US008679822B2

(12) United States Patent
Caimi et al.

(10) Patent No.: US 8,679,822 B2
(45) Date of Patent: Mar. 25, 2014

(54) XYLOSE UTILIZATION IN RECOMBINANT ZYMOMONAS

(75) Inventors: Perry G. Caimi, Kennett Square, PA (US); Laura McCole, East Fallowfield, PA (US); Luan Tao, Wallingford, PA (US); Jean-Francois Tomb, Wilmington, DE (US); Paul V. Viitanen, West Chester, PA (US)

(73) Assignee: E I du Pont de Nemours and Company, Wilmington, DE (US)

( * ) Notice: Subject to any disclaimer, the term of this patent is extended or adjusted under 35 U.S.C. 154(b) by 51 days.

(21) Appl. No.: 13/161,734

(22) Filed: Jun. 16, 2011

(65) Prior Publication Data

US 2012/0156746 A1 Jun. 21, 2012

Related U.S. Application Data

(60) Provisional application No. 61/359,445, filed on Jun. 29, 2010.

(51) Int. Cl.

| | |
|---|---|
| ***C12N 1/20*** | (2006.01) |
| ***C12N 9/24*** | (2006.01) |
| ***C12N 9/90*** | (2006.01) |
| ***C12N 15/00*** | (2006.01) |
| ***C12N 15/74*** | (2006.01) |
| ***C12P 21/06*** | (2006.01) |
| ***C07H 21/02*** | (2006.01) |
| ***C07H 21/04*** | (2006.01) |

(52) U.S. Cl.

USPC ....... 435/252.3; 435/200; 435/233; 435/69.1; 435/161; 435/471; 435/476; 435/320.1; 536/23.1; 536/23.2; 536/23.4; 536/23.7

(58) Field of Classification Search

None

See application file for complete search history.

(56) References Cited

U.S. PATENT DOCUMENTS

| | | | | |
|---|---|---|---|---|
| 5,514,583 A | | 5/1996 | Picataggio et al. | |
| 5,712,133 A | | 1/1998 | Picataggio et al. | |
| 6,566,107 B1 | | 5/2003 | Zhang | |
| 7,223,575 B2 | | 5/2007 | Zhang et al. | |
| 7,741,084 B2 | | 6/2010 | Viitanen et al. | |
| 7,741,119 B2 | | 6/2010 | Viitanen et al. | |
| 7,803,623 B2 | | 9/2010 | Caimi et al. | |
| 7,897,396 B2 | | 3/2011 | Caimi et al. | |
| 7,989,206 B2 | | 8/2011 | Viitanen et al. | |
| 7,998,722 B2 | | 8/2011 | Viitanen et al. | |
| 2008/0261287 A1 | * | 10/2008 | Winkler et al. | 435/161 |
| 2011/0014670 A1 | | 1/2011 | Caimi et al. | |
| 2011/0143408 A1 | | 6/2011 | Yang | |

OTHER PUBLICATIONS

Karhumaa, Kaisa et al., Investigation of limiting metabolic steps in the utilization of xylose by recombinant *Saccharomyces cervisiae* using metablic engineering, Yeast, 2005, pp. 359-368, vol. 22.

International Search Report dated Oct. 21, 2011, International Application No. PCT/US2011/042122.

Feldmann, Sigrun D. et al., Pentose metabolism in *Zymomonas mobilis* wild-type and recombinant strains, Applied Microbiology and Biotechnology, 1992, pp. 354-361, vol. 38, Springer-Verlag.

Yanase, Hideshi et al., Genetic Engineering of *Zymobacter palmae* for Production of Ethanol from Xylose, Applied and Environmental Microbiology, Apr. 2007, pp. 2592-2599, vol. 73, No. 8, American Society for Microbiology.

Zhang, Min et al., Metabolic Engineering of a Pentose Metabolism Pathway in Ethanologenic *Zymomonas mobilis,* Science, Jan. 13, 1995, pp. 240-243, vol. 267.

Kahsay, Robel et al., U.S. Appl. No. 13/161,749, filed Jun. 16, 2011.

* cited by examiner

*Primary Examiner* — Robert Mondesi
*Assistant Examiner* — Iqbal H Chowdhury

(57) ABSTRACT

Xylose-utilizing *Zymomonas* strains studied were found to accumulate ribulose when grown in xylose-containing media. Engineering these strains to increase ribose-5-phosphate isomerase activity led to reduced ribulose accumulation, improved growth, improved xylose utilization, and increased ethanol production.

12 Claims, 7 Drawing Sheets

XYLOSE UTILIZATION IN RECOMBINANT ZYMOMONAS

This application claims the benefit of U.S. Provisional Application 61/359,445, filed Jun. 29, 2010.

STATEMENT OF GOVERNMENT RIGHTS

This invention was made with United States government support under Contract Nos. DE-FC36-07GO17056 awarded by the Department of Energy. The government has certain rights in this invention.

FIELD OF THE INVENTION

The invention relates to the fields of microbiology and genetic engineering. More specifically, increasing ribose-5-phosphate isomerase activity in xylose utilizing *Z. mobilis* improved xylose utilization by the microorganism.

BACKGROUND OF THE INVENTION

Production of ethanol by microorganisms provides an alternative energy source to fossil fuels and is therefore an important area of current research. It is desirable that microorganisms producing ethanol, as well as other useful products, be capable of using xylose as a carbon source since xylose is the major pentose in hydrolyzed lignocellulosic biomass. Biomass can provide an abundantly available, low cost carbon substrate. *Zymomonas mobilis* and other bacterial ethanologens which do not naturally utilize xylose have been genetically engineered for xylose utilization by introduction of genes encoding 1) xylose isomerase, which catalyses the conversion of xylose to xylulose; 2) xylulokinase, which phosphorylates xylulose to form xylulose 5-phosphate; 3) transketolase; and 4) transaldolase.

There has been success in engineering *Z. mobilis* strains for xylose metabolism (U.S. Pat. No. 5,514,583, U.S. Pat. No. 5,712,133, U.S. Pat. No. 6,566,107, WO 95/28476, Feldmann et al. (1992) *Appl Microbiol Biotechnol* 38: 354-361, Zhang et al. (1995) Science 267:240-243), as well as a *Zymobacter palmae* strain (Yanase et al. (2007) *Appl. Environ. Mirobiol.* 73:2592-2599). However, typically the engineered strains do not grow and produce ethanol as well on xylose as on glucose. Strains engineered for xylose utilization have been adapted by serial passage on xylose medium, resulting in strains with improved xylose utilization as described in U.S. Pat. No. 7,223,575 and commonly owned and co-pending U.S. Pat. No. 7,741,119. Disclosed in commonly owned and co-pending US Patent App. No. US 2009-0246846 A1 is the finding that an adapted strain with higher xylose utilization has increased xylose isomerase activity, and engineering for improved xylose utilization by expression of xylose isomerase from a mutated, highly active *Zymomonas mobilis* glyceraldehyde-3-phosphate dehydrogenase gene promoter (Pgap). However xylose utilization is still not comparable to glucose utilization.

There remains a need for strains of *Zymomonas*, and other bacterial ethanolagens, which have further improvement in xylose utilization.

SUMMARY OF THE INVENTION

The invention provides ethanol producing, recombinant xylose-utilizing *Zymomonas* or *Zymobacter* cells that are engineered to have increased ribose-5-phosphate isomerase (RPI) activity. It has been discovered that, in strains where xylose isomerase activity is high, the carbon flux to RPI is also high and results in the generation of the undesirable by products ribulose-5-phosphate and/or ribulose (catalyzed by cellular phosphotases), which accumulate in the medium. Generation of these by-products siphons off carbon that could be used in the production of ethanol. Applicants' solution to this newly discovered problem is to increase the activity of RPI to direct more carbon to the desired products of the xylose metabolic pathway (fructose-6 phosphate and glyceraldyhyde-6 phosphate) which are used in the generation of ethanol. Thus, in xylose-utilizing *Zymomonas* or *Zymobacter* strains that accumulate ribulose-5-phosphate and/or ribulose when grown in xylose containing medium, an increase in RPI activity improves cell growth, xylose utilization, and ethanol production.

Accordingly, the invention provides a recombinant bacterial host cell comprising:

a) a xylose metabolic pathway comprising at least one gene encoding a polypeptide having xylose isomerase activity;

b) at least one gene encoding a polypeptide having ribose-5-phosphate isomerase activity; and c) at least one genetic modification which increases ribose-5-phosphate isomerase activity in the host cell as compared with ribose-5-phosphate isomerase activity in the host cell lacking said genetic modification;

wherein, the bacterial host cell utilizes xylose to produce ethanol; and wherein the bacterial host cell is selected from the group consisting of *Zymomonas* and *Zymobacter*.

The ribose-5-phosphate isomerase of the invention may be of the "A" type or the "B" type as described herein. Preferred "A" type ribose-5-phosphate isomerases are those that: i) give an E-value score of 0.1 or less when queried using a Profile Hidden Markov Model prepared using SEQ ID NOs: 83, 84, 85, 86, 87, 88, 89, 90, 91, 92, 93, 94, 95, 96, and 97; the query being carried out using the hmmsearch algorithm wherein the Z parameter is set to 1 billion, and ii) have aspartic acid and glutamic acid at positions corresponding to 107 and 129, respectively, in the *Saccharomyces cerevisiae* RPI-A protein of SEQ ID NO:97.

Similarly, preferred "B" type ribose-5-phosphate isomerases are those that i) give an E-value score of 0.1 or less when queried using a Profile Hidden Markov Model prepared using SEQ ID NOs:1213, 1214, 1215, 1216, and 1217; the query being carried out using the hmmsearch algorithm wherein the Z parameter is set to 1 billion;

ii) either have cysteine and threonine at positions corresponding to 66 and 68, respectively, in the *E. coli* RPI-B protein of SEQ ID NO:1216 or have serine and glutamic acid at positions corresponding to 68 and 72, respectively, in the *M. tuberculosis* RPI-B protein of SEQ ID NO:1213, and iii) have asparagine, glycine, aspartic acid, serine, or glutamic acid but not leucine at the position corresponding to 100 in the *E. coli* RPI-B protein of SEQ ID NO:1216.

Preferred xylose isomerases of the invention are those that have an E-value score of less than or equal to $3\times10^{-10}$ when queried using a Profile HMM prepared using SEQ ID NOs: 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, and 81, and having four catalytic site residues: histine 54, aspartic acid 57, glutamic acid 181, and lysine 183, with the position numbers in reference to the *Streptomyces albus* xylose isomerase sequence of SEQ ID NO:61.

Additionally the invention provides a method for making a recombinant bacterial host cell for the production of ethanol comprising:

a) providing a *Zymomonas* or *Zymobacter* bacterial host cell comprising a xylose metabolic pathway wherein the bacterial host cell produces ethanol in the presence of xylose and accumulates ribulose-5-phosphate, ribulose, or both ribulose-5-phosphate and ribulose in a medium when grown in a medium comprising xylose; and b) genetically modifying the bacterial host cell of (a) wherein the genetic modification increases ribose-5-phosphate isomerase activity in the host cell as compared with ribose-5-phosphate isomerase activity in the host cell lacking said genetic modification;

wherein ribulose-5-phosphate, ribulose, or both ribulose-5-phosphate and ribulose no longer accumulate in the medium.

In another embodiment the invention provides a process for producing ethanol comprising:

a) providing a ethanol producing recombinant bacterial host cell of the invention; and b) culturing the host of (a) in a medium comprising xylose whereby xylose is converted to ethanol.

BRIEF DESCRIPTION OF THE BIOLOGICAL DEPOSITS, FIGURES AND SEQUENCE DESCRIPTIONS

Applicants have made the following biological deposits under the terms of the Budapest Treaty on the International Recognition of the Deposit of Microorganisms for the Purposes of Patent Procedure:

Information on Deposited Strains

| Depositor Identification Reference | International Depository Designation | Date of Deposit |
|---|---|---|
| *Zymomonas* ZW658 | ATCC No PTA-7858 | Sep. 12, 2006 |

Figure 6:
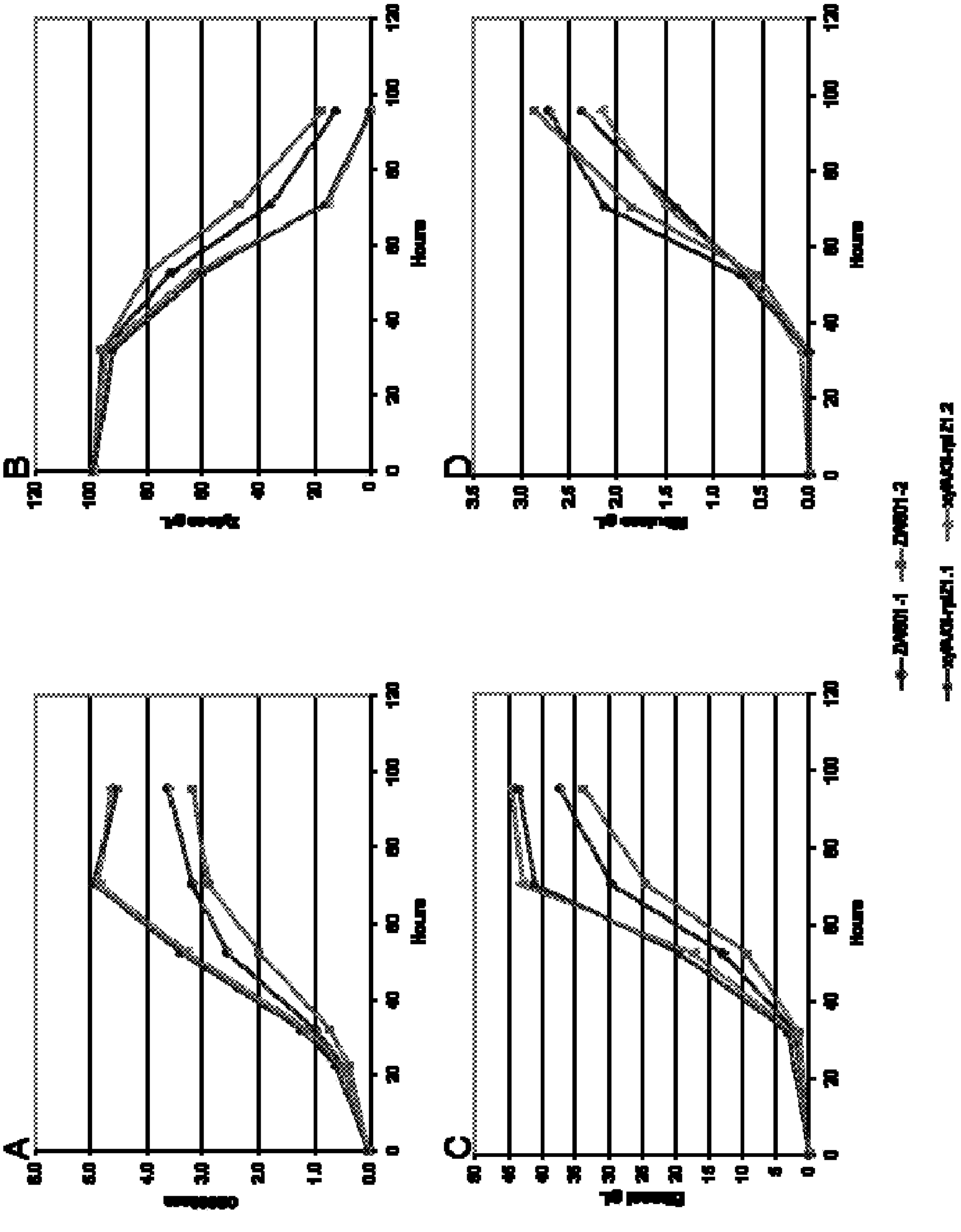

FIG. 6 shows graphs of growth (A), xylose utilization (B), ethanol production (C), and ribulose accumulation in media (D) of cultures of ZW801-4 control strains (ZW801-1 and ZW801-2) and ZW801-4 strains containing a plasmid containing a chimeric gene with an *A. missouriensis* GI promoter and *Z. mobilis* RPI-A coding region and a plasmid containing a chimeric gene with *Z. mobilis* GAP promoter and *E. coli* xylA coding region (xylA/G1-rpiZ1.1 and xylA/G1-rpiZ1.2).

Figure 7:
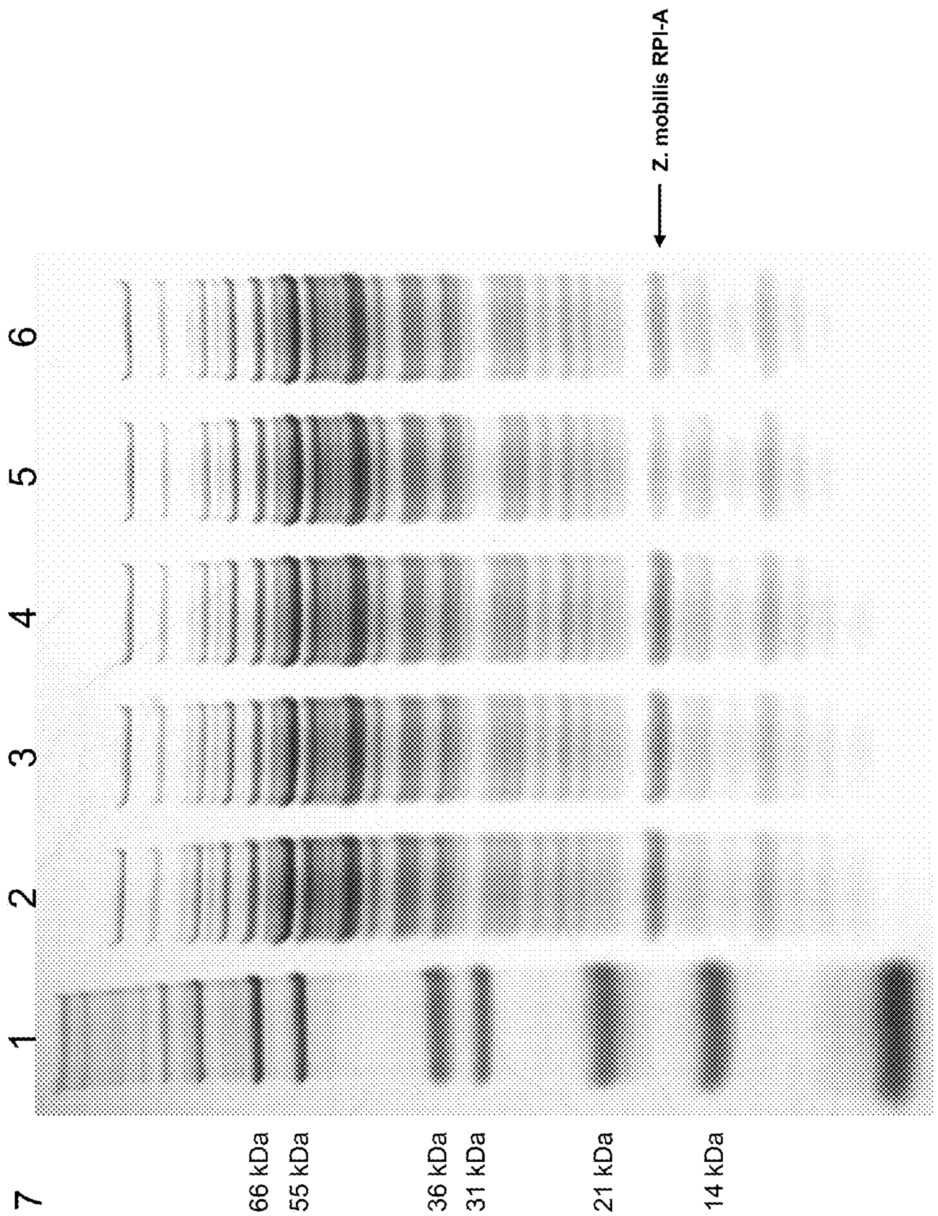

FIG. 7 shows a stained gel of markers (lane 1) and total protein extracts of cells expressing RPI-A with an ATG start codon in ZW801 GAP-rpi-1, ZW801 GAP-rpi-3 and ZW801 GAP-rpi-4 (lanes 2, 3, and 4, respectively) and controls expressing RPI-A with the native GTG start codon (lanes 5 and 6), with the position of the *Z. mobilis* RPI-A protein marked by an arrow.

Table 3 is a table of the Profile HMM for xylose isomerases. Table 3 is submitted herewith electronically and is incorporated herein by reference.

Table 4 is a table of the Profile HMM for RPI-A proteins. Table 4 is submitted herewith electronically and is incorporated herein by reference.

Table 5 is a table of the Profile HMM for RPI-B proteins. Table 5 is submitted herewith electronically and is incorporated herein by reference.

The following sequences conform with 37 C.F.R. 1.821-1.825 ("Requirements for patent applications Containing Nucleotide Sequences and/or Amino Acid Sequence Disclosures—the Sequence Rules") and consistent with World Intellectual Property Organization (WIPO) Standard ST.25 (1998) and the sequence listing requirements of the EPO and PCT (Rules 5.2 and 49.5(a-bis), and Section 208 and Annex C of the Administrative Instructions). The symbols and format used for nucleotide and amino acid sequence data comply with the rules set forth in 37 C.F.R. §1.822.

SEQ ID NOs:1-13 are oligonucleotide primers.

SEQ ID NO:14 is the nucleotide sequence of the promoter from the glucose isomerase gene of *Actinoplanes missouriensis.*

SEQ ID NO:15 is the nucleotide sequence of the pZB188/aadA plasmid.

SEQ ID NO:16 is the nucleotide sequence of the pZB-GI-RPI plasmid.

SEQ ID NO:17 is the nucleotide sequence of the glyceraldehyde-3-phosphate dehydrogenase (GAP) promoter from *Z. mobilis* strain ZW1 (ZW4).

SEQ ID NO:18 is the nucletotide sequence of the xylose isomerase expression cassette PgapXylA.

TABLE 1

SEQ ID numbers of xylose isomerase proteins and their coding regions

| Organism | SEQ ID NO: Protein | SEQ ID NO: Coding region |
|---|---|---|
| *Escherichia coli* K12 | 19 | 20 |
| *Lactobacillus brevis* ATCC 367 | 21 | 22 |
| *Thermoanaerobacterium* | 23 | 24 |
| *Clostridium thermosulfurogenes* | 25 | 26 |
| *Actinoplanes Missouriensis* | 27 | 28 |
| *Arthrobacter* Strain B3728 | 29 | 30 |
| *Baccillus licheniformis* ATCC 14580 | 31 | 32 |
| *Geobacillus stearothermophilus* | 33 | 34 |
| *Bacillus coagulans* 36D1 | 35 | 36 |
| *Bacillus subtilis* subsp. *subtilis* str. 168 | 37 | 38 |
| *Bacteroides vulgatus* ATCC 8482 | 39 | 40 |
| *Bifidobacterium adolescentis* ATCC 15703 | 41 | 42 |
| *Erwinia carotovora* subsp. *atroseptica* SCRI1043 | 43 | 44 |
| *Hordeum vulgare* subsp. *vulgare* | 45 | 46 |
| *Klebsiella pneumoniae* subsp. *pneumoniae* MGH 78578 | 47 | 48 |
| *Lactococcus lactis* subsp. *lactis* | 49 | 50 |

TABLE 1-continued

SEQ ID numbers of xylose isomerase proteins and their coding regions

| Organism | SEQ ID NO: Protein | SEQ ID NO: Coding region |
|---|---|---|
| *Lactobacillus reuteri* 100-23 | 51 | 52 |
| *Leuconostoc mesenteroides* subsp. *mesenteroides* ATCC 8293 | 53 | 54 |
| *Thermoanaerobacterium Thermosulfurisgenes* | 55 | 56 |
| *Thermotoga Neapolitana* | 57 | 58 |
| *Streptomyces Rubiginosus* | 59 | 60 |
| *Streptomyces albus* | 61 | 62[1] |
| *Thermus thermophilus* | 63 | 64 |
| *Streptomyces diastaticus* | 65 | 66 |
| *Streptomyces coelicolor* A3(2) | 67 | 68 |
| *Thermus Caldophilus* | 69 | 70[2] |
| *Xanthomonas campestris* pv. *vesicatoria* str. 85-10 | 71 | 72 |
| *Thermus aquaticus* | 73 | 74[3] |
| *Tetragenococcus halophilus* | 75 | 76 |
| *Staphylococcus xylosus* | 77 | 78 |
| *Mycobacterium smegmatis* str. MC2 155 | 79 | 80 |
| *Piromyces* sp. E2 | 81 | 82 |

[1]This coding sequence is designed, based on the *Streptomyces rubiginosus* coding sequence, to encode the *Streptomyces albus* protein (which has three amino acid differences with the *Streptomyces rubiginosus* protein.

[2]This coding sequence is designed, based on a *Thermus thermophilus* coding sequence, to encode the *Thermus Caldophilus* protein (which has 21 amino acid differences with the *Streptomyces rubiginosus* protein.

[3]This coding sequence is from *Thermus thermophilus* and translates to the *Thermus aquaticus* protein, although the *Thermus aquaticus* coding sequence may have differences due to codon degeneracy.

TABLE 2

SEQ ID numbers of ribose-5-phosphate isomerase proteins used as seed sequences for RPI-A structure analysis and their coding regions

| Organism | SEQ ID NO: protein | SEQ ID NO: coding region |
|---|---|---|
| *Escherichia coli* str. K-12 substr. DH10B | 83 | 2108 |
| *Enterobacter cloacae* | 84 | 2109 |
| *Vibrio vulnificus* | 85 | 2110 |
| *Thermus thermophilus* HB8 | 86 | 2111 |
| *Chlamydomonas reinhardtii* | 87 | 2112 |
| *Spinacia oleracea* | 88 | 2113 |
| *Arabidopsis thaliana* | 89 | 2114 |
| *Arabidopsis thaliana* | 90 | 2115 |
| *Plasmodium falciparum* 3D7 | 91 | 2116 |
| *Pyrococcus horikosshii* OT3 | 92 | 2117 |
| *Methanocaldococcus jannaschii* DSM 2661 | 93 | 2118 |
| *Fibrobacter succinogenes* subsp. *succinogenes* S85 | 94 | 2119 |
| *Homo sapiens* | 95 | 2120 |
| *Caenorthabditis elegans* | 96 | 2121 |
| *Saccharomyces cerevisiae* | 97 | 2122 |

SEQ ID NOs:98-1212 are RPI-A ribose-5-phosphate isomerase proteins.

SEQ ID NOs:2123-3237 are sequences encoding RPI-A ribose-5-phosphate isomerase proteins.

TABLE 3

SEQ ID numbers of ribose-5-phosphate isomerase proteins used as seed sequences for RPI-B structure analysis and their coding regions

| Organism | SEQ ID NO: protein | SEQ ID NO: coding region |
|---|---|---|
| *Mycobacterium tuberculosis* CDC1551 | 1213 | 3238 |
| *Thermotoga maritima* MSB8 | 1214 | 3239 |
| *Clostridium thermocellum* ATCC 27405 | 1215 | 3240 |
| *Escherichia coli* str. K-12 substr. MG1655 | 1216 | 3241 |
| *Trypanosoma cruzi* strain *CL Brener* | 1217 | 3242 |

SEQ ID NOs:1218-2107 are RPI-B ribose-5-phosphate isomerase proteins.

SEQ ID NOs:3243-4132 are sequences encoding RPI-B ribose-5-phosphate isomerase proteins.

DETAILED DESCRIPTION

Disclosed herein are xylose-utilizing *Zymomonas* or *Zymobacter* strains that are genetically modified to have increased expression of ribose-5-phosphate isomerase (RPI) activity, as compared to strains without the genetic modification. When ribulose is produced as a side product in xylose utilization, the increased RPI activity provides improved xylose utilization, which is desired for growth in media containing xylose including saccharified biomass, leading to increased ethanol production. Ethanol is an important compound for use in replacing fossil fuels and saccharified biomass provides a renewable carbon source for ethanol production by fermentation.

The following definitions may be used for the interpretation of the claims and specification:

As used herein, the terms "comprises," "comprising," "includes," "including," "has," "having," "contains" or "containing," or any other variation thereof, are intended to cover a non-exclusive inclusion. For example, a composition, a mixture, process, method, article, or apparatus that comprises a list of elements is not necessarily limited to only those elements but may include other elements not expressly listed or inherent to such composition, mixture, process, method, article, or apparatus. Further, unless expressly stated to the contrary, "or" refers to an inclusive or and not to an exclusive or. For example, a condition A or B is satisfied by any one of the following: A is true (or present) and B is false (or not present), A is false (or not present) and B is true (or present), and both A and B are true (or present).

Also, the indefinite articles "a" and "an" preceding an element or component of the invention are intended to be nonrestrictive regarding the number of instances (i.e. occurrences) of the element or component. Therefore "a" or "an" should be read to include one or at least one, and the singular word form of the element or component also includes the plural unless the number is obviously meant to be singular.

The term "invention" or "present invention" as used herein is a non-limiting term and is not intended to refer to any single embodiment of the particular invention but encompasses all possible embodiments as described in the specification and the claims.

As used herein, the term "about" modifying the quantity of an ingredient or reactant of the invention employed refers to variation in the numerical quantity that can occur, for example, through typical measuring and liquid handling procedures used for making concentrates or use solutions in the real world; through inadvertent error in these procedures; through differences in the manufacture, source, or purity of the ingredients employed to make the compositions or carry out the methods; and the like. The term "about" also encompasses amounts that differ due to different equilibrium conditions for a composition resulting from a particular initial mixture. Whether or not modified by the term "about", the claims include equivalents to the quantities. In one embodiment, the term "about" means within 10% of the reported numerical value, preferably within 5% of the reported numerical value.

The term "carbon substrate" or "fermentable carbon substrate" refers to a carbon source capable of being metabolized by host organisms of the present invention and particularly carbon sources selected from the group consisting of monosaccharides, oligosaccharides, and polysaccharides.

"Gene" refers to a nucleic acid fragment that expresses a specific protein or functional RNA molecule, which may optionally include regulatory sequences preceding (5' non-coding sequences) and following (3' non-coding sequences) the coding sequence. "Native gene" or "wild type gene" refers to a gene as found in nature with its own regulatory sequences. "Chimeric gene" refers to any gene that is not a native gene, comprising regulatory and coding sequences that are not found together in nature. Accordingly, a chimeric gene may comprise regulatory sequences and coding sequences that are derived from different sources, or regulatory sequences and coding sequences derived from the same source, but arranged in a manner different than that found in nature. "Endogenous gene" refers to a native gene in its natural location in the genome of an organism. A "foreign" gene refers to a gene not normally found in the host organism, but that is introduced into the host organism by gene transfer. Foreign genes can comprise native genes inserted into a non-native organism, or chimeric genes.

The term "genetic construct" refers to a nucleic acid fragment that encodes for expression of one or more specific proteins or functional RNA molecules. In a gene construct the gene may be native, chimeric, or foreign in nature. Typically a genetic construct will comprise a "coding sequence". A "coding sequence" refers to a DNA sequence that encodes a specific amino acid sequence.

"Promoter" or "Initiation control regions" refers to a DNA sequence capable of controlling the expression of a coding sequence or functional RNA. In general, a coding sequence is located 3' to a promoter sequence. Promoters may be derived in their entirety from a native gene, or be composed of different elements derived from different promoters found in nature, or even comprise synthetic DNA segments. It is understood by those skilled in the art that different promoters may direct the expression of a gene in different tissues or cell types, or at different stages of development, or in response to different environmental conditions. Promoters which cause a gene to be expressed in most cell types at most times are commonly referred to as "constitutive promoters".

The term "genetic modification" refers, non-inclusively, to any modification, mutation, base deletion, base addition, codon modification, gene over-expression, gene suppression, promoter modification or substitution, gene addition (either single or multicopy), antisense expression or suppression, or any other change to the genetic elements of a host cell or bacterial strain, whether they produce a change in phenotype or not.

The term "recombinant bacterial host cell" refers to a bacterial cell that comprises at least one heterologus gene or genetic construct or nucleic acid fragment.

The term "expression", as used herein, refers to the transcription and stable accumulation of coding (mRNA) or functional RNA derived from a gene. Expression may also refer to translation of mRNA into a protein. "Antisense inhibition" refers to the production of antisense RNA transcripts capable of suppressing the expression of the target protein. "Over-expression" refers to the production of a gene product in transgenic organisms that exceeds levels of production in normal or non-transformed organisms. "Co-suppression" refers to the production of sense RNA transcripts or fragments capable of suppressing the expression of identical or substantially similar foreign or endogenous genes (U.S. Pat. No. 5,231,020). The term "transformation" as used herein, refers to the transfer of a nucleic acid fragment into a host organism, resulting in genetically stable inheritance. The transferred nucleic acid may be in the form of a plasmid maintained in the host cell, or some transferred nucleic acid may be integrated into the genome of the host cell. Host organisms containing the transformed nucleic acid fragments are referred to as "transgenic" or "recombinant" or "transformed" organisms.

The terms "plasmid" and "vector" as used herein, refer to an extra chromosomal element often carrying genes which are not part of the central metabolism of the cell, and usually in the form of circular double-stranded DNA molecules. Such elements may be autonomously replicating sequences, genome integrating sequences, phage or nucleotide sequences, linear or circular, of a single- or double-stranded DNA or RNA, derived from any source, in which a number of nucleotide sequences have been joined or recombined into a unique construction which is capable of introducing a promoter fragment and DNA sequence for a selected gene product along with appropriate 3' untranslated sequence into a cell.

The term "operably linked" refers to the association of nucleic acid sequences on a single nucleic acid fragment so that the function of one is affected by the other. For example, a promoter is operably linked with a coding sequence when it is capable of affecting the expression of that coding sequence (i.e., that the coding sequence is under the transcriptional control of the promoter). Coding sequences can be operably linked to regulatory sequences in sense or antisense orientation.

The term "selectable marker" means an identifying factor, usually an antibiotic or chemical resistance gene, that is able to be selected for based upon the marker gene's effect, i.e., resistance to an antibiotic, wherein the effect is used to track the inheritance of a nucleic acid of interest and/or to identify a cell or organism that has inherited the nucleic acid of interest.

As used herein the term "codon degeneracy" refers to the nature in the genetic code permitting variation of the nucleotide sequence without affecting the amino acid sequence of an encoded protein. The skilled artisan is well aware of the "codon-bias" exhibited by a specific host cell in usage of nucleotide codons to specify a given amino acid. Therefore, when synthesizing a gene for improved expression in a host cell, it is desirable to design the gene such that its frequency of codon usage approaches the frequency of preferred codon usage of the host cell.

The term "codon-optimized" as it refers to genes or coding regions of nucleic acid molecules for transformation of various hosts, refers to the alteration of codons in the gene or coding regions of the nucleic acid molecules to reflect the typical codon usage of the host organism without altering the protein encoded by the DNA.

The term "lignocellulosic" refers to a composition comprising both lignin and cellulose. Lignocellulosic material may also comprise hemicellulose.

The term "cellulosic" refers to a composition comprising cellulose and additional components, including hemicellulose.

The term "saccharification" refers to the production of fermentable sugars from polysaccharides.

The term "pretreated biomass" means biomass that has been subjected to physical, chemical and/or thermal pretreatment to increase accessibility of polysaccharides in the biomass prior to saccharification.

"Biomass" refers to any cellulosic or lignocellulosic material and includes materials comprising cellulose, and optionally further comprising hemicellulose, lignin, starch, oligosaccharides and/or monosaccharides. Biomass may also comprise additional components, such as protein and/or lipid. Biomass may be derived from a single source, or biomass can comprise a mixture derived from more than one source; for example, biomass could comprise a mixture of corn cobs and corn stover, or a mixture of grass and leaves. Biomass includes, but is not limited to, bioenergy crops, agricultural residues, municipal solid waste, industrial solid waste, sludge from paper manufacture, yard waste, wood and forestry waste. Examples of biomass include, but are not limited to, corn cobs, crop residues such as corn husks, corn stover, grasses, wheat straw, barley straw, hay, rice straw, switchgrass, waste paper, sugar cane bagasse, sorghum, soy, components obtained from milling of grains, trees, branches, roots, leaves, wood chips, sawdust, shrubs and bushes, vegetables, fruits, flowers and animal manure.

"Biomass hydrolysate" refers to the product resulting from saccharification of biomass. The biomass may also be pretreated or pre-processed prior to saccharification.

The term "xylose metabolic pathway" or "xylose utilization pathway" refers to a series of enzymes (encoded by genes) that metabolize xylose through to fructose-6-phosphate and/or glyceraldehyde-6-phosphate and include 1) xylose isomerase, which catalyses the conversion of xylose to xylulose; 2) xylulokinase, which phosphorylates xylulose to form xylulose 5-phosphate; 3) transketolase; and 4) transaldolase.

The term "xylose isomerase" refers to an enzyme that catalyzes the interconversion of D-xylose and D-xylulose. Xylose isomerases (XI) belong to the group of enzymes classified as EC 5.3.1.5.

The term "ribose-5-phosphate isomerase" or "RPI" refers to an enzyme that catalyzes the interconversion of ribulose-5-phosphate and ribose-5-phosphate. Ribose-5-phosphate isomerases belong to the group of enzymes classified as EC 5.3.1.6.

The term "E-value", as known in the art of bioinformatics, is "Expect-value" which provides the probability that a match will occur by chance. It provides the statistical significance of the match to a sequence. The lower the E-value, the more significant the hit.

The term "*Z. mobilis* RPI-A" refers to the *Z. mobilis* RPI which has been labeled in the art as RPI-A. However, the *Z. mobilis* RPI protein has closer sequence identity to the *E. coli* RPI-B protein (36%) than to the *E. coli* RPI-A protein (20%) and further analysis of RPIs described herein places the *Z. mobilis* RPI in the RPI-B group. However, herein the *Z. mobilis* RPI is called RPI-A to be consistent with its publicly known name.

The term "heterologous" means not naturally found in the location of interest. For example, a heterologous gene refers to a gene that is not naturally found in the host organism, but that is introduced into the host organism by gene transfer. For example, a heterologous nucleic acid molecule that is present in a chimeric gene is a nucleic acid molecule that is not naturally found associated with the other segments of the chimeric gene, such as the nucleic acid molecules having the coding region and promoter segments not naturally being associated with each other.

As used herein, an "isolated nucleic acid molecule" is a polymer of RNA or DNA that is single- or double-stranded, optionally containing synthetic, non-natural or altered nucleotide bases. An isolated nucleic acid molecule in the form of a polymer of DNA may be comprised of one or more segments of cDNA, genomic DNA or synthetic DNA.

A nucleic acid fragment is "hybridizable" to another nucleic acid fragment, such as a cDNA, genomic DNA, or RNA molecule, when a single-stranded form of the nucleic acid fragment can anneal to the other nucleic acid fragment under the appropriate conditions of temperature and solution ionic strength. Hybridization and washing conditions are well known and exemplified in Sambrook, J., Fritsch, E. F. and Maniatis, T. *Molecular Cloning: A Laboratory Manual,* 2$^{nd}$ ed., Cold Spring Harbor Laboratory: Cold Spring Harbor, N.Y. (1989), particularly Chapter 11 and Table 11.1 therein (entirely incorporated herein by reference). The conditions of temperature and ionic strength determine the "stringency" of the hybridization. Stringency conditions can be adjusted to screen for moderately similar fragments (such as homologous sequences from distantly related organisms), to highly similar fragments (such as genes that duplicate functional enzymes from closely related organisms). Post-hybridization washes determine stringency conditions. One set of preferred conditions uses a series of washes starting with 6×SSC, 0.5% SDS at room temperature for 15 min, then repeated with 2×SSC, 0.5% SDS at 45° C. for 30 min, and then repeated twice with 0.2×SSC, 0.5% SDS at 50° C. for 30 min. A more preferred set of stringent conditions uses higher temperatures in which the washes are identical to those above except for the temperature of the final two 30 min washes in 0.2×SSC, 0.5% SDS was increased to 60° C. Another preferred set of highly stringent conditions uses two final washes in 0.1×SSC, 0.1% SDS at 65° C. An additional set of stringent conditions include hybridization at 0.1×SSC, 0.1% SDS, 65° C. and washes with 2×SSC, 0.1% SDS followed by 0.1×SSC, 0.1% SDS, for example.

Hybridization requires that the two nucleic acids contain complementary sequences, although depending on the stringency of the hybridization, mismatches between bases are possible. The appropriate stringency for hybridizing nucleic acids depends on the length of the nucleic acids and the degree of complementation, variables well known in the art. The greater the degree of similarity or homology between two nucleotide sequences, the greater the value of Tm for hybrids of nucleic acids having those sequences. The relative stability (corresponding to higher Tm) of nucleic acid hybridizations decreases in the following order: RNA:RNA, DNA:RNA, DNA:DNA. For hybrids of greater than 100 nucleotides in length, equations for calculating Tm have been derived (see Sambrook et al., supra, 9.50-9.51). For hybridizations with shorter nucleic acids, i.e., oligonucleotides, the position of mismatches becomes more important, and the length of the oligonucleotide determines its specificity (see Sambrook et al., supra, 11.7-11.8). In one embodiment the length for a hybridizable nucleic acid is at least about 10 nucleotides. Preferably a minimum length for a hybridizable nucleic acid is at least about 15 nucleotides; more preferably at least about 20 nucleotides; and most preferably the length is at least about 30 nucleotides. Furthermore, the skilled artisan will recognize that the temperature and wash solution salt concentration may be adjusted as necessary according to factors such as length of the probe. The term "complementary" is used to describe the relationship between nucleotide bases that are capable of hybridizing to one another. For example, with respect to DNA, adenosine is complementary to thymine and cytosine is complementary to guanine.

The term "homologous" refers to nucleic acid fragments wherein changes in one or more nucleotide bases do not affect the ability of the nucleic acid fragment to mediate gene expression or produce a certain phenotype. The term also refers to modifications of the nucleic acid fragments of the instant invention such as deletion or insertion of one or more nucleotides that do not substantially alter the functional properties of the resulting nucleic acid fragment relative to the initial, unmodified fragment. It is therefore understood, as those skilled in the art will appreciate, that the invention encompasses more than the specific exemplary sequences.

Moreover, the skilled artisan recognizes that homologous nucleic acid sequences encompassed by this invention are also defined by their ability to hybridize, under moderately stringent conditions (e.g., 0.5×SSC, 0.1% SDS, 60° C.) with the sequences exemplified herein, or to any portion of the nucleotide sequences disclosed herein and which are functionally equivalent to any of the nucleic acid sequences disclosed herein.

The term "percent identity", as known in the art, is a relationship between two or more polypeptide sequences or two or more polynucleotide sequences, as determined by comparing the sequences. In the art, "identity" also means the degree of sequence relatedness between polypeptide or polynucleotide sequences, as the case may be, as determined by the match between strings of such sequences. "Identity" and "similarity" can be readily calculated by known methods, including but not limited to those described in: 1.) *Computational Molecular Biology* (Lesk, A. M., Ed.) Oxford University: NY (1988); 2.) *Biocomputing: Informatics and Genome Projects* (Smith, D. W., Ed.) Academic: NY (1993); 3.) *Computer Analysis of Sequence Data, Part I* (Griffin, A. M., and Griffin, H. G., Eds.) Humania: NJ (1994); 4.) *Sequence Analysis in Molecular Biology* (von Heinje, G., Ed.) Academic (1987); and 5.) *Sequence Analysis Primer* (Gribskov, M. and Devereux, J., Eds.) Stockton: NY (1991).

Preferred methods to determine identity are designed to give the best match between the sequences tested. Methods to determine identity and similarity are codified in publicly available computer programs. Sequence alignments and percent identity calculations may be performed using the MegAlign™ program of the LASERGENE bioinformatics computing suite (DNASTAR Inc., Madison, Wis.). Multiple alignment of the sequences is performed using the "Clustal method of alignment" which encompasses several varieties of the algorithm including the "Clustal V method of alignment" corresponding to the alignment method labeled Clustal V (described by Higgins and Sharp, *CABIOS.* 5:151-153 (1989); Higgins, D. G. et al., *Comput. Appl. Biosci.,* 8:189-191 (1992)) and found in the MegAlign™ program of the LASERGENE bioinformatics computing suite (DNASTAR Inc.). For multiple alignments, the default values correspond to GAP PENALTY=10 and GAP LENGTH PENALTY=10. Default parameters for pairwise alignments and calculation of percent identity of protein sequences using the Clustal method are KTUPLE=1, GAP PENALTY=3, WINDOW=5 and DIAGONALS SAVED=5. For nucleic acids these parameters are KTUPLE=2, GAP PENALTY=5, WINDOW=4 and DIAGONALS SAVED=4. After alignment of the sequences using the Clustal V program, it is possible to obtain a "percent identity" by viewing the "sequence distances" table in the same program. Additionally the "Clustal W method of alignment" is available and corresponds to the alignment method labeled Clustal W (described by Higgins and Sharp, *CABIOS.* 5:151-153 (1989); Higgins, D. G. et al., *Comput. Appl. Biosci.* 8:189-191 (1992)) and found in the MegAlign™ v6.1 program of the LASERGENE bioinformatics computing suite (DNASTAR Inc.). Default parameters for multiple alignment (GAP PENALTY=10, GAP LENGTH PENALTY=0.2, Delay Divergen Seqs(%)=30, DNA Transition Weight=0.5, Protein Weight Matrix=Gonnet Series, DNA Weight Matrix=IUB). After alignment of the sequences using the Clustal W program, it is possible to obtain a "percent identity" by viewing the "sequence distances" table in the same program.

It is well understood by one skilled in the art that many levels of sequence identity are useful in identifying polypeptides, from other species, wherein such polypeptides have the same or similar function or activity. Useful examples of percent identities include, but are not limited to: 25%, 30%, 35%, 40%, 45%, 50%, 55%, 60%, 65%, 70%, 75%, 80%, 85%, 90%, or 95%, or any integer percentage from 25% to 100% may be useful in describing the present invention, such as 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99%. Suitable nucleic acid fragments not only have the above homologies but typically encode a polypeptide having at least 50 amino acids, preferably at least 100 amino acids, and more preferably at least 150 amino acids.

The term "sequence analysis software" refers to any computer algorithm or software program that is useful for the analysis of nucleotide or amino acid sequences. "Sequence analysis software" may be commercially available or independently developed. Typical sequence analysis software will include, but is not limited to: 1.) the GCG suite of programs (Wisconsin Package Version 9.0, Genetics Computer Group (GCG), Madison, Wis.); 2.) BLASTP, BLASTN, BLASTX (Altschul et al., J. Mol. Biol., 215:403-410 (1990)); 3.) DNASTAR (DNASTAR, Inc. Madison, Wis.); 4.) Sequencher (Gene Codes Corporation, Ann Arbor, Mich.); and 5.) the FASTA program incorporating the Smith-Waterman algorithm (W. R. Pearson, Comput. Methods Genome Res., [Proc. Int. Symp.] (1994), Meeting Date 1992, 111-20. Editor(s): Suhai, Sandor. Plenum: New York, N.Y.). Within the context of this application it will be understood that where sequence analysis software is used for analysis, that the results of the analysis will be based on the "default values" of the program referenced, unless otherwise specified. As used herein "default values" will mean any set of values or parameters that originally load with the software when first initialized.

Standard recombinant DNA and molecular cloning techniques used here are well known in the art and are described by Sambrook, J., Fritsch, E. F. and Maniatis, *T. Molecular Cloning: A Laboratory Manual,* $2^{nd}$ ed.; Cold Spring Harbor Laboratory: Cold Spring Harbor, N.Y., 1989 (hereinafter "Maniatis"); and by Silhavy, T. J., Bennan, M. L. and Enquist, L. W. *Experiments with Gene Fusions*; Cold Spring Harbor Laboratory: Cold Spring Harbor, N.Y., 1984; and by Ausubel, F. M. et al., In *Current Protocols in Molecular Biology*, published by Greene Publishing and Wiley-Interscience, 1987.

The present invention relates to engineered strains of xylose-utilizing *Zymomonas* or *Zymobacter* that have improved xylose utilization when fermented in xylose containing media. A challenge for improving ethanol production by fermentation of a biocatalyst in media that includes biomass hydrolysate, produced typically by pretreatment and saccharification of biomass, is obtaining optimal utilization of xylose. Xylose is one of the predominant pentose sugars in hydrolyzed lignocellulosic materials, the other being arabinose. Applicants have discovered that increased expression ribose-5-phosphate isomerase in xylose-utilizing strains leads to increased efficiency in xylose utilization, and thus to higher ethanol yields when fermentation is in xylose containing media.

Discovery of Inefficiency in Xylose Utilization

Figure 1:
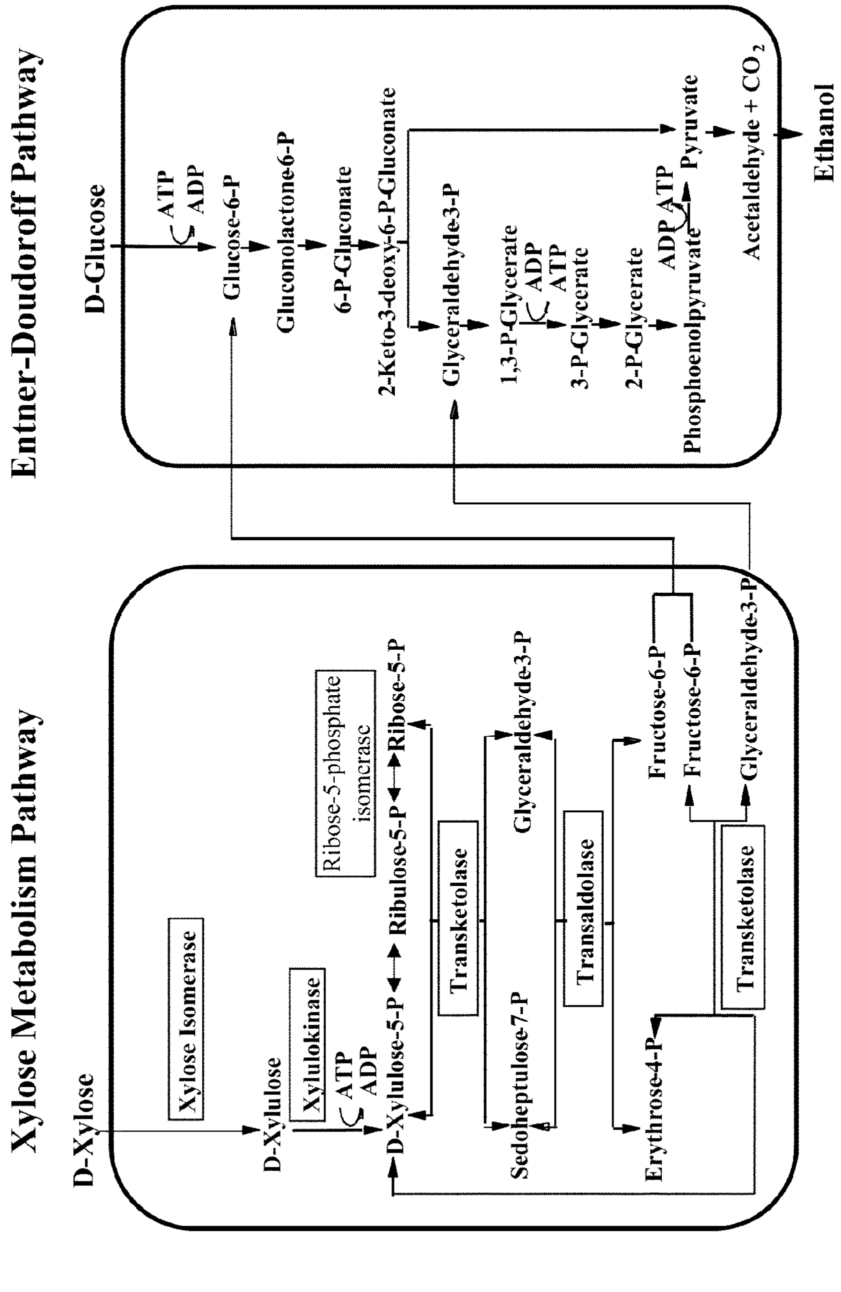
FIG. 1 shows a diagram of the xylose metabolism and ethanol fermentation pathways in *Zymomonas* engineered for xylose utilization.

Engineering of ethanologens for xylose utilization typically includes expression of four proteins: xylose isomerase, xylulokinase, transketolase, and transaldolase. These enzymes provide a xylose utilization pathway that feeds into ethanol production as shown in FIG. 1. However, utilization of xylose by *Zymomonas* strains engineered to metabolize xylose is typically not efficient.

Applicants have discovered a potential cause of inefficiency in xylose utilization: a xylose utilization pathway metabolite which could be used to produce ethanol is diverted to a by-product. Specifically, Applicants have discovered that with xylose-utilizing *Zymomonas* strains that are able to grow on xylose as the sole carbon source, ribulose (D-ribulose) accumulates in the medium when they are grown in medium containing only xylose as the carbon source. The ribulose accumulated in the medium may account for about 8% of total xylose consumed. This ribulose accumulation does not occur when the same xylose-utilizing *Zymomonas* is grown in medium containing glucose and no xylose.

Ribulose may be produced by conversion of ribulose-5-phosphate to ribulose by a phosphatase. If ribulose-5-phosphate accumulates in a cell it may provide a substrate for cellular phosphatases. The conversion of ribulose-5-phosphate to ribulose and accumulation of ribulose in the medium indicates an enzymatic deficiency in the pathway responsible for metabolizing xylose to ethanol. Conditions under which the initial step in metabolism of xylose, catalyzed by xylose isomerase, has been increased may act to intensify this deficiency leading to even higher levels of ribulose-5-phosphate and ribulose accumulation. In addition, ribulose-5-phosphate accumulation may be so great that it becomes bacteriostatic or even lethal, as it is known that sugar phosphate accumulation in bacteria cells is detrimental to their metabolism and viability. Therefore by the discovery of ribulose in the medium and Applicants' recognition of the potential implications of this finding, Applicants have identified a problem to be solved which may impact xylose utilization. Reducing production of ribulose and improving ribulose-5-phosphate utilization in xylose metabolism and ethanol production pathways as shown in FIG. 1 may improve production of ethanol from xylose.

Increasing Ribose-5-Phosphate Isomerase Activity

Applicants have discovered that increasing expression of ribose-5-phosphate isomerase (RPI) in xylose utilizing *Z. mobilis* that accumulates ribulose when grown in xylose containing medium leads to reduced accumulation of ribulose. Reduced accumulation of ribulose may be related to reduced accumulation of ribulose-5-phosphate as described above. Strains with increased RPI expression showed improved growth, increased xylose utilization, and increased ethanol production when grown in medium containing xylose as compared to the same strains lacking increased RPI expression. RPI catalyzes the interconversion of ribulose-5-phosphate and ribose-5-phosphate (see FIG. 1).

Increasing expression of the *Z. mobilis* RPI-A enzyme (which actually is an RPI-B as determined herein and described below) in a xylose utilizing *Z. mobilis* strain that produces ribulose when grown in xylose containing medium led to almost 50% reduction in ribulose accumulation in the medium as compared to the same strain without increased RPI expression. In addition, the strains with increased RPI expression showed increased cell mass yield, increased xylose consumption, and increased ethanol titer indicating increased conversion of xylose to ethanol. Increased expression of the *E. coli* RPI-A enzyme in the same ribulose producing *Z. molibilis* strain also led to production of increased cell mass. Increase in cell mass, xylose consumption, and ethanol yield will vary depending on factors such as the starting xylose-utilizing strain, media composition, and expression level of RPI. Increased cell mass may be about 15% or greater after 60 hours of growth in medium containing 100 g/L xylose as the sole sugar, and increase in ethanol production may be at least about 5%, using the present strains in conditions described in Examples herein.

Increased RPI expression may be accomplished using any protein or polypeptide with ribose-5-phosphate isomerase activity in *Zymomonas*. There are two groups of ribose-5-phosphate isomerase enzymes that are called RPI-A and RPI-B. The RPI-B enzymes belong to the RpiB/LacA/LacB family of sugar-phosphate isomerases. *E. coli* has two RPI proteins, one is an RPI-A and one is an RPI-B. *Z. mobilis* has a single RPI protein that is annotated as RPI-A. However, the *Z. mobilis* RPI protein has closer sequence identity to the *E. coli* RPI-B protein (36%) than to the *E. coli* RPI-A protein (20%). Further analysis of RPIs described below places the *Z. mobilis* RPI in the RPI-B group. However, herein the *Z. mobilis* RPI is called RPI-A to be consistent with its publicly known name.

The sequences of RPI proteins that may be used in the present microorganisms are very diverse as exemplified by the *Z. mobilis* and *E. coli* RPI proteins. RPI proteins that may be used in the present microorganisms may be identified using bioinformatics analysis. A structure/function bioinformatics approach used herein in Example 8 is analysis based on Profile Hidden Markov Modeling, active site residue identification, and additional identifying amino acid screening.

Profile Hidden Markov Models (HMM) were constructed using the hmmsearch algorithm of the HMMER software package (Janelia Farm Research Campus, Ashburn, Va.). The theory behind Profile HMMs is described in Durbin et al. ((1998) *Biological sequence analysis: probabilistic models of proteins and nucleic acids*, Cambridge University Press) and Krogh et al. ((1994) J. Mol. Biol. 235:1501-1531), which characterizes a set of proteins based on the probability of each amino acid occurring at each position in the alignment of the proteins of the set.

Proteins with functional identification as referenced in the BRENDA (Cologne University BioInformatics Center) and PubMed (US National Library of Medicine, National Institutes of Health) databases, 15 for RPI-A (Table 2; SEQ ID NOs:83, 84, 85, 86, 87, 88, 89, 90, 91, 92, 93, 94, 95, 96, and 97) and 5 for RPI-B (Table 3; SEQ ID NOs:1213, 1214, 1215, 1216, and 1217), were used as seed sequences to prepare Profile HMMs for RPI-A and RPI-B. BRENDA is a human-curated database that contains detailed information about enzyme kinetic, physical, and biochemical properties extracted from the experimental literature and with links to the relevant databases. Using each set of seed sequences a multiple sequence alignment (MSA) was built using ClustalW with default parameters. The MSA results were used as input data to prepare the Profile HMMs that are given in Tables 4 and 5 for ribose-5-phosphate isomerase A proteins and ribose-5-phosphate isomerase B proteins, respectively. In the tables, the amino acids are represented by the one letter code. The first line for each position reports the match emission scores: probability for each amino acid to be in that state (highest score is highlighted). The second line reports the insert emission scores, and the third line reports on state transition scores: M→M, M→I, M→D; I→M, I→I; D→M, D→D; B→M; M→E.

In addition to the Profile HMMs, active site residues known for RPI-A and RPI-B enzymes (Roos et al. (2004) J. Mol. Biol. 335:799-809; Graile et al. (2005) Biochimie 87:763-769), and an amino acid that distinguishes LacB, were used to identify RPI-A and RPI-B proteins that may be used in the present microorganisms. RPI-A proteins that may be used are proteins that i) give an E-value score of 0.1 or less when queried using a Profile Hidden Markov Model prepared using SEQ ID NOs:83, 84, 85, 86, 87, 88, 89, 90, 91, 92, 93, 94, 95, 96, and 97; the query being carried out using the hmmsearch algorithm wherein the Z parameter is set to 1 billion, and ii) have aspartic acid and glutamic acid at positions corresponding to 107 and 129, respectively, in the *Saccharomyces cerevisiae* RPI-A protein (SEQ ID NO:97). RPI-B proteins that may be used are proteins that i) give an E-value score of 0.1 or less when queried using a Profile Hidden Markov Model prepared using SEQ ID NOs:1213, 1214, 1215, 1216, and 1217; the query being carried out using the hmmsearch algorithm wherein the Z parameter is set to 1 billion, ii) either have cysteine and threonine at positions corresponding to 66 and 68, respectively, in the *E. coli* RPI-B protein (SEQ ID NO:1216) or have serine and glutamic acid at positions corresponding to 68 and 72, respectively, in the *M. tuberculosis* RPI-B protein (SEQ ID NO:1213), and iii) have asparagine, glycine, aspartic acid, serine, or glutamic acid but not leucine at the position corresponding to 100 in the *E. coli* RPI-B protein (SEQ ID NO:1216).

Examples of RPI-A and RPI-B proteins that fit the above criteria and that may be used in the present microorganisms are for RPI-A: SEQ ID NOs:83 through 1212, and for RPI-B:SEQ ID NOs:1213 through 2107. These proteins, as well as any protein with at least about 80-85%, 85%-90%, 90%-95%, or at least about 96%, 97%, 98%, or 99% sequence identity to any of these sequences and having ribose-5-phosphate isomerase activity, may be used in the present cells. Examples of sequences encoding RPI-A proteins include SEQ ID NOs: 2108 through 3237. Examples of sequences encoding RPI-B proteins include SEQ ID NOs:3238 through 4132. Additional RPIs may be readily identified in the literature and in bioinformatics databases as is well known to the skilled person and as described above. Identification of protein and/or coding sequences using bioinformatics is typically through BLAST (described above) searching of publicly available databases with RPI amino acid sequences or encoding sequences, such as those provided herein. Identities are based on the Clustal W method of alignment using the default parameters of GAP PENALTY=10, GAP LENGTH PENALTY=0.1, and Gonnet 250 series of protein weight matrix.

Additionally, the sequences described herein or those recited in the art may be used to identify other homologs in nature. For example each of the RPI encoding nucleic acid fragments described herein may be used to isolate DNA sequences encoding homologous proteins. Isolation of homologous sequences using sequence-dependent protocols is well known in the art. Examples of sequence-dependent protocols include, but are not limited to: 1) methods of nucleic acid hybridization; 2) methods of DNA and RNA amplification, as exemplified by various uses of nucleic acid amplification technologies [e.g., polymerase chain reaction (PCR), Mullis et al., U.S. Pat. No. 4,683,202; ligase chain reaction (LCR), Tabor, S. et al., *Proc. Acad. Sci. USA* 82:1074 (1985); or strand displacement amplification (SDA), Walker, et al., *Proc. Natl. Acad. Sci.* U.S.A., 89:392 (1992)]; and 3) methods of library construction and screening by complementation.

Xylose-Utilizing Host Strain

Expression of RPI may be increased in any strain of *Zymomonas* or other bacterial ethanolagen, such as *Zymobacter*, that is able to utilize xylose as a carbon source. *Zymobacter palmae* is an ethanol-producing bacterium that has been engineered for xylose utilization by expressing genes for xylose utilization as described below for *Zymomonas*, using *Z. mobilis* glyceraldehyde-3-phosphate dehydrogenase and enolase promoters (Yanase et al. *Applied and Environmental Microbiology* (2007) 73:2592-2599). In addition, the ethanologen accumulates ribulose-5-phosphate or ribulose when grown in medium containing xylose when RPI expression is not increased.

Strains of *Zymomonas*, such as *Z. mobilis* have been engineered for xylose fermentation to ethanol. Typically four genes have been introduced into *Z. mobilis* for expression of four enzymes involved in xylose metabolism (FIG. 1) as described in U.S. Pat. No. 5,514,583, U.S. Pat. No. 5,712,133, U.S. Pat. No. 6,566,107, WO 95/28476, Feldmann et al. ((1992) Appl Microbiol Biotechnol 38: 354-361), and Zhang et al. ((1995) Science 267:240-243). These include genes encoding xylose isomerase which catalyzes the conversion of xylose to xylulose, and xylulokinase which phosphorylates xylulose to form xylulose 5-phosphate. Additionally expressed are transketolase and transaldolase, two enzymes of the pentose phosphate pathway that convert xylulose 5-phosphate to intermediates that couple pentose metabolism to the glycolytic Entner-Douderoff pathway permitting the metabolism of xylose to ethanol (see FIG. 1). DNA sequences encoding these enzymes may be obtained from any of numerous microorganisms that are able to metabolize xylose, such as enteric bacteria, and some yeasts and fungi. Sources for the coding regions may include *Xanthomonas, Klebsiella, Escherichia, Rhodobacter, Flavobacterium, Acetobacter, Gluconobacter, Rhizobium, Agrobacterium, Salmonella, Pseudomonads*, and *Zymomonas*. The coding regions of *E. coli* are typically used.

Endogenous genes may provide part of a xylose fermentation pathway, or may be altered by any known genetic manipulation technique to provide a protein with enzyme activity useful for xylose metabolism. For example, the endogenous transketolase may complement other introduced enzyme activities in creating a xylose utilization pathway.

*Zymomonas* or *Zymobacter* strains that are additionally engineered to utilize other sugars that, like xylose, are not natural substrates, may also be used in the present process. An example is a strain of *Z. mobilis* engineered for arabinose utilization as described in U.S. Pat. No. 5,843,760, which is herein incorporated by reference. Strains may be modified in other additional ways to improve xylose utilization and ethanol production.

Increased Expression of RPI

In the present microorganism, a genetic modification is made which increases ribose-5-phosphate isomerase activity as compared to ribose-5-phosphate isomerase activity in the microorganism lacking the genetic modification. Increased expression of RPI activity may be obtained by expressing a DNA molecule encoding a protein having ribose-5-phosphate isomerase activity that is active in the host microorganism. Useful proteins with ribose-5-phosphate isomerase activity including ribose-5-phosphate isomerase A and ribose-5-phosphate isomerase B proteins are described above.

Any method for increasing activity of an enzyme in a microorganism may be used to increase RPI activity. Such methods are well known to one skilled in the art and include increasing the encoding gene copy number and/or expression from a gene containing a high expression promoter. The present strains may be engineered for increased expression of an endogenous RPI coding region, and/or expression of an introduced heterologous RPI coding region to give increased enzyme activity. In addition, RPI activity may be increased by mutation and screening of expressed mutated genes to identify microorganisms with increased activity.

Typically, increased expression of RPI is achieved by transforming with a DNA molecule encoding RPI that is operably linked to a promoter in a chimeric gene or operon. Coding sequences for RPIs that may be used include any sequences encoding the RPI-A and RPI-B proteins described above. Examples of these coding sequences include for RPI-A: SEQ ID NOs:2108 through 3237, and for RPI-B: SEQ ID NOs:3238 through 4132.

When using a heterologous coding region, the sequence may be codon-optimized for maximal expression in the target host cell, as well known to one skilled in the art. If the native start codon is GTG, it may be changed to ATG for increased protein expression. Methods for gene expression in bacteria are well known in the art. Expression of genes in bacteria typically requires a promoter, operably linked to a coding region of interest, and a transcriptional terminator. Promoters that may be used are promoters that are expressed in *Zymomonas* or *Zymobacter* cells such as the promoters of *Z. mobilis* glyceraldehyde-3-phosphate dehydrogenase (GAP promoter; $P_{gap}$) gene, of *Z. mobilis* enolase (ENO promoter; Peno) gene, and of the *Actinoplanes missouriensis* xylose isomerase encoding gene (GI promoter, Pgi). Particularly high expression promoters that may be used are the $P_{gap}$ promoters with mutations causing high expression as disclosed in US Patent Publication #2009-0246876 A1. The $P_{gap}$ promoters therein have a base substitution in a position selected from the group consisting of position −190, position −89, or both position −190 and −89; wherein the position numbers are with respect to the natural ATG translation initiation codon for glyceraldehyde-3-phosphate dehydrogenase in the CP4 and ZM4 strains of *Z. mobilis*. Specifically, the base substitution is at position −190, a T replacing G; and at position −89, a T replacing C. These positions are 116 and 217, respectively, in SEQ ID NO:17.

A chimeric gene or operon for RPI expression is typically constructed in or transferred to a vector for further manipulations. Vectors are well known in the art. Certain vectors are capable of replicating in a broad range of host bacteria and can be transferred by conjugation. The complete and annotated sequence of pRK404 and three related vectors: pRK437, pRK442, and pRK442(H) are available. These derivatives have proven to be valuable tools for genetic manipulation in gram-negative bacteria (Scott et al., *Plasmid* 50(1):74-79 (2003)). Particularly useful for expression in *Zymomonas* are vectors that can replicate in both *E. coli* and *Zymomonas*, such as pZB188 which is described in U.S. Pat. No. 5,514,583. Vectors may include plasmids for autonomous replication in a cell, and plasmids for carrying constructs to be integrated into bacterial genomes. Plasmids for DNA integration may include transposons, regions of nucleic acid sequence homologous to the target bacterial genome, or other sequences supporting integration. An additional type of vector may be a transposome produced using, for example, a system that is commercially available from EPICENTRE®. It is well known how to choose an appropriate vector for the desired target host and the desired function.

Bacterial cells may be engineered by introducing a vector having a chimeric gene comprising an RPI coding region by well known methods, such as using freeze-thaw transformation, calcium-mediated transformation, electroporation, or conjugation. Any bacterial cell to be engineered for improved xylose utilization by increasing expression of an RPI enzyme is a target host cell for transformation to engineer a strain as described herein. Particularly suitable host cells are *Zymomonas* and *Zymobacter*. The introduced chimeric gene may be maintained in the cell on a stably replicating plasmid, or integrated into the genome following introduction.

For engineering a strain with an integrated RPI chimeric gene or operon in the bacterial cell genome, methods may be used that are well known in the art such as homologous recombination, transposon insertion, or transposome insertion. In homologous recombination, DNA sequences flanking a target integration site are placed bounding a spectinomycin-resistance gene, or other selectable marker, and Rpi chimeric gene leading to insertion of the selectable marker and the Rpi chimeric gene into the target genomic site. In addition, the selectable marker may be bounded by site-specific recombination sites, so that after expression of the corresponding site-specific recombinase, the resistance gene is excised from the genome.

In addition, the promoter of the endogenous RPI expressing gene may be replaced with a more highly expressed promoter to increase RPI activity in the cell. This may be accomplished by homologous recombination using vectors and methods as described above.

Combination of Increased Xylose Isomerase and RPI Expression

The present microorganisms may be engineered to have increased expression of xylose isomerase. The presence of increased RPI activity in the cells, along with further increased xylose isomerase expression, leads to further increased ethanol production. For example, ethanol production may be increased by at least about 10%, 15%, 20%, or 25%, depending on factors such as the specific strain, media composition, and growth conditions.

In the present cells, increased expression of xylose isomerase activity may be obtained by expressing a gene encoding a xylose isomerase enzyme that is active in the host cell, using any method known in the art as described above for expression of RPI. Useful enzymes with xylose isomerase activity are described in commonly owned and co-pending US Patent Application Publication US 2009-0246846 A1, which is herein incorporated by reference. As disclosed therein xylose isomerases may be identified using a Profile HMM (described above for RPI) prepared therein using 32 xylose isomerase protein sequences with experimentally verified function as referenced in the BRENDA database. These proteins are listed in Table 1 and have SEQ ID NOs:19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, and 81. The Profile HMM for the xylose isomerase family of proteins is given in Table 3. In addition to the Profile HMM, four catalytic site amino acids were found to be characteristic of xylose isomerases: histine 54, aspartic acid 57, glutamic acid 181, and lysine 183, with the position numbers in reference to the *Streptomyces albus* xylose isomerase sequence (SEQ ID NO:61). Any protein fitting the xylose isomerase Profile HMM with an E-value score < or $=3\times10^{-10}$ and having these four catalytic site residues is a xylose isomerase whose coding region may be used to increase xylose isomerase activity in the present cells, in addition to the proteins with SEQ ID NOs listed in Table 1. Examples of coding regions that may be used to express xylose isomerase proteins are SEQ ID NOs: 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80 as listed in Table 1.

As known in the art, there may be variations in DNA sequences encoding an amino acid sequence due to the degeneracy of the genetic code. Codons may be optimized for expression of an amino acid sequence in a target host cell to provide for optimal encoded expression.

Fermentation of Improved Xylose-Utilizing Strain

The present engineered microorganisms with increased RPI activity may be used in fermentation to produce ethanol. As an example, production of ethanol by a *Z. mobilis* strain of the invention is described.

For production of ethanol, recombinant xylose-utilizing *Z. mobilis* having increased RPI activity is brought in contact with medium that contains xylose. Xylose may be the sole sugar, but typically the medium contains a mixture of sugars including xylose and glucose. The medium may contain biomass hydrolysate that includes these sugars that are derived from treated cellulosic or lignocellulosic biomass.

When the mixed sugars concentration is high such that growth is inhibited, the medium includes sorbitol, mannitol, or a mixture thereof as disclosed in commonly owned U.S. Pat. No. 7,629,156 B2. Galactitol or ribitol may replace or be combined with sorbitol or mannitol. The *Z. mobilis* grows in the medium where fermentation occurs and ethanol is produced. The fermentation is run without supplemented air, oxygen, or other gases (which may include conditions such as anaerobic, microaerobic, or microaerophilic fermentation), for at least about 24 hours, and may be run for 30 or more hours. The timing to reach maximal ethanol production is variable, depending on the fermentation conditions. Typically, if inhibitors are present in the medium, a longer fermentation period is required. The fermentations may be run at temperatures that are between about 30° C. and about 37° C., at a pH of about 4.5 to about 7.5.

The present *Z. mobilis* may be grown in medium containing mixed sugars including xylose in laboratory scale fermenters, and in scaled up fermentation where commercial quantities of ethanol are produced. Where commercial production of ethanol is desired, a variety of culture methodologies may be applied. For example, large-scale production from the present *Z. mobilis* strains may be produced by both batch and continuous culture methodologies. A classical batch culturing method is a closed system where the composition of the medium is set at the beginning of the culture and not subjected to artificial alterations during the culturing process. Thus, at the beginning of the culturing process the medium is inoculated with the desired organism and growth or metabolic activity is permitted to occur adding nothing to the system. Typically, however, a "batch" culture is batch with respect to the addition of carbon source and attempts are often made at controlling factors such as pH and oxygen concentration. In batch systems the metabolite and biomass compositions of the system change constantly up to the time the culture is terminated. Within batch cultures cells moderate through a static lag phase to a high growth log phase and finally to a stationary phase where growth rate is diminished or halted. If untreated, cells in the stationary phase will eventually die. Cells in log phase are often responsible for the bulk of production of end product or intermediate in some systems. Stationary or post-exponential phase production can be obtained in other systems.

A variation on the standard batch system is the Fed-Batch system. Fed-Batch culture processes are also suitable for growth of the present *Z. mobilis* strains and comprise a typical batch system with the exception that the substrate is added in increments as the culture progresses. Fed-Batch systems are useful when catabolite repression is apt to inhibit the metabolism of the cells and where it is desirable to have limited amounts of substrate in the medium. Measurement of the actual substrate concentration in Fed-Batch systems is difficult and is therefore estimated on the basis of the changes of measurable factors such as pH and the partial pressure of waste gases such as $CO_2$. Batch and Fed-Batch culturing methods are common and well known in the art and examples may be found in Biotechnology: A Textbook of Industrial Microbiology, Crueger, Crueger, and Brock, Second Edition (1989) Sinauer Associates, Inc., Sunderland, Mass., or Deshpande, Mukund V., *Appl. Biochem. Biotechnol.,* 36, 227, (1992), herein incorporated by reference.

Commercial production of ethanol may also be accomplished with a continuous culture. Continuous cultures are open systems where a defined culture medium is added continuously to a bioreactor and an equal amount of conditioned medium is removed simultaneously for processing. Continuous cultures generally maintain the cells at a constant high liquid phase density where cells are primarily in log phase growth. Alternatively, continuous culture may be practiced with immobilized cells where carbon and nutrients are continuously added, and valuable products, by-products or waste products are continuously removed from the cell mass. Cell immobilization may be performed using a wide range of solid supports composed of natural and/or synthetic materials as is known to one skilled in the art.

Continuous or semi-continuous culture allows for the modulation of one factor or any number of factors that affect cell growth or end product concentration. For example, one method will maintain a limiting nutrient such as the carbon source or nitrogen level at a fixed rate and allow all other parameters to moderate. In other systems a number of factors affecting growth can be altered continuously while the cell concentration, measured by medium turbidity, is kept constant. Continuous systems strive to maintain steady state growth conditions and thus the cell loss due to medium being drawn off must be balanced against the cell growth rate in the culture. Methods of modulating nutrients and growth factors for continuous culture processes as well as techniques for maximizing the rate of product formation are well known in the art of industrial microbiology and a variety of methods are detailed by Brock, supra.

Particularly suitable for ethanol production is a fermentation regime as follows. The desired *Z. mobilis* strain of the present invention is grown in shake flasks in semi-complex medium at about 30° C. to about 37° C. with shaking at about 150 rpm in orbital shakers and then transferred to a 10 L seed fermentor containing similar medium. The seed culture is grown in the seed fermentor anaerobically until $OD_{600}$ is between 3 and 6, when it is transferred to the production fermentor where the fermentation parameters are optimized for ethanol production. Typical inoculum volumes transferred from the seed tank to the production tank range from about 2% to about 20% v/v. Typical fermentation medium contains minimal medium components such as potassium phosphate (1.0-10.0 g/L), ammonium sulfate (0-2.0 g/L), magnesium sulfate (0-5.0 g/L), a complex nitrogen source such as yeast extract or soy based products (0-10 g/L). A final concentration of about 5 mM sorbitol or mannitol is present in the medium. Mixed sugars including xylose and at least one additional sugar such as glucose (or sucrose), providing a carbon source, are continually added to the fermentation vessel on depletion of the initial batched carbon source (50-200 g/L) to maximize ethanol rate and titer. Carbon source feed rates are adjusted dynamically to ensure that the culture is not accumulating glucose in excess, which could lead to build up of toxic byproducts such as acetic acid. In order to maximize yield of ethanol produced from substrate utilized, biomass growth is restricted by the amount of phosphate that is either batched initially or that is fed during the course of the fermentation. The fermentation is controlled at pH 5.0-6.0 using caustic solution (such as ammonium hydroxide, potassium hydroxide, or sodium hydroxide) and either sulfuric or phosphoric acid. The temperature of the fermentor is controlled at 30° C.-35° C. In order to minimize foaming, antifoam agents (any class-silicone based, organic based etc) are added to the vessel as needed. An antibiotic, for which there is an antibiotic resistant marker in the strain, such as kanamycin, may be used optionally to minimize contamination.

Any set of conditions described above, and additionally variations in these conditions that are well known in the art, are suitable conditions for production of ethanol by a xylose-utilizing recombinant *Zymomonas* strain.

EXAMPLES

The present invention is further defined in the following Examples. It should be understood that these Examples, while indicating preferred embodiments of the invention, are given by way of illustration only. From the above discussion and these Examples, one skilled in the art can ascertain the essential characteristics of this invention, and without departing from the spirit and scope thereof, can make various changes and modifications of the invention to adapt it to various uses and conditions.

General Methods

Standard recombinant DNA and molecular cloning techniques used here are well known in the art and are described by Sambrook, J., Fritsch, E. F. and Maniatis, T., *Molecular Cloning: A Laboratory Manual,* $2^{nd}$ ed., Cold Spring Harbor Laboratory: Cold Spring Harbor, N.Y. (1989) (hereinafter "Maniatis"); and by Silhavy, T. J., Bennan, M. L. and Enquist, L. W., *Experiments with Gene Fusions*, Cold Spring Harbor Laboratory: Cold Spring Harbor, N.Y. (1984); and by Ausubel, F. M. et al., *Current Protocols in Molecular Biology*, published by Greene Publishing Assoc. and Wiley-Interscience, Hoboken, N.J. (1987).

The meaning of abbreviations is as follows: "kb" means kilobase(s), "bp" means base pairs, "nt" means nucleotide(s), "hr" means hour(s), "min" means minute(s), "sec" means second(s), "d" means day(s), "L" means liter(s), "ml" means milliliter(s), "4" means microliter(s), "4" means microgram(s), "ng" means nanogram(s), "mM" means millimolar, "μM" means micromolar, "nm" means nanometer(s), "μmol" means micromole(s), "μmol" means picomole(s), "Cm" means chloramphenicol, "$Cm^r$" means chloramphenicol resistant, "$Cm^s$" means chloramphenicol sensitive, "$Sp^r$" means spectinomycin resistance, "$Sp^s$" means spectinomycin sensitive, "XI" is xylose isomerase, "XK" is xylulokinase, "TAL" is transaldolase, "TKT" is transketolase, "OD600" means optical density measured at a wavelength of 600 nm, "PCR" means polymerase chain reaction, "kDa" means kilodaltons, "g" means the gravitation constant, "bp" means base pair(s), "kbp" means kilobase pair(s), "HPLC" means high performance liquid chromatography, and "GC" means gas chromatography, "RM" means rich medium containing 10 g/L yeast extract plus 2 g/L $KH_2PO_4$, "MM" means mating medium containing 10 g/L yeast extract, 5 g/L tryptone, 2.5 g/L $(NH_4)_2SO_4$ and 0.2 g/L $KH_2PO_4$.

Example 1

Ribulose Accumulation *Zymomonas mobilis* Strain ZW801-4

The recombinant *Z. mobilis* strain ZW801-4 was described in U.S. Pat. No. 7,741,119, which is herein incorporated by reference. Strain ZW801-4 was derived from strain ZW800, which was derived from strain ZW658, all as described in U.S. Pat. No. 7,741,119. ZW658 was constructed by integrating two operons, $P_{gap}$xylAB and $P_{gap}$taltkt, containing four xylose-utilizing genes encoding xylose isomerase (xylA), xylulokinase (xylB), transaldolase (tal), and transketolase (tkt), into the genome of ZW1 (rename of strain ZM4; ATCC #31821) via sequential transposition events to produce strain X13L3, which was renamed ZW641, and followed by adaptation on selective media containing xylose. ZW658 was deposited under the Budapest Treaty as ATCC #PTA-7858. In ZW658, the gene encoding glucose-fructose oxidoreductase was insertionally-inactivated using host-mediated, double-crossover, homologous recombination and spectinomycin resistance as a selectable marker to create strain ZW800. The spectinomycin resistance marker, which was bounded by loxP sites, was removed by site specific recombination using Cre recombinase to create strain ZW801-4. As disclosed in commonly owned and co-pending US Patent Application Publication #US 20090246846 A1, ZW648 has much more xylose isomerase activity (about 7-fold higher) than ZW641 (represented by X13bC strain) due to a mutation in the promoter (Pgap) expressing the xylA coding region.

Figure 2:
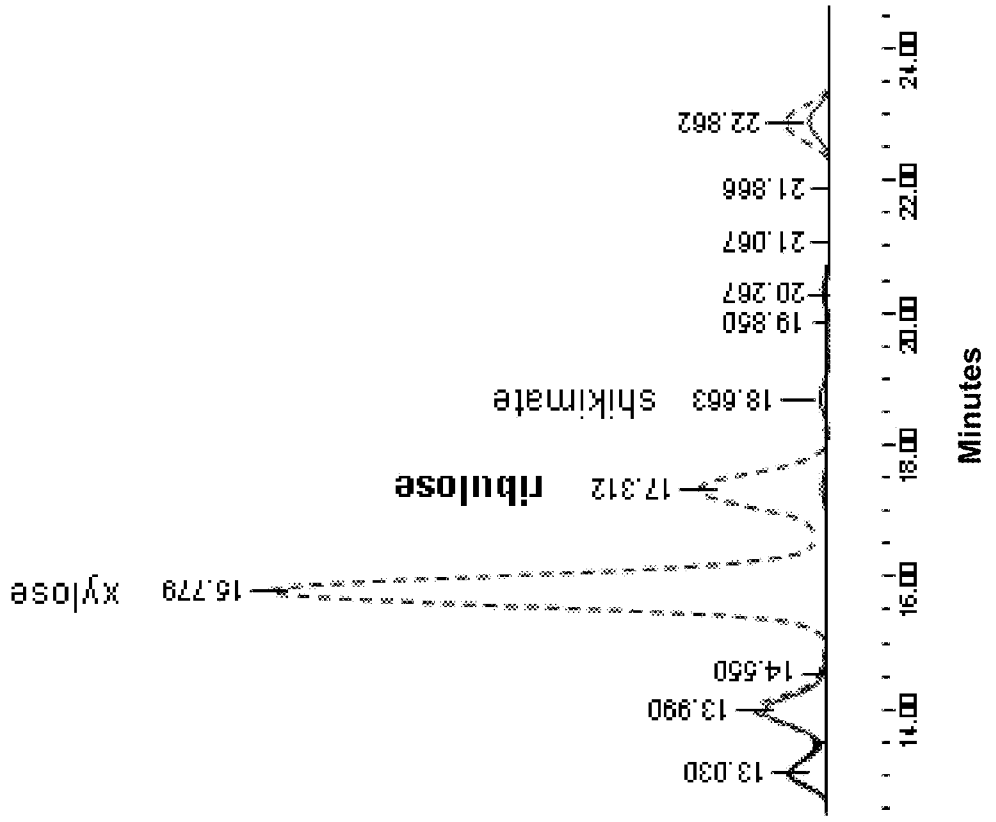
FIG. 2 shows HPLC analysis of culture media following growth of strain ZW801-4 in media containing glucose (solid line) or xylose (dashed line).

ZW801-4 was grown in medium containing xylose as the sole carbon source (MRM3X10 media; 1% yeast extract, 15 mM $KH_2PO_4$, 4 mM $MgSO_4$, and 100 g/L xylose) and in medium with 100 g/L glucose substituted for the xylose (MRM3G10). Cells were grown at 33° C. with minimal agitation (125 RPM in a LAB-Line orbital shaker; Terra Universal, Inc. Fullerton, Calif.). Ribulose and other fermentation products were analyzed by high performance chromatography (HPLC). HPLC analysis was performed on an Agilent 1200 series (Agilent Technologies, Santa Clara, Calif.) with both refractive index and diode array detectors. Mobile phase consisted of 0.01N sulfuric acid at 0.5 ml/min. A Shodex SH1011 (Showa Denko, Tokyo, Japan) sugar column was used for separation of substrates and fermentation products. External standards included D-glucose, D-xylose, glycerol, acetate, ethanol and D-ribulose (Sigma-Aldrich, St. Louis, Mo.) at various concentrations for calibration and comparison to products accumulating in culture media. The refractive index signal for the D-ribulose standard was at a retention time of 17.3 minutes and, as expected, presents no signal with diode array detection. Analysis of culture media showed ribulose production began very early in the xylose containing culture and continued until the xylose source had been exhausted. Furthermore, ribulose accumulated only when cells were grown in xylose containing media (FIG. 2, dashed line). Comparison of culture media by HPLC for the strain ZW801-4 grown in culture media with glucose as the carbon source (FIG. 2, solid line) showed neither transient nor cumulative production of ribulose despite complete use of this substrate (FIG. 2). Xylose was not used to completion in the culture containing xylose medium.

Example 2

Engineering of *Z. Mobilis* with Chimeric *Z. Mobilis* Ribulose-5-Phosphate Isomerase Gene Expression of an extrachromosomal copy of a chimeric gene containing the native *Z. mobilis* ribulose-5-phosphate isomerase (RPI-A) coding region was accomplished by cloning the coding region into a shuttle vector adjacent to a glucose isomerase (GI) promoter derived from *Actinoplanes missouriensis*.

The *Z. mobilis* RPI-A coding region (SEQ ID NO:1870) was isolated from strain ZW1 (rename of strain ZM4; ATCC 31821) genomic DNA using PCR. Genomic DNA was prepared from ZW1 using a Puregene genomic DNA purification kit following the manufacturer's instructions (Gentra Systems, Minneapolis, Minn.). PCR primers were designed to amplify the RPI-A coding region and incorporate appropriate restriction enzyme sites for cloning purposes. PCR primers were also designed to preserve the native distance between the promoter's Shine-Delgarno sequence and the coding region initiation codon.

PCR primers used to isolate the RPI-A coding region were Primer-1 and Primer-2 (SEQ ID NOs:1 and 2). The sequence of Primer-1 corresponds to the 5'-end of the RPI-A coding region, including the native initiation codon and 15 bp of sequence at the extreme 3'-end of the *A. missouiensis* GI promoter. Primer-2 includes the 3'-end of the RPI-A coding region, incorporating the native STOP codon and a XhoI restriction enzyme recognition site. PCR using genomic DNA from *Z. mobilis* ZW1 with Primer-1 and Primer-2 resulted in a DNA fragment containing the 474 bp RPI-A coding sequence, with 15 bp of the GI promoter sequence at the 5'-end and an XhoI restriction enzyme recognition site at the 3'-end.

The 186 bp *A. missouriensis* (ATCC 14538) GI promoter (SEQ ID NO:14) was isolated by PCR using primers Primer-3 and Primer-4 (SEQ ID NOs:3 and 4). The PCR Primer-3 contains sequence for NcoI and SacI restriction enzyme recognition sites located at the 5'-end of the GI promoter fragment. The sequence for Primer-4 contains the 3'-end of the GI promoter and the first 15 bp for the RPI-A coding sequence.

The GI promoter and RPI-A coding sequence PCR products were combined in a second PCR using only the primers Primer-2 and Primer-3, which resulted in a DNA fragment containing the GI promoter linked to the RPI-A coding sequence with the distance between the Shine-Delgarno sequence and initiation codon preserved. The DNA fragment was then digested with the restriction enzymes NcoI and XhoI and ligated into the *Zymomonas*-*E. coli* shuttle vector pZB188/aadA previously treated with the same two enzymes. pZB188/aadA (SEQ ID NO:15) is a vector constructed from pZB188, described in U.S. Pat. No. 5,514,583, which is able to replicate in *E. coli* and *Z. mobilis*, and has a tetracycline resistance marker. Construction of pZB188/aadA was described in commonly owned and co-pending US Patent Application Publication US 2009-0246876 A1 (Example 5, which is herein incorporated by reference), and has a deletion of the tetracycline resistance marker and replacement with a spectinomycin resistance marker. Following ligation, the resulting plasmid, designated pZB-GI-RPI (SEQ ID NO:16), was transformed into chemically competent *E. coli* SCS110 cells (Stratagene, San Diego, Calif.) using the manufacturer's protocol.

The plasmid pZB-GI-RPI isolated from SCS110 cells was transformed into competent *Z. molilis* strain ZW801-4. Competent ZW801-4 cells were prepared by growing cultures overnight in MRM3G5 (1% yeast extract, 15 mM $KH_2PO_4$, 4 mM $MgSO_4$, and 50 g/L glucose) at 30° C. Cells were harvested the next day and transferred to fresh medium to an initial OD600 value of 0.025. Cultures were grown to an OD600 of 0.5, then harvested and washed once with 4° C. sterile-filtered water and then twice with 4° C. 10% glycerol. Competent cells, concentrated by a factor of 200× (OD600=100), were stored at −80° C. until use.

Transformed *Z. molilis* strains containing the pZB-GI-RPI plasmid were isolated from single colonies following incubation on MRM3G5-Spec250 plates (MRM3G5 media with 250 mg/L spectinomycin and 15 g/L agar) incubated for 2 days at 30° C., in an anaerobic jar using AnaeroPacks (Mitsubishi Gas Chemical, New York, N.Y.).

Example 3

Effects of Increased Expression of *Z. Mobilis* Ribulose-5-Phosphate Isomerase in Recombinant *Z. Mobilis* Strains To determine whether recombinant *Z. mobilis* strains carrying extrachromosomal copies of the RPI-A gene would have altered levels of ribulose and improved xylose fermentation, individual transformed strains containing pZB-GI-RPI were selected from MRM3G5-Spec250 plates. Transformed strains (RPI-1 and RPI-2) were transferred to MRM3G5-Spec250 liquid media at a 0.1 initial OD600 and incubated at 30° C. After 14-16 hours incubation, strains were transferred to MRM3X10 medium (1% yeast extract, 15 mM $KH_2PO_4$, 4 mM $MgSO_4$, and 100 g/L xylose) and incubated for 24 hours. Testing the effect of increased RPI-A gene copy number on fermentation performance began after a second transfer of cultures to fresh MRM3X10 medium as a measure to prevent glucose carry-over from the original culture. Transformed strains carrying pZB-GI-RPI and controls (ZW801-4 in duplicate: ZW801-1 and ZW801-2) were inoculated to an initial OD600 of 0.1 and incubated at 30° C. Growth was monitored by optical density measurements. Xylose consumption and product accumulation (i.e. ribulose and ethanol) were monitored by HPLC analysis as described in Example 1.

Figure 3:
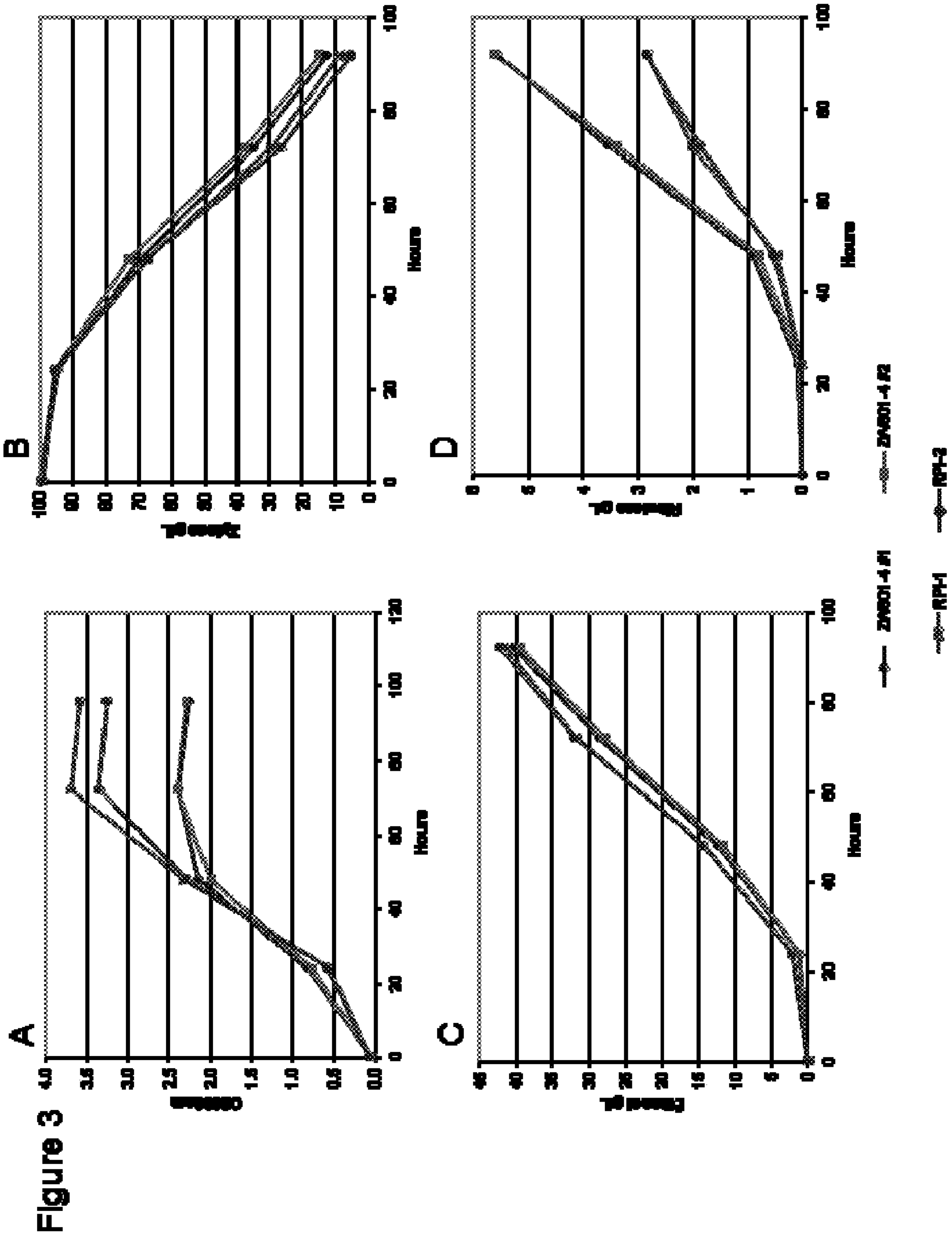
FIG. 3 shows graphs of growth (A), xylose utilization (B), ethanol production (C), and ribulose accumulation in media (D) of cultures of ZW801-4 control strains (ZW801-4#1 and ZW801-4#2) and ZW801-4 strains containing a plasmid containing a chimeric gene with an *A. missouriensis* GI promoter and *Z. mobilis* RPI-A coding region (RPI-1 and RPI-2).

The results for fermentation in MRM3X10 medium are shown in FIG. 3 (A-C). FIG. 3A is a record of the change in optical density for two transformed strains (RPI-1 and RPI-2) compared to the controls (ZW801-4#1 and ZW801-4#2). From this data it can be seen that early growth of the transformed and control strains was similar. However, at the 48-hour time point the control strain ceased growing, whereas the two independent transformed strains continued to increase in cell mass. The increase in cell mass accumulated by the strains carrying extra copies of the *Z. mobilis* RPI-A coding region was also reflected in the increased use of xylose and increase in ethanol production over the later time-points for this experiment (FIGS. 3B and 3C). FIG. 3D also shows the time course for ribulose accumulation for each strain. From this data it is clear that the level of ribulose was reduced for the recombinant strains containing additional *Z. mobilis* RPI-A coding region copies, compared to controls.

Example 4

Expression of the *E. Coli* RPI-A Gene in Recombinant *Zymomonas mobilis*

The RPI-A coding region was cloned from *E. coli* (coding region SEQ ID NO:2108, protein SEQ ID NO:83) and placed into the pZB188/aadA shuttle vector, in a chimeric gene expressed from the native *Z. mobilis* glyceraldehyde-3-phosphate dehydrogernase (GAP) promoter (from ZW1, also called ZM4; SEQ ID NO:17).

The native distance between the Shine-Delgarno sequence for the GAP promoter and the initiation codon of the *E. coli* RPI-A coding region was preserved through primer design. Appropriate restriction enzyme recognition sites were added for cloning purposes. The PCR Primer-5 (SEQ ID NO:5) includes NcoI and SacI recognition sites added to the 5'-end of the GAP promoter sequence. Using Primer-6 (SEQ ID NO:6) in a reaction, paired with Primer-5, and ZW1 (ATCC #31821) genomic DNA as template, produced a 304 base pair DNA fragment containing the entire native *Z. mobilis* GAP promoter. This fragment also contained 15 base pairs of the 5'-end coding sequence for the *E. coli* RPI-A coding region by incorporation into the Primer-6 sequence. Using Primer-7 and Primer-8 (SEQ ID NOS:7 and 8), and genomic DNA isolated from *E. coli* K12, a 660 base pair fragment was amplified by PCR. The 5'-end of the fragment contained 15 base pairs of sequence corresponding to the 3'-end of the GAP promoter. Sequence for the restriction enzyme recognition site XhoI was added to the 3-end of the RPI-A coding region. The GAP promoter and RPI-A coding region fragments were isolated and used in a second PCR with Primer-5 and Primer-8. This reaction resulted in a single DNA fragment which linked the GAP promoter to the *E. coli* RPI-A coding region, preserving the native distance between Shine-Delgarno and initiation codon, also incorporating restriction enzyme sites for cloning into the pZB188/aadA shuttle vector (described in Example 2). Insertion into the shuttle vector followed digestion with the enzymes NcoI and XhoI. Transformation of the ligation product into competent *E. coli* SCS110 cells allowed isolation of an intact plasmid (named pZB-GI-RPI-ECA) which was then transformed into competent *Z. mobilis* ZW801-4 cells by the methods described in Example 2.

Figure 4:
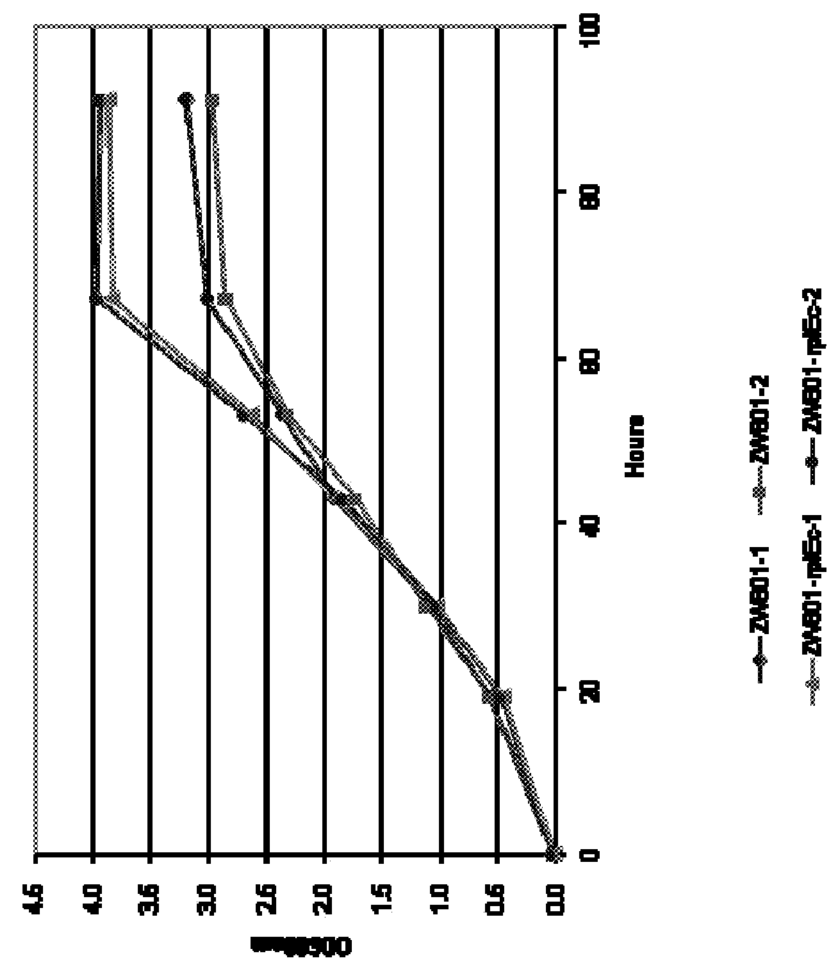
FIG. 4 shows a graph of growth of ZW801-4 control strains (ZW801-1 and ZW801-2) and ZW801-4 strains containing a plasmid containing a chimeric gene with a native *Z. mobilis* GAP promoter and an *E. coli* RPI-A coding region (ZW801-rpiEc-1 and ZW801-rpiEc-2).

Single colonies from MRM3G5-Spec250 plates, named strains ZW801-rpiEc-1 and ZW801-rpiEc-2, were grown in MRM3G10 liquid medium with spectinomycin (250 μg/ml) and then transferred to fresh MRM3×10, along with the parent ZW801-4 strain (ZW801-1 and ZW801-2) as a control. Optical density for the cultures was determined following 16 hours incubation at 30° C. Cells were transferred to fresh MRM3X10 medium, minimizing transfer of glucose into the xylose medium, and growth for the strains containing the chimeric gene expressing the *E. coli RPI-A* coding region was compared to the control (in duplicate) to determine whether an increase in cell mass and reduction in ribulose accumulation was possible through expression of this heterologous gene. Results in FIG. 4 demonstrate an increase in cell mass accumulation for the two independently isolated strains containing the chimeric gene expressing the heterologous RPI-A coding region as compared to controls. The results were similar to those demonstrated for the *Z. mobilis* RPI-A coding region, shown in FIG. 3A, with the transformed lines accumulating higher cell mass. HPLC analysis also demonstrated lower ribulose accumulation in the medium. The end-point analysis at 91 hours resulted in accumulation of 3.03 g/L ribulose for an average of the two control strains and only 2.12 g/L and 1.93 g/L ribulose for the strains ZW801-rpiEc-1 and ZW801-rpiEc-2, respectively. The results from this comparison are consistent with those demonstrated in Example 3, showing increased expression of RPI in a strain growing in medium containing xylose resulted in an increase in cell mass accumulation and reduced ribulose accumulation.

Example 5

Comparative: Fermentation Performance for Recombinant *Z. Mobilis* Strain ZW801-4 with Further Increased Xylose Isomerase Expression The *E. coli* xylA coding region was expressed from a GAP promoter on a multi-copy shuttle vector to increase activity for this enzyme. Expression was in the ZW801-4 strain which is a xylose-utilizing strain with high xylose isomerase activity due to a mutation in the promoter (Pgap) expressing the xylA coding region, as described in Example 1.

Construction of a pZB188/aadA (described in Example 2 above) vector containing the *E. coli* xylose isomerase coding region (coding region SEQ ID NO:20; protein SEQ ID NO:19) with its transcription directed by a native *Z. mobilis* glyceraldehyde-3-phosphate dehydrogenase (GAP) promoter (pZB188/aadA-GapXylA, also called pZB188/aadA-641GapXylA) was previously described in Example 5 of commonly owned and co-pending US Patent Application Publication US 2009-0246876 A1, which is herein incorporated by reference. The PgapXylA expression cassette (SEQ ID NO:18) has the GAP promoter (Pgap) from the ZW641 strain.

The pZB188/aadA and pZB188/aadA-641GapXylA plasmids were transformed into the strain ZW801-4 as described in Example 1 above. Strains were isolated from single colonies grown on a MMG-KAN500 plate (1% yeast extract, 15 mM $KH_2PO_4$, 4 mM $MgSO_4$, 50 g/L glucose, 500 μg/ml kanamycin) and transferred to MRM3X10 medium. The initial cell OD600 was adjusted to 0.08 for each strain and then cells were incubated at 30° C. with shaking at 150 RPM.

Figure 5:
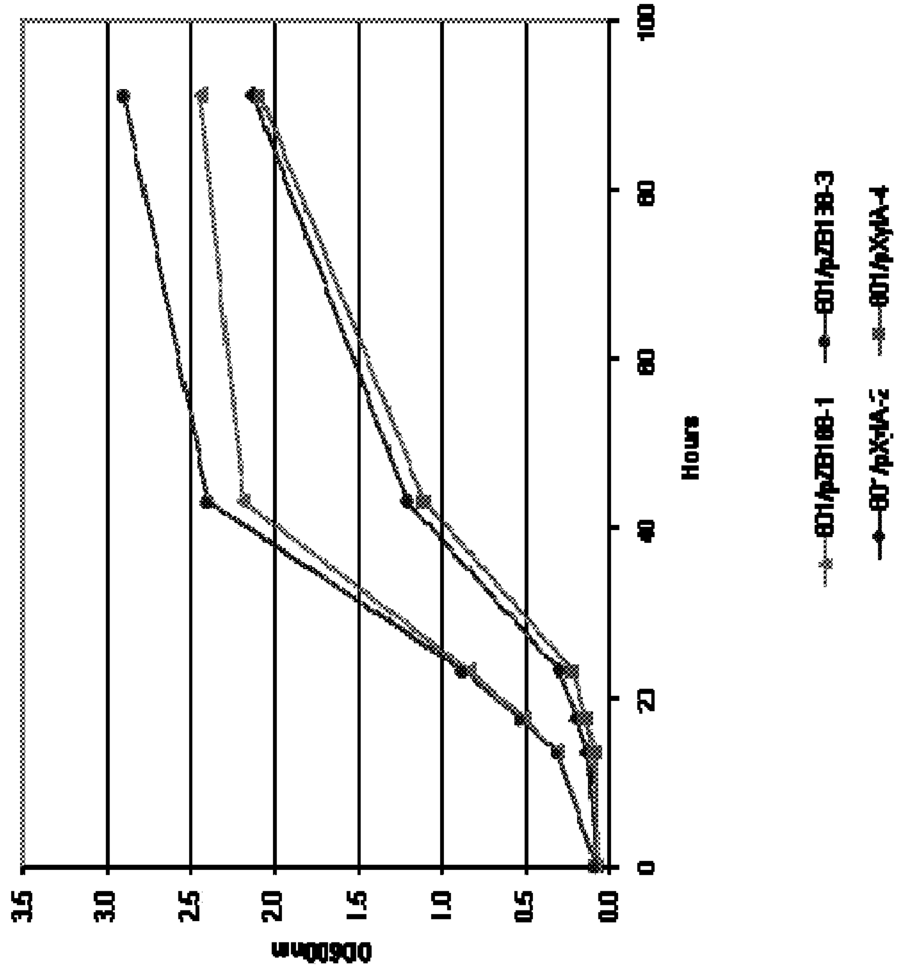
FIG. 5 shows a graph of growth of ZW801-4 control strains (801/pZB188-1 and 801/pZB188-3) and ZW801-4 strains containing a plasmid containing a chimeric gene with a *Z. mobilis* GAP promoter and an *E. coli* xylA coding region (801/pXylA-2 and 801/pXylA-4).

Growth rates of the strains in MRM3X10 medium are shown in FIG. 5. The results show that growth rates for the controls (801/pZB188-1 and 801/pZB188-3) were higher than for strains transformed with pZB188/aadA-641GapXylA (801/pXylA-2 and 801/pXylA-4). Final cell mass was also increased for the control strains growing in media containing xylose. HPLC analysis, in Table 6, also clearly demonstrated reduced use of xylose and lower ethanol production for strains containing pZB188/aadA-641GapXylA. Ribulose accumulation per gram of xylose used was also found to be increased in these strains compared to the control line.

Thus further increased expression of xylose isomerase in ZW801-4, which already has high expression of xylose isomerase as described above, is detrimental to fermentation performance.

TABLE 6

HPLC analysis of culture media following 91 hours incubation.

| Strain | Xylose | Ribulose | Ethanol |
|---|---|---|---|
| 801/pXylA-2 | 34.72 | 4.27 | 32.26 |
| 801/pXylA-4 | 39.05 | 3.93 | 29.67 |
| 801/pZB188-1 | 8.20 | 8.20 | 43.67 |
| 801/pZB188-3 | 5.57 | 6.95 | 45.17 |

Data is in g/L.

Example 6

Fermentation Performance for Strain ZW801-4 with Increased Expression of Xylose Isomerase and Ribulose-5-Phosphate Isomerase Effects of increasing expression of both xylose isomerase (XI) and ribulose-5-phosphate isomerase (RPI) in the high xylose isomerase expressing strain ZW801-4 were assessed.

The shuttle vectors pZB-GI-RPI, described in Example 1, and pZB188/aadA-641GapXylA, described in Example 5, were sequentially transformed into the *Z. mobilis* strain ZW801-4 described above. The strain containing the RPI-A vector, containing a spectinomycin marker, was isolated first by transformation and selection on MRM3G5-spec plates. Transformed cells were isolated as single colonies and then re-transformed with the xylA vector containing a kanamycin resistance marker. Strains isolated from MRM3G5-KAN plates were shown to be both spectinomycin and kanamycin tolerant, and are referred to as xylA/GI-rpiZ strains.

Individual colonies containing the two plasmids (xylA/G1-rpiZ1.1 and xylA/GI-rpiZ1.2) were grown overnight in MRM3G10 medium with both spectinimycin (250 μg/ml) and kanamycin (400 μg/ml). Control strains (ZW801-1 and ZW801-2) were grown in MRM3G10 medium with no antibiotic selection. Cells were then transferred to MRM3X10 medium and incubated for an additional 20 hours at 30° C. A final transfer to fresh MRM3X10 medium, at an initial OD600 of 0.1, was done to minimize transfer of glucose from the original culture into the test medium. The ZW801 control strain, in duplicate, and xylA/GI-rpiZ strains were incubated at 30° C. and monitored for cell growth and sugar consumption by HPLC analysis.

The results are shown in FIG. 6 (A-D). Growth of cells throughout the experiment is shown in FIG. 6A. Strains with increased XI and RPI expression grew at an increased rate and to a higher final cell mass, relative to the controls. The results are in contrast to those in Example 4 where a strain having only increased XI expression grew at a reduced rate in medium containing xylose. FIGS. 6B and 6C also show an improved fermentation performance with an increase in xylose use rate and final xylose amount consumed for strains carrying both xylA and RPI-A shuttle vectors, with increased xylose use reflected in an increase in final ethanol titer. FIG. 6D shows that ribulose levels were also found to be lower as compared to the controls.

Thus the combination of increased XI and RPI remedied the detrimental effect of increased XI alone (Example 5) and further increased xylose utilization and ethanol production in the high XI ZW801-4 strain.

Example 7

Increased Ribulose-5-Phosphate Isomerase Protein Levels in Recombinant *Z. mobilis* Strains Data in the above Examples demonstrated that increased expression of RPI-A protein in recombinant *Z. moblilis* resulted in increased fermentation performance. This example demonstrates an alternative method for increasing RPI in transformed cells.

The translation initiation codon for the *Z. mobilis* RPI-A coding region (SEQ ID NO:3895) was changed from the naturally occurring GTG codon to the more common ATG codon. In addition, the native *Z. mobilis* GAP promoter was linked to the coding sequence for RPI-A while preserving the distance between the Shine-Delgarno sequence and the initiation codon for this promoter. The GAP promoter (SEQ ID NO:17) was isolated from *Z. mobilis* ZW1 genomic DNA by PCR using Primer-5 (SEQ ID NO:5), which has NcoI and SacI restriction enzyme sites incorporated at the 3'-end and Primer-9 (SEQ ID NO:9), containing a 15 base pair overlap with the start of the RPI-A coding region. The 15 base pair overlap in Primer-9 also alters the native GTG start codon to an ATG.

The RPI-A coding region was isolated in a separate PCR using *Z. mobilis* ZW1 genomic DNA as template with Primer-10 (SEQ ID NO:10), also with the ATG start codon change and a 15 base pair overlap with the GAP promoter. Primer-11 (SEQ ID NO:11) was paired with Primer-10 in a reaction leading to isolation of the complete coding sequence for RPI-A. Primer-11 also contains an XhoI restriction enzyme recognition site for cloning into the pZB188 shuttle vector.

Following the two separate reactions, a third PCR was run with the two isolated DNA fragment products using Primer-5 and Primer-11. From this reaction a DNA fragment containing a GAP promoter linked to the RPI-A coding region with an ATG start codon was isolated and it was then digested with the enzymes NcoI and XhoI. The fragment was ligated into the pZB188/aadA shuttle vector, which was used to determine the effect of an altered start codon on steady state protein levels in transformed cells.

As a control, the same RPI-A coding region was isolated with its native GTG start codon by the same method, except that Primer-12 (SEQ ID NO:12) and Primer-13 (SEQ ID NO:13) were substituted in place of Primers 9 and 10. Following the first round of PCR, the two DNA fragments, one containing the GAP promoter with 15 base pair overlap to the native RPI-A coding region and the other containing the RPI-A coding region with the native start codon, were isolated and used in a third PCR. This reaction included Primer-5 and Primer-11, and produced a DNA fragment containing the GAP promoter linked to the RPI-A coding region with a native GTG start codon. This fragment was digested with the restriction enzymes NcoI and XhoI and ligated into the pZB188/aadA shuttle vector. The GAP-promoter native RPI-A expression vector was used as a control to compare to protein levels produced by cells containing the same promoter linked to the ATG altered version of the RPI-A coding region.

The shuttle vectors containing the native and ATG-altered genes were transformed into *E. coli* SCS110 competent cells. The plasmids isolated from *E. coli* were used to transform competent ZW801-4 cells and single colonies were selected by plating on MRM3G5-spec plates. Isolated single colonies named ZW801 GAP-rpi-1, ZW801 GAP-rpi-3 and ZW801 GAP-rpi-4 were grown overnight in MRM3G5 media with spectinomycin (250 μg/ml) and harvested for preparation of protein extracts. Extracts were made by transferring cells to fresh MRM3G10 medium and growing to an OD600 of 0.6 to 0.8. Concentration of total protein in the extracts was controlled by dilution of cells in a ratio of 1 OD600 to 44.38 μl of sample buffer. Sample buffer consisted of 650 μl water, 250 μl Nupage 4× loading buffer, and 100 μl 10× Nupage reducing buffer. The cells suspended in sample buffer, were heated to 80° C. for 10 minutes. Supernatants were collected following centrifugation at 13000 RPM for 10 minutes. Fifteen microliters of protein extract from the supernatants and Mark12 unstained standards (Invitrogen, Carlsbad, Calif.) were loaded on a 4-12% Nupage Bis-Tris acrylamide gel (Invitrogen, Carlsbad, Calif.), which was run using Nupage 1×MES SDS running buffer.

The SDS gel, stained with Simply Blue Safe Stain (Invitrogen, Carlsbad, Calif.) is shown in FIG. 7. From this figure it can be seen that the level of RPI-A protein from an extract of total protein was higher in strains containing the start codon altered RPI-A coding region (ZW801 GAP-rpi-1, ZW801 GAP-rpi-3 and ZW801 GAP-rpi-4 in lanes 2, 3, and 4, respectively) compared to the control lanes containing the native RPI-A coding region (lanes 5 and 6). The results are a clear demonstration that the level of *Z. mobilis* RPI-A protein level was increased in transformed lines by changing the start codon from the native GTG to ATG.

Example 8

Structural Analysis of Ribose-5-Phosphate Isomerase Enzymes

For analysis of RPI sequence structure, RPI proteins functionally characterized as ribose-5-phosphate isomerases were extracted from Brenda (BRENDA, AMENDA and FRENDA the enzyme information system: new content and tools in 2009. Chang A., Scheer M., Grote A., Schomburg I., Schomburg D. *Nucleic Acids Res.* 2009, Vol. 37, Database issue, D588-D592) and PubMed (US National Library of Medicine, National Institutes of Health) databases. These seed sequences included 15 sequences for RPI-A and 5 sequences for RPI-B. The RPI-A seed sequences are those from *E. coli* (SEQ ID NO:83), *Enterobacter cloacae* (SEQ ID NO:84), *Vibrio vulnificus* (SEQ ID NO:85), *Thermus thermophilus* (SEQ ID NO:86), *Chlamydomonas reinhardtii* (SEQ ID NO:87), *Spinacia oleracea* (SEQ ID NO:88), *Arabidopsis thaliana* (SEQ ID NO:89), *Arabidopsis thaliana* (SEQ ID NO:90), *Plasmodium falciparum* (SEQ ID NO:91), *Pyrococcus horikoshii* (SEQ ID NO:92), *Methanocaldococcus jannaschii* (SEQ ID NO:93), *Fibrobacter succinogenes* (SEQ ID NO:94), *Homo sapiens* (SEQ ID NO:95), *Caenorhabditis elegans* (SEQ ID NO:96), and *Saccharomyces cerevisiae* (SEQ ID NO:97). The RPI-B seed sequences are those from *Mycobacterium tuberculosis* (SEQ ID NO:1213), *Thermotoga maritime* (SEQ ID NO:1214), *Clostridium thermocellum* (SEQ ID NO:1215), *Escherichia coli* (SEQ ID NO:1216), and *Trypanosoma cruzi* (SEQ ID NO:1217). References with abstracts providing information on functional characterization of RPIs used as seed sequences is provided in Appendix file “rpi_exp_evid.doc”.

Each sequence (member) of the seed sequences was used to search the non-redundant Genbank database (National Center for Biotechnology Information, Bethesda, Md.) using BLAST with the E-value set at 0.001. Blast search results were combined separately for RPI-A and RPI-B, and redundancy at 100% ID and 100% length overlap was performed. This analysis resulted in 1232 RPI-A sequences and 1206 RPI-B sequences. These numbers were reduced to 1155 RPI-A sequences and 1112 RPI-B sequences by retaining sequences with a length in the range of 200-300 amino acids for RPI-A and 125-185 amino acids for RPI-B.

A multiple sequence alignment was made for each set of RPI-A and RPI-B seed sequences, which was then used to create a profile Hidden Markov Model (HMM) using the hmmsearch algorithm of the HMMER software package following the user guide which is available from HMMER (Janelia Farm Research Campus, Ashburn, Va.). The theory behind profile HMMs is described in R. Durbin, S. Eddy, A. Krogh, and G. Mitchison, *Biological sequence analysis: probabilistic models of proteins and nucleic acids*, Cambridge University Press, 1998; Krogh et al., 1994; J. Mol. Biol. 235:1501-1531). As stated in the user guide, Profile HMMs are statistical models of multiple sequence alignments. They capture position-specific information about how conserved each column of the alignment is, and which amino acid residues are most likely to occur at each position. Thus HMMs have a formal probabilistic basis. Profile HMMs for a large number of protein families are publicly available in the PFAM database (Janelia Farm Research Campus, Ashburn, Va.), and the software is publicly available for creating profile HMMs.

The Profile HMMs were built as follows:

Step 1. Build a Sequence Alignment

The seed sequences (sequences with high confidence infunctional characterization) were aligned using Clustal W with default parameters.

Step 2. Build a Profile HMM

The hmmbuild program was run on each set of aligned sequences using default parameters. hmmbuild reads the multiple sequence alignment file, builds a new Profile HMM, and saves the Profile HMM to file. Using this program a profile was generated from the multiple alignment for each set of seed sequences described above. The profile HMM for RPI-A is given in Table 4 and the profile HMM for RPI-B is given in Table 5.

The following information based on the HMMER software user guide gives some description of the way that the hmmbuild program prepares a Profile HMM. A Profile HMM is capable of modeling gapped alignments, e.g. including insertions and deletions, which lets the software describe a complete conserved domain (rather than just a small ungapped motif). Insertions and deletions are modeled using insertion (I) states and deletion (D) states. All columns that contain more than a certain fraction x of gap characters will be assigned as an insert column. By default, x is set to 0.5. Each match state has an I and a D state associated with it. HMMER calls a group of three states (M/D/I) at the same consensus position in the alignment a “node”. These states are interconnected with arrows called state transition probabilities. M and I states are emitters, while D states are silent. The transitions are arranged so that at each node, either the M state is used (and a residue is aligned and scored) or the D state is used (and no residue is aligned, resulting in a deletion-gap character, ‘–’). Insertions occur between nodes, and I states have a self-transition, allowing one or more inserted residues to occur between consensus columns.

The scores of residues in a match state (i.e. match state emission scores), or in an insert state (i.e. insert state emission scores) are proportional to Log_2 (p_x)/(null_x). Where p_x is the probability of an amino acid residue, at a particular position in the alignment, according to the Profile HMM and null_x is the probability according to the Null model. The Null model is a simple one state probabilistic model with pre-calculated set of emission probabilities for each of the 20 amino acids derived from the distribution of amino acids in the SWISSPROT release 24.

State transition scores are also calculated as log odds parameters and are propotional to Log_2 (t_x). Where t_x is the probability of transiting to an emitter or non-emitter state.

Step 3. Check the Profile HMM

The Profile HMMs were searched against the corresponding set of RPI-A or RPI-B homologues retrieved by BLAST search as noted above. An E value of 0.1 was used as a cut-off, with the Z parameter set to 1 billion. All RPI-A and RPI-B sequence homologues, except for one, were identified by the profile HMM searches. The non-matching sequence was removed. The RPI-A Profile HMM is given in Table 4, the RPI-B Profile Hmm is in Table 5.

Refining RPI-A and RPI-B Sequence Sets

Further refining of RPI-A and RPI-B sequence sets was as follows. Multiple sequence alignments were performed to remove sequences with internal, N-terminal or C-terminal truncations. This resulted in 1145 sequences for RPI-A and no change for RPI-B (1112 sequences).

Sequences were evaluated with respect to active site residues that had been identified for RPI-A and RPI-B (Roos et al. (2004) J. Mol. Biol. 335:799-809; Graile et al. (2005) Biochimie 87:763-769). These active site residues are:

For RPI-A: aspartic acid and glutamic acid at positions 107 and 128, respectively, in the *S. cerevisiae* sequence (D107 and E128; SEQ ID NO:97). Positions 107 and 128 of the *S. cerevisiae* protein correspond to positions 91 and 114, respectively, in the HMM profile.

For RPI-B: cysteine and threonine at positions 66 and 68, respectively, in the *E. coli* sequence (C66 and T68; SEQ ID NO:1216). Positions 66 and 68 of the *E. coli* protein correspond to positions 69 and 71, respectively, in the HMM profile.

OR: serine and glutamic acid at positions 68 and 72, respectively, in the *M. tuberculosis* sequence (S68 and E72; SEQ ID NO:1213). Positions 68 and 72 of the *M. tuberculosis* protein correspond to positions 71 and 75, respectively, in the HMM profile.

Proteins lacking the appropriate catalytic site residues were removed from the sets of RPI-A or RPI-B homologues. The final set of RPI-A proteins was 1130 proteins.

It was found that although the RpiB Profile HMM was generated from an alignment of RPI-B sequences derived from experimentally verified enzymes, the Profile HMM identifies a general class of sugar isomerases known as the RpiB/LacA/LacB family that contains, in addition to ribose-6-phosphate isomerase, the two subunits LacA and LacB of galactose-6-phosphate isomerase. The two subunits are easily identifiable: They are contiguously positioned in the genome, one subunit lacks the two catalytic residues, and the other brings complementary active site residues as well as the two catalytic residues.

The LacA subunit was removed from the RPI-B set of proteins by its lack of the catalytic residues. LacB proteins were distinguished from RPI-B proteins based on having leucine instead of asparagine at position 100 in the *E. coli* and *M. tuberculosis* proteins (SEQ ID NOs:1216 and 1213). RPI-B proteins may also have glycine, aspartic acid, serine, or glutamic acid at the position corresponding to 100, which corresponds to position 104. In the Profile HMM. Proteins having leucine at this position were removed from the RPI-B protein set, leaving 895 sequences.

Through this structural analysis, proteins matching RPI-A function have been identified as SEQ ID NOs:83 through 1212. Coding sequences for RPI-A proteins are SEQ ID NOs:2108 through 3237.

Through this structural analysis, proteins matching RPI-B function have been identified as SEQ ID NOs: 1213 through 2107. Coding sequences for RPI-B proteins are SEQ ID NOs: 3238 through 4132.

TABLE 3

HMMER2.0 [2.3.2][1]
NAME brenda_xylA3_seqs-con[2]
LENG 455[3]
ALPH Amino[4]
MAP yes[5]
COM hmmbuild brenda-xyla3.hmm brenda_xylA3_seqs-con.aln[6]
COM hmmcalibrate brenda-xyla3.hmm[7]
NSEQ 32[8]
DATE Wed Mar 12 21:55:22 2008[9]
XT −8455 −4 −1000 −1000 −8455 −4 −8455 −4
NULT −4 −8455[10]
NULE 595 −1558 85 338 −294 453 −1158 197 249 902 −1085 −142 −21 −313 45 531 201 384 −1998 −644[11]
EVD −379.726868 0.105452[12]

| HMM | A m->m | C m->i | D m->d | E i->m | F i->i | G d->m | H d->d | I b->m | K m->e | L | M | N | P | Q | R | S | T | V | W | Y | |
|---|---|---|---|---|---|---|---|---|---|---|---|---|---|---|---|---|---|---|---|---|---|
| | −152 | * | −3322 | | | | | | | | | | | | | | | | | | |
| 1(W) | −204 | 887 | 46 | 246 | −204 | −619 | 891 | −475 | 338 | −941 | 659 | 291 | −334 | 598 | 147 | −143 | 7 | −471 | 1260 | 199 | 51 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −383 | −8312 | −2119 | −894 | −1115 | −701 | −1378 | −152 | * | | | | | | | | | | | | |
| 2(I) | −652 | −1642 | −4507 | −4008 | 395 | −3998 | −3165 | 3120 | −3750 | 38 | −736 | −3643 | −3893 | −3438 | −3659 | −3185 | −1974 | 1769 | −2848 | −2496 | 52 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −9 | −7937 | −8980 | −894 | −1115 | −1952 | −431 | * | * | | | | | | | | | | | | |
| 3(D) | −60 | −2403 | 1750 | 355 | −2717 | 573 | −526 | −2474 | −145 | −2417 | −1502 | 888 | 1044 | 650 | −666 | 634 | −860 | −2023 | −2588 | −1891 | 53 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −9 | −7937 | −8980 | −894 | −1115 | −1952 | −431 | * | * | | | | | | | | | | | | |
| 4(K) | −1273 | −2543 | −1243 | −600 | −2936 | −2186 | −668 | −2589 | 2995 | −2503 | 541 | −838 | −82 | 803 | 733 | −1166 | −210 | −2211 | −2612 | −2088 | 54 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −9 | −7937 | −8980 | −894 | −1115 | −1952 | −431 | * | * | | | | | | | | | | | | |
| 5(I) | −2454 | −1957 | −5121 | −4804 | −2568 | −4911 | −4887 | 3182 | −4747 | −1338 | −1282 | −4599 | −4682 | −4674 | −4889 | −4283 | −2449 | 2522 | −4274 | −3775 | 55 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −9 | −7937 | −8980 | −894 | −1115 | −1952 | −431 | * | * | | | | | | | | | | | | |
| 6(Q) | −232 | −2237 | −616 | 690 | −2557 | −420 | −400 | −2306 | 1437 | −2253 | −1327 | 1063 | −363 | 1500 | 815 | −649 | 560 | −754 | −2421 | −1740 | 56 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −9 | −7937 | −8980 | −894 | −1115 | −1952 | −431 | * | * | | | | | | | | | | | | |
| 7(Y) | −4607 | −3566 | −5021 | −5359 | 2754 | −4894 | −1132 | −3491 | −4922 | −2814 | −2904 | −3541 | −4763 | −3674 | −4302 | −4158 | −4468 | −3655 | −380 | 4341 | 57 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −9 | −7937 | −8980 | −894 | −1115 | −1952 | −431 | * | * | | | | | | | | | | | | |
| 8(E) | −1557 | −2509 | −804 | 3252 | −3197 | −2167 | −1540 | −2531 | −1429 | −2964 | −2264 | −1142 | −2608 | −1221 | −1910 | −404 | −1676 | 930 | −3370 | −2737 | 58 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −9 | −7937 | −8980 | −894 | −1115 | −1952 | −431 | * | * | | | | | | | | | | | | |
| 9(G) | −4079 | −3917 | −4766 | −5131 | −5608 | 3825 | −4746 | −6295 | −5445 | −6007 | −5654 | −4803 | −4532 | −5224 | −5099 | −4361 | −4464 | −5518 | −4690 | −5554 | 59 |
| — | −149 | −500 | 233 | 44 | −381 | 398 | 108 | −625 | 210 | −466 | −721 | 275 | 394 | 45 | 97 | 359 | 117 | −369 | −295 | −250 | |
| — | −284 | −2499 | −8980 | −602 | −1552 | −1952 | −431 | * | * | | | | | | | | | | | | |
| 10(K) | −211 | −2265 | −699 | −143 | −2591 | −1802 | −444 | −2325 | 2070 | −2275 | −1362 | −444 | 1490 | 1183 | 432 | 193 | 169 | −1892 | −2442 | −1783 | 62 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −9 | −7937 | −8980 | −894 | −1115 | −1952 | −431 | * | * | | | | | | | | | | | | |
| 11(K) | −238 | −2256 | 1519 | 758 | −2576 | −602 | −412 | −2328 | 1550 | −2272 | −1346 | 498 | −1845 | 1040 | −505 | 399 | 267 | −1878 | −2440 | −1756 | 63 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −9 | −7937 | −8980 | −894 | −1115 | −1952 | −431 | * | * | | | | | | | | | | | | |

TABLE 3-continued

| | | | | | | | | | | | | | | | | | | | | | |
|---|---|---|---|---|---|---|---|---|---|---|---|---|---|---|---|---|---|---|---|---|---|
| 12(S) | −24 | −1368 | −1330 | −776 | −1457 | −2006 | −777 | −219 | 3 | −20 | −569 | −944 | −366 | −548 | −1012 | 2341 | 203 | −865 | −1771 | −1305 | 64 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −9 | −7937 | −8980 | −894 | −1115 | −1952 | −431 | * | * | | | | | | | | | | | | |
| 13(K) | −815 | −2291 | 332 | 381 | −2610 | −1764 | −439 | −2362 | 2248 | −2306 | −1383 | 929 | −1870 | 1259 | −537 | 203 | 744 | −1912 | −2474 | −1788 | 65 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −9 | −7937 | −8980 | −894 | −1115 | −1952 | −431 | * | * | | | | | | | | | | | | |
| 14(N) | −112 | −2600 | −523 | 381 | −2952 | −1931 | −753 | −2702 | 541 | −2657 | −1773 | 3112 | −2133 | −322 | −907 | 983 | −1121 | −2258 | −2837 | −2142 | 66 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −9 | −7937 | −8980 | −894 | −1115 | −1952 | −431 | * | * | | | | | | | | | | | | |
| 15(P) | −67 | −1766 | −1443 | −999 | −2363 | 1282 | −1134 | −1992 | 272 | −2170 | 1037 | −1129 | 2920 | −813 | −1183 | −1074 | −1062 | −1654 | −2530 | −2036 | 67 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −9 | −7937 | −8980 | −894 | −1115 | −1952 | −431 | * | * | | | | | | | | | | | | |
| 16(L) | −1558 | −1364 | −253 | −3026 | 1709 | −3054 | −1523 | −618 | −2677 | 2198 | 1130 | −2548 | −3046 | −2242 | −2517 | −2147 | −1490 | −703 | −1178 | 1973 | 68 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −9 | −7937 | −8980 | −894 | −1115 | −1508 | −625 | * | * | | | | | | | | | | | | |
| 17(A) | 2539 | −1340 | −2407 | −1923 | −114 | 254 | −1611 | −1400 | −1746 | −1704 | 967 | −1746 | −2462 | −1570 | −1957 | 1232 | −1093 | −1168 | −2213 | −1825 | 69 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −8 | −8005 | −9047 | −894 | −1115 | −1811 | −484 | * | * | | | | | | | | | | | | |
| 18(F) | −3970 | −3283 | −4844 | −4992 | 4163 | −4617 | −1220 | −3051 | −4579 | −2594 | −2558 | −3472 | −4567 | −3555 | −4097 | −3851 | −332 | −3156 | −493 | 2114 | 70 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −8 | −8005 | −9047 | −894 | −1115 | −1811 | −484 | * | * | | | | | | | | | | | | |
| 19(K) | −1512 | −2771 | −1507 | −818 | −3232 | −2385 | 2267 | −2858 | 2388 | −2715 | −1873 | 46 | −2431 | 989 | 2056 | −1394 | −1391 | −589 | −2767 | −2293 | 71 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −8 | −8005 | −9047 | −894 | −1115 | −1811 | −484 | * | * | | | | | | | | | | | | |
| 20(Y) | −3420 | −2864 | −4689 | −4633 | 1930 | −4361 | 3299 | −2576 | −4223 | −668 | −2142 | −3313 | −4295 | −3326 | −3804 | −3534 | −3326 | −132 | 2330 | 3572 | 72 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −8 | −8005 | −9047 | −894 | −1115 | −1811 | −484 | * | * | | | | | | | | | | | | |
| 21(Y) | −3783 | −3746 | −2646 | −265 | −826 | −3845 | −1884 | −3929 | −3309 | −3512 | −3401 | −2873 | −4182 | −3050 | −3402 | −3623 | −3828 | −3890 | −1488 | 4716 | 73 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −8 | −8005 | −9047 | −894 | −1115 | −1811 | −484 | * | * | | | | | | | | | | | | |
| 22(N) | −2403 | −4115 | 2160 | −610 | −4589 | −2333 | −1803 | −4558 | −2130 | −4439 | −3800 | 3631 | −2908 | −1490 | −3023 | −352 | −2529 | −3961 | −4620 | −3589 | 74 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −8 | −8005 | −9047 | −894 | −1115 | −1811 | −484 | * | * | | | | | | | | | | | | |
| 23(P) | 1749 | −1901 | −2474 | −2677 | −4084 | −2051 | −2900 | −3873 | −3079 | −4087 | −3221 | 194 | 3510 | −2758 | −3227 | −1440 | −1653 | −2866 | −4265 | −3960 | 75 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −8 | −8005 | −9047 | −894 | −1115 | −1811 | −484 | * | * | | | | | | | | | | | | |
| 24(E) | −1269 | −2810 | 2039 | 2488 | −3105 | −1980 | −824 | −2879 | 132 | −2814 | −1924 | 557 | −2199 | 462 | −1082 | −1105 | −1230 | −604 | −2987 | −2252 | 76 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −8 | −8005 | −9047 | −894 | −1115 | −1811 | −484 | * | * | | | | | | | | | | | | |
| 25(E) | −1569 | −3030 | −675 | 2974 | −3390 | −2199 | −979 | −3118 | 1545 | −3013 | −2167 | −824 | −2424 | 431 | −850 | −255 | −1514 | −2686 | −3134 | −2484 | 77 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −8 | −8005 | −9047 | −894 | −1115 | −1811 | −484 | * | * | | | | | | | | | | | | |
| 26(V) | −940 | −874 | −2689 | 438 | 215 | −2419 | −1259 | 1264 | 196 | 312 | −72 | −1852 | −2473 | −1538 | −1814 | −1476 | 712 | 1953 | −1336 | −976 | 78 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −8 | −8005 | −9047 | −894 | −1115 | −1811 | −484 | * | * | | | | | | | | | | | | |
| 27(I) | −2373 | −1909 | −4992 | −4608 | −2445 | −4701 | −4324 | 2910 | −4485 | −353 | −1224 | −4353 | −4509 | −4336 | −4547 | −3996 | −278 | 2559 | −3880 | −3432 | 79 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −8 | −8005 | −9047 | −894 | −1115 | −1147 | −867 | * | * | | | | | | | | | | | | |
| 28(M) | 297 | −2163 | 527 | 293 | −2408 | 1145 | −557 | −2107 | 444 | 404 | 2320 | 222 | −1978 | −127 | −668 | −804 | −824 | −1744 | −2394 | −1759 | 80 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −8 | −8107 | −9149 | −894 | −1115 | −623 | −1512 | * | * | | | | | | | | | | | | |

TABLE 3-continued

| | | | | | | | | | | | | | | | | | | | | | |
|---|---|---|---|---|---|---|---|---|---|---|---|---|---|---|---|---|---|---|---|---|---|
| 29(G) | −858 | −2502 | 613 | −529 | −2936 | 2600 | −948 | −2664 | −620 | −2675 | 970 | 838 | −430 | −525 | −1133 | 25 | −1200 | −2235 | −2897 | −2236 | 81 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8252 | −9294 | −894 | −1115 | −533 | −1695 | * | * | | | | | | | | | | | | |
| 30(K) | −1648 | −2125 | −2186 | −1533 | −1645 | −2748 | 734 | −1787 | 3106 | −865 | −1291 | −1622 | −2796 | −1038 | −912 | −1781 | −1555 | 269 | −1998 | 1612 | 82 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 31(T) | −1046 | −2501 | −897 | 404 | −2830 | −2011 | −653 | −2571 | 1787 | −2511 | −1591 | −648 | 227 | 1574 | 636 | −249 | 1801 | −2128 | −2671 | −2004 | 83 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 32(M) | −551 | −1875 | −3895 | −3452 | −1627 | −3127 | −2589 | −1019 | −3062 | 172 | 4465 | −3001 | 1725 | −2776 | −2984 | −2338 | −1912 | −1168 | −2513 | −2250 | 84 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 33(K) | 127 | −2511 | −888 | 1379 | −2865 | −2030 | −726 | −2605 | 2447 | −2560 | −1648 | −691 | −2148 | −275 | −785 | 270 | 1004 | −2163 | −2733 | −2065 | 85 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 34(D) | −2246 | −3964 | 2730 | 2201 | −4210 | −2482 | −1633 | −4052 | −1600 | −3950 | −3164 | −1082 | 1471 | −1258 | 488 | −1984 | −2261 | −3563 | −4127 | −3260 | 86 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 35(W) | −307 | −2255 | −1047 | 1375 | −2417 | −2110 | 3282 | −2137 | −380 | −1097 | −1379 | −803 | −2206 | 929 | −826 | −1054 | −1045 | −1820 | 3681 | −1859 | 87 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 36(L) | −2283 | −2311 | 1522 | −2528 | 661 | −3412 | 1226 | −1601 | −2637 | 2573 | −1135 | −2460 | −3499 | −2296 | −2785 | −2587 | −2228 | −1696 | −1466 | −539 | 88 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 37(R) | −3325 | −3893 | −4311 | −2623 | −4835 | −3766 | 1845 | −4080 | 1753 | −3674 | −3032 | −2431 | −3666 | −1120 | 3594 | −3191 | −2938 | −3882 | −3468 | −3430 | 89 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 38(F) | −5308 | −4420 | −5610 | −5948 | 4547 | −4921 | −3048 | −4656 | −5852 | −3992 | −4112 | −4995 | −5217 | −5110 | −5315 | −5363 | −5399 | −4866 | −2341 | −1279 | 90 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 39(S) | 2011 | −1975 | −4184 | −4245 | −4465 | −522 | −3670 | −4249 | −4052 | −4495 | −3559 | −2916 | −3035 | −3647 | −3928 | 2570 | 1512 | −3083 | −4681 | −4554 | 91 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 40(V) | −389 | −1555 | −4211 | −3620 | 2221 | −3520 | −2467 | 827 | −3266 | −146 | 1500 | −3166 | −3495 | −2880 | −3090 | −2639 | −1760 | 2647 | −2235 | −1917 | 92 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 41(A) | 2968 | 1546 | −4577 | −4780 | −4439 | 1767 | −3862 | −4189 | −4447 | −4480 | −3561 | −3040 | −3058 | −3946 | −4144 | −1616 | −19 | −3053 | −4696 | −4614 | 93 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 42(Y) | −4757 | −3801 | −5352 | −5629 | 2454 | −5193 | −1481 | −3601 | −5191 | 1280 | −3022 | −3865 | −5051 | −3974 | −4590 | −4428 | −4620 | −3780 | 3031 | 3651 | 94 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 43(W) | −6178 | −4896 | −5848 | −6204 | −4109 | −4952 | −4743 | −6650 | −6203 | −5992 | −6031 | −5971 | −5371 | −6028 | −5699 | −6531 | −6329 | −6559 | 6291 | −3733 | 95 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 44(H) | −2390 | −2940 | −3006 | −3167 | −3361 | −3029 | 4890 | −4377 | −2892 | −4385 | −3795 | −2928 | −3660 | −3087 | −2954 | −2556 | 2015 | −3712 | −3688 | −2968 | 96 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −383 | −8312 | −2119 | −894 | −1115 | −701 | −1378 | * | * | | | | | | | | | | | | |
| 45(T) | −1111 | −1722 | −3459 | −3693 | −4071 | −1979 | −3313 | −3836 | −3645 | −4141 | −3273 | −2568 | −2762 | −3316 | −3519 | 182 | 3789 | −2767 | −4303 | −4118 | 97 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −9 | −7937 | −8980 | −894 | −1115 | −254 | −2629 | * | * | | | | | | | | | | | | |

TABLE 3-continued

| | | | | | | | | | | | | | | | | | | | | | |
|---|---|---|---|---|---|---|---|---|---|---|---|---|---|---|---|---|---|---|---|---|---|
| 46(F) | −2728 | −2359 | −5136 | −4558 | 3354 | −4572 | −3468 | 910 | −4252 | 475 | 1893 | −4231 | −4294 | −3617 | −3993 | −3745 | −2649 | 1605 | −2824 | −2691 | 98 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 47(C) | −1098 | 2971 | 1338 | −866 | −2368 | 1340 | −1058 | −2007 | −774 | −2171 | −1369 | −1075 | −2324 | −705 | 113 | −1140 | 1757 | −600 | −2527 | −1988 | 99 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 48(W) | 1080 | −2296 | −913 | 535 | −2548 | 415 | −675 | −2251 | −288 | −2283 | 573 | 864 | −2098 | 1523 | −780 | −923 | −946 | −1882 | 3639 | −1888 | 100 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 49(D) | −994 | −2466 | 1756 | 978 | −2785 | −1962 | −625 | −2536 | −208 | −2481 | −1556 | 1471 | −2058 | 1356 | 818 | −349 | 553 | −426 | −2650 | −1967 | 101 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 50(W) | −204 | 887 | 46 | 246 | −204 | −619 | 891 | −475 | 338 | −941 | 659 | 291 | −334 | 598 | 147 | −143 | 7 | −471 | 1260 | 199 | 102 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 51(G) | −321 | −2099 | −3782 | −3944 | −3733 | 3298 | −3507 | −3250 | −3871 | 860 | −2925 | −2956 | −3185 | −3562 | −3763 | −1823 | −1971 | −2699 | −4191 | −3938 | 103 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 52(R) | 877 | −2295 | −923 | −374 | −2567 | −29 | −672 | −2273 | 201 | −2299 | −1418 | 171 | −2092 | −237 | 1473 | 1037 | 601 | 603 | −2534 | −1895 | 104 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 53(D) | −4886 | −4905 | 4186 | −3339 | −5949 | −4221 | −4195 | −6666 | −4787 | −6283 | −6022 | −3676 | −4750 | −4186 | −5191 | −4762 | −5055 | −6188 | −5117 | −5507 | 105 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 54(P) | −358 | −1704 | −2202 | −1724 | −1995 | −2408 | −1572 | −1504 | −1467 | −1768 | 1554 | −1730 | 3367 | 1187 | −1721 | −1521 | −1336 | −433 | −2377 | −1966 | 106 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 55(F) | −5308 | −4420 | −5610 | −5948 | 4547 | −4921 | −3048 | −4656 | −5852 | −3992 | −4112 | −4995 | −5217 | −5110 | −5315 | −5363 | −5399 | −4866 | −2341 | −1279 | 107 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 56(G) | −4740 | −4445 | −5364 | −5738 | −6131 | 3840 | −5265 | −6903 | −6030 | −6539 | −6235 | −5426 | −5034 | −5814 | −5624 | −5041 | −5115 | −6153 | −5123 | −6096 | 108 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 57(D) | 674 | −2424 | 2070 | 271 | −2717 | 297 | −669 | −2448 | 257 | −2431 | −1527 | −639 | −352 | −221 | −775 | −916 | −171 | 1037 | −2630 | −1963 | 109 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 58(G) | 2216 | −2048 | −3999 | −4272 | −4632 | 2814 | −3817 | −4443 | −4322 | −4692 | −3754 | −2971 | 778 | −3836 | −4128 | −1679 | −1899 | −3208 | −4829 | −4747 | 110 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 59(T) | −552 | −1875 | −3402 | −3173 | −3341 | −2281 | −2846 | −2926 | −3030 | −3256 | −2480 | −431 | −2933 | −2784 | −3135 | 445 | 3459 | 549 | −3668 | −3358 | 111 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 60(M) | 1157 | −1590 | −1704 | −1125 | 650 | −2335 | −1036 | −1217 | 1096 | −1475 | 2399 | −1271 | −2407 | −836 | 1972 | −1316 | −1065 | −1061 | −1945 | 272 | 112 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 61(Q) | 506 | −2444 | 274 | 1073 | −701 | −1222 | −615 | −365 | 270 | −2458 | −1534 | 700 | −532 | 2051 | −444 | −279 | 33 | −667 | −2629 | −1949 | 113 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 62(R) | 716 | −1736 | −2244 | −1683 | 752 | −2703 | −1193 | −1344 | −1412 | −1580 | −929 | −63 | −2766 | −1328 | 3068 | −1710 | −1403 | −1220 | 1669 | 685 | 114 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |

TABLE 3-continued

| | | | | | | | | | | | | | | | | | | | | | |
|---|---|---|---|---|---|---|---|---|---|---|---|---|---|---|---|---|---|---|---|---|---|
| 63(P) | −625 | −2530 | 60 | −1072 | −2925 | −2398 | −1624 | −2563 | −1584 | 1086 | −2026 | 184 | 3237 | −1340 | −2075 | −1705 | −1751 | −2272 | −3163 | −2593 | 115 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −90 | −8312 | −4120 | −894 | −1115 | −701 | −1378 | * | * | | | | | | | | | | | | |
| 64(W) | −4762 | −4593 | 2301 | −3636 | −3451 | −4258 | −3708 | −5821 | −4679 | −5395 | −5229 | −3844 | −4736 | −4222 | −4864 | −4710 | −4913 | −5577 | 5797 | −3009 | 116 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −130 | −8229 | −3598 | −894 | −1115 | −1121 | −889 | * | * | | | | | | | | | | | | |
| 65(D) | −1309 | −2840 | 2011 | 494 | −3135 | −2037 | −873 | −2906 | −572 | −2846 | −1955 | 2010 | 1717 | 1170 | −1125 | −1150 | −1269 | −671 | −3021 | −2290 | 117 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −2311 | −8107 | −331 | −894 | −1115 | −628 | −1503 | * | * | | | | | | | | | | | | |
| 66(Y) | −635 | −882 | −1209 | −779 | 422 | −1778 | −110 | −454 | −556 | 590 | −63 | 1215 | −1869 | −452 | −785 | −844 | −583 | −360 | −175 | 2802 | 118 |
| — | −149 | −500 | 234 | 43 | −381 | 399 | 106 | −626 | 210 | −466 | −721 | 275 | 394 | 46 | 96 | 359 | 117 | −369 | −294 | −249 | |
| — | −1029 | −988 | −7468 | −137 | −3461 | −571 | −1614 | * | * | | | | | | | | | | | | |
| 67(H) | −9 | −2243 | 374 | 1170 | −2564 | 95 | 1478 | −2314 | 1276 | −2259 | −1332 | −378 | −1836 | 1253 | 987 | −8 | −709 | −1865 | −2426 | −1743 | 120 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −9 | −7937 | −8980 | −894 | −1115 | −1952 | −431 | * | * | | | | | | | | | | | | |
| 68(Y) | −804 | −1603 | −77 | −470 | −287 | 1328 | −615 | −1330 | 378 | −176 | −755 | −707 | −70 | −291 | −797 | −226 | −744 | −1108 | −1927 | 2425 | 121 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −9 | −7937 | −8980 | −894 | −1115 | −1952 | −431 | * | * | | | | | | | | | | | | |
| 69(T) | −167 | −2183 | 188 | −187 | −2570 | 677 | −524 | −2303 | 362 | −2287 | −1382 | −483 | −141 | −80 | −634 | 985 | 2088 | −1868 | −2484 | −1822 | 122 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −9 | −7937 | −8980 | −894 | −1115 | −1952 | −431 | * | * | | | | | | | | | | | | |
| 70(D) | −1090 | −2605 | 2512 | 741 | −2908 | 391 | 837 | −2674 | −342 | −2615 | −1713 | 665 | −2065 | −234 | −883 | 9 | 769 | −2220 | −2788 | −2070 | 123 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −262 | −7937 | −2624 | −894 | −1115 | −1952 | −431 | * | * | | | | | | | | | | | | |
| 71(P) | 1251 | −2101 | −546 | 596 | −2491 | −1704 | −497 | −2212 | 497 | −2217 | −1335 | −424 | 2156 | −66 | −607 | 788 | −767 | −1795 | −2431 | −1781 | 124 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7686 | −8728 | −894 | −1115 | −1200 | −825 | * | * | | | | | | | | | | | | |
| 72(M) | −1983 | −1721 | −4201 | −671 | −1027 | −3652 | −2508 | 473 | −3258 | 1831 | 3893 | −3253 | −3511 | −2756 | −3069 | −2772 | −1908 | 239 | −2109 | −1917 | 125 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −9 | −7937 | −8980 | −894 | −1115 | −1952 | −431 | * | * | | | | | | | | | | | | |
| 73(D) | 325 | −3516 | 2804 | 2034 | −3761 | −2131 | −1242 | −3593 | −1187 | −3502 | −2691 | 664 | −2522 | 465 | −1858 | −1573 | −1824 | −3108 | −3684 | −2831 | 126 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −9 | −7937 | −8980 | −894 | −1115 | −1952 | −431 | * | * | | | | | | | | | | | | |
| 74(M) | −162 | 687 | −1246 | 48 | −1449 | −1992 | −713 | 457 | 968 | 807 | 1568 | −876 | −2071 | 590 | 824 | −952 | 177 | −864 | −1751 | −1277 | 127 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −9 | −7937 | −8980 | −894 | −1115 | −1952 | −431 | * | * | | | | | | | | | | | | |
| 75(A) | 3609 | −2502 | −4177 | −4484 | −4584 | −2730 | −3982 | −4412 | −4488 | −4693 | −4043 | −3432 | −3468 | −4163 | −4245 | −2287 | −2480 | −3528 | −4478 | −4636 | 128 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −9 | −7937 | −8980 | −894 | −1115 | −1952 | −431 | * | * | | | | | | | | | | | | |
| 76(K) | −1027 | −2025 | −1083 | 321 | −188 | −2040 | 1105 | −1850 | 2712 | 477 | −1152 | −762 | −2121 | −270 | −504 | −1005 | −952 | −1581 | −2205 | −1638 | 129 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −9 | −7937 | −8980 | −894 | −1115 | −1952 | −431 | * | * | | | | | | | | | | | | |
| 77(A) | 2085 | −2164 | −961 | −400 | −2453 | −1963 | −598 | −2122 | −76 | −2158 | 472 | 939 | −2059 | 608 | 1792 | −921 | −920 | −1780 | −2390 | −1815 | 130 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −9 | −7937 | −8980 | −894 | −1115 | −1952 | −431 | * | * | | | | | | | | | | | | |
| 78(R) | −3027 | −3580 | −3980 | −2342 | −4547 | −3455 | −1266 | −3796 | 2824 | −3394 | −2754 | −2150 | −3372 | −849 | 3133 | −2900 | −2653 | −3595 | −3184 | −3156 | 131 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −9 | −7937 | −8980 | −894 | −1115 | −1952 | −431 | * | * | | | | | | | | | | | | |
| 79(V) | 1224 | −1553 | −4145 | −3706 | −1862 | −3327 | −2889 | 214 | −3415 | −1131 | 2011 | −3214 | −3508 | −3137 | −3344 | −2552 | −1771 | 3003 | −2764 | −2407 | 132 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −9 | −7937 | −8980 | −894 | −1115 | −254 | −2629 | * | * | | | | | | | | | | | | |

TABLE 3-continued

| | | | | | | | | | | | | | | | | | | | | | |
|---|---|---|---|---|---|---|---|---|---|---|---|---|---|---|---|---|---|---|---|---|---|
| 80(D) | −493 | −3116 | 2767 | 1555 | −3391 | −2262 | −1166 | −3139 | 191 | −3116 | −2255 | −888 | −2518 | −751 | −1483 | −1454 | −1589 | 1219 | −3318 | −2582 | 133 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 81(A) | 2284 | −1391 | −2040 | 1144 | −1397 | −2450 | −1253 | −149 | −1343 | −1258 | −592 | −1560 | −2537 | −1201 | −1606 | −1469 | −1103 | 118 | −1822 | 1911 | 134 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 82(A) | 2251 | −1006 | −3057 | −2446 | 931 | −297 | 873 | 186 | −2124 | 136 | −207 | −2119 | −2664 | −1821 | −2064 | −199 | −1051 | 393 | −1458 | −1105 | 135 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 83(F) | −2224 | −2250 | −4424 | −4264 | 3927 | −1145 | −2398 | −1376 | −3976 | −1984 | −1709 | −3372 | −3765 | −3490 | −3760 | −2682 | −2389 | 1653 | −1938 | −991 | 136 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 84(E) | −2532 | −3829 | −1248 | 3330 | −4180 | −2869 | 2424 | −3974 | −839 | −3774 | −3045 | −1508 | −3153 | −1222 | 558 | −2322 | −2451 | −3596 | −3729 | −3191 | 137 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 85(F) | −1403 | −1396 | −2948 | −2272 | 3286 | −2799 | −1493 | 1022 | 1260 | −1060 | 686 | −2099 | −2836 | −1618 | 230 | −1871 | −1330 | −773 | −1748 | −1356 | 138 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 86(F) | −317 | 889 | −3643 | −3012 | 2565 | −2871 | −1711 | −515 | −2614 | 1586 | 2444 | −2508 | −2900 | −2216 | −2412 | −1959 | −1257 | −505 | −1529 | 755 | 139 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 87(E) | 1138 | −2517 | −22 | 2128 | −2834 | −1986 | 953 | −2586 | −260 | −2532 | −1609 | 47 | −2094 | 1725 | −772 | −522 | −30 | −2137 | −2701 | −2014 | 140 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 88(K) | −3061 | −4130 | −1699 | 1837 | −4807 | −3224 | −1891 | −4412 | 3434 | −4126 | −3469 | −1918 | −3509 | −1513 | −1024 | −2841 | −2941 | −4072 | −3990 | −3669 | 141 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 89(L) | −3259 | −2823 | −5615 | −5021 | −1437 | −5150 | −3961 | 745 | −4731 | 2913 | 1019 | −4827 | −4647 | −3875 | −4383 | −4368 | 365 | −1276 | −3007 | −3044 | 142 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 90(G) | −1754 | −3293 | 758 | −600 | −3610 | 2854 | 295 | −3395 | −1059 | −3333 | −2477 | 1368 | −2611 | −871 | −192 | −608 | −1738 | −2933 | −3514 | −2754 | 143 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 91(V) | 1814 | −1770 | −4355 | −3892 | −2144 | −3716 | −3087 | 1744 | −3628 | −1521 | −1158 | −748 | −3817 | −3368 | −3576 | −2912 | −2012 | 2602 | −2979 | −2593 | 144 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 92(P) | −1176 | −2665 | 795 | 1462 | −2975 | −2054 | 1351 | −2732 | 293 | −2676 | −1764 | 301 | 2104 | −333 | −927 | −1042 | −1122 | −2283 | −2848 | 1814 | 145 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 93(Y) | −3660 | −3259 | −4548 | −4414 | 1974 | 1637 | −1482 | −3075 | −3905 | −2811 | −2599 | −3440 | −4500 | −3380 | −86 | −3688 | −3603 | −3082 | −832 | 3949 | 146 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 94(F) | −1766 | −1543 | −3984 | −3431 | 2846 | −3263 | −1648 | 658 | −3029 | 322 | −605 | −2801 | −3277 | −2560 | −2795 | −2362 | −1702 | 919 | 1783 | 2653 | 147 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 95(C) | 367 | 5085 | −4219 | −4291 | −4096 | −2272 | −3593 | −3763 | −4037 | −4088 | −3236 | 350 | −3041 | −3643 | −3867 | −1621 | 1654 | −2856 | −4389 | −4220 | 148 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 96(F) | −4420 | −3702 | −5536 | −5637 | 4337 | −5230 | −2140 | −2246 | −5268 | −125 | −1647 | −4338 | −5053 | −4174 | −4736 | −4670 | −4342 | −2825 | −1358 | −250 | 149 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |

TABLE 3-continued

| | | | | | | | | | | | | | | | | | | | | | |
|---|---|---|---|---|---|---|---|---|---|---|---|---|---|---|---|---|---|---|---|---|---|
| 97(H) | −5506 | −4764 | −5029 | −5331 | −4362 | −4732 | +Z,29 | −6634 | −5266 | −6082 | −5977 | −5274 | −5186 | −5341 | −5054 | −5722 | −5705 | −6336 | −4332 | −3976 | 150 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 98(D) | −4886 | −4905 | 4186 | −3339 | −5949 | −4221 | −4195 | −6666 | −4787 | −6283 | −6022 | −3676 | −4750 | −4186 | −5191 | −4762 | −5055 | −6188 | −5117 | −5507 | 151 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 99(R) | −1078 | −2255 | 1071 | 345 | −2468 | −2070 | −762 | 246 | −400 | −2220 | −1378 | 214 | −2175 | −352 | 2115 | −1018 | −1019 | 1592 | −2508 | −1898 | 152 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 100(W) | −204 | 887 | 46 | 246 | −204 | −619 | 891 | −475 | 338 | −941 | 659 | 291 | −334 | 598 | 147 | −143 | 7 | −471 | 1260 | 199 | 153 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 101(D) | −4886 | −4905 | +Z,30 | −3339 | −5949 | −4221 | −4195 | −6666 | −4787 | −6283 | −6022 | −3676 | −4750 | −4186 | −5191 | −4762 | −5055 | −6188 | −5117 | −5507 | 154 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 102(I) | −3148 | −2630 | −5718 | −5282 | −1996 | −5478 | −4785 | 2752 | −5148 | 2210 | −760 | −5155 | −4982 | −4511 | −4983 | −4815 | −3092 | 885 | −3726 | −3666 | 155 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 103(A) | 2332 | 880 | −3499 | −2885 | 155 | −2753 | −1687 | 1413 | −2507 | −912 | −290 | −2404 | −2824 | −2151 | −2344 | 131 | −1170 | 922 | −1580 | −1235 | 156 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 104(P) | −672 | −3716 | 211 | −35 | −4479 | −2521 | −1993 | −4330 | −2167 | −4293 | −3563 | −1294 | 3795 | −1666 | −2911 | −671 | −2463 | −3744 | −4510 | −3639 | 157 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 105(E) | −1113 | −2563 | 755 | 2544 | 1516 | −2031 | −733 | −2609 | −341 | −2569 | −1661 | −668 | −2154 | 563 | 301 | −991 | −66 | −2175 | −2752 | −2069 | 158 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 106(G) | 299 | −2657 | 34 | −2104 | −4774 | 3464 | −2959 | −4642 | −3376 | −4771 | −3958 | −2126 | −3197 | −2757 | −3854 | −1993 | −2272 | −3598 | −4890 | −4406 | 159 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 107(D) | 940 | −2485 | 1893 | 127 | −2803 | −1971 | 844 | −2554 | 764 | −2500 | −1576 | 1057 | −2071 | −182 | −737 | 809 | 137 | −2106 | −2669 | −1984 | 160 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 108(T) | −1565 | −2482 | 739 | −1528 | −3930 | −2299 | −2089 | −3698 | −2004 | −3773 | −2913 | −1652 | 144 | −1753 | −2486 | 2008 | 2860 | −2980 | −3986 | −3403 | 161 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 109(L) | 183 | −1297 | 530 | −2212 | −1245 | −2705 | −1605 | 1003 | −2029 | 2269 | −425 | −2074 | −99 | −1781 | −2114 | −1784 | −1252 | −579 | −1782 | −1423 | 162 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 110(K) | 640 | −2464 | −846 | 531 | −2786 | −634 | −624 | −2534 | 1804 | −2478 | −1554 | −606 | −2062 | 1184 | 1680 | −183 | 159 | −2087 | −2644 | −1966 | 163 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 111(E) | −2632 | −4118 | −726 | 3650 | −4688 | −2682 | −2003 | −4498 | −1128 | −4407 | −3745 | −1375 | −3200 | −1672 | −2399 | −2379 | −470 | −3990 | −4537 | −3731 | 164 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 112(T) | −1378 | −1595 | −2330 | −1769 | 970 | −2639 | −1269 | −1211 | −1461 | −1477 | −820 | −1762 | −2729 | −1384 | 1813 | −551 | 2331 | −1088 | −1586 | 2248 | 165 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −383 | −8312 | −2119 | −894 | −1115 | −701 | −1378 | * | * | | | | | | | | | | | | |
| 113(N) | −791 | −1832 | 50 | 1047 | −305 | −1841 | −525 | −703 | −197 | −251 | −964 | 2489 | −1931 | −140 | −666 | −283 | −731 | −1371 | −2110 | 963 | 166 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −9 | −7937 | −8980 | −894 | −1115 | −1952 | −431 | * | * | | | | | | | | | | | | |

TABLE 3-continued

| | | | | | | | | | | | | | | | | | | | | | |
|---|---|---|---|---|---|---|---|---|---|---|---|---|---|---|---|---|---|---|---|---|---|
| 114(K) | 1001 | −2246 | −618 | 864 | −2565 | −1750 | 758 | −2313 | 2093 | −2260 | −1336 | 584 | −1845 | 635 | −493 | −69 | −7 | −1867 | −2429 | −1749 | 167 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −9 | −7937 | −8980 | −894 | −1115 | −1952 | −431 | * | * | | | | | | | | | | | | |
| 115(N) | −2127 | −2452 | −2097 | −2034 | −660 | −2951 | −1368 | −198 | −1982 | −2230 | −1833 | 3905 | −3222 | −1904 | −2179 | −2236 | −2170 | −1981 | −1308 | 936 | 168 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −9 | −7937 | −8980 | −894 | −1115 | −1952 | −431 | * | * | | | | | | | | | | | | |
| 116(L) | −3492 | −2924 | −5834 | −5257 | 789 | −5550 | −4102 | 1027 | −5024 | 2950 | 84 | −5225 | −4707 | −3869 | −4541 | −4869 | −3343 | −1272 | −2805 | −2830 | 169 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −9 | −7937 | −8980 | −894 | −1115 | −254 | −2629 | * | * | | | | | | | | | | | | |
| 117(D) | 352 | −2696 | 2970 | 584 | −3009 | −2082 | −807 | −2762 | 980 | −2704 | −1796 | −713 | −2225 | −360 | 0 | −1079 | −1159 | −2316 | −2873 | −1202 | 170 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 118(Q) | −379 | −2417 | −845 | 1254 | −2722 | −784 | 874 | −200 | 1175 | −2426 | 150 | −604 | −2055 | 1667 | 717 | −495 | −154 | 224 | −2610 | −1937 | 171 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 119(M) | −1906 | −1631 | −4282 | −3715 | −1632 | −3659 | 1153 | 2809 | −3369 | −1030 | 2854 | −3290 | −3631 | −3031 | −3229 | −2790 | −1858 | 1751 | −2428 | −2079 | 172 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 120(V) | −1675 | −1428 | −4046 | −3465 | −1535 | −3381 | −2355 | 1345 | −3118 | −355 | 657 | −3016 | −3390 | −2785 | −2974 | −980 | 862 | 2932 | −2198 | −1841 | 173 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 121(D) | 893 | −2550 | 2186 | 1147 | −2867 | 374 | −691 | −2620 | 533 | −2564 | −1644 | −634 | −2116 | −235 | 310 | −332 | −1012 | −2171 | −2733 | −2044 | 174 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 122(M) | −1064 | −1348 | −380 | −1330 | −160 | −875 | 767 | 37 | 931 | 35 | 2022 | −1413 | −2427 | −1031 | 1430 | −1349 | −1004 | 428 | −1753 | 1366 | 175 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 123(I) | 624 | −2059 | −4727 | −4136 | 2069 | −4088 | −2966 | 2565 | −3797 | 1421 | −374 | −3739 | −3937 | −3261 | −3569 | −3229 | −2291 | −675 | −2502 | −2265 | 176 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 124(K) | 164 | −2420 | −870 | 864 | −2723 | −1981 | −637 | −2456 | 2548 | −1107 | −1515 | 258 | −2073 | −184 | 396 | −892 | −135 | −384 | −2612 | −1946 | 177 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 125(Q) | −1086 | −2570 | 755 | 2102 | −2887 | −239 | −702 | −2641 | 579 | −2583 | −1663 | −642 | −2127 | 2335 | −145 | −259 | −1028 | −2191 | −2750 | −2060 | 178 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 126(K) | 1143 | −2138 | −1047 | −491 | −2334 | −1268 | −731 | −1997 | 1991 | −845 | 321 | 94 | −2151 | −329 | 582 | −988 | −966 | −1692 | −2398 | 1901 | 179 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 127(M) | −3159 | −2791 | −5237 | −4626 | −1375 | −4924 | −3658 | 241 | −4242 | 1751 | 3379 | −4479 | −4487 | 2834 | −4010 | −4102 | −3045 | −1481 | −2879 | −2882 | 180 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 128(K) | 531 | −2467 | 1672 | 432 | −2787 | −1962 | 842 | −2538 | 1945 | −2482 | −1556 | −597 | −2058 | 764 | −60 | 337 | −933 | −2089 | −2649 | −1966 | 181 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 129(E) | 608 | −2501 | 1336 | 1866 | −2820 | −1977 | −651 | −2572 | 350 | −2516 | −1592 | 79 | −2081 | 847 | −752 | −263 | 1096 | −2122 | −2684 | −1998 | 182 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 130(T) | −1443 | −2096 | −3124 | −3287 | −4401 | −2292 | −3317 | −4200 | −3525 | −4417 | −3519 | −111 | −3045 | −3199 | −3603 | 2044 | 3281 | −3122 | −4592 | −4334 | 183 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |

TABLE 3-continued

| | | | | | | | | | | | | | | | | | | | | | |
|---|---|---|---|---|---|---|---|---|---|---|---|---|---|---|---|---|---|---|---|---|---|
| 131(G) | −2342 | −3617 | −1078 | −1138 | −4177 | 3145 | 602 | −3928 | 852 | −3793 | −3046 | 937 | −3065 | −1284 | −1318 | −2168 | −2338 | −3491 | −3842 | −3252 | 184 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 132(M) | −1412 | −1211 | −3721 | −3109 | −1195 | −3019 | −1922 | 1936 | 153 | 636 | 2441 | −2644 | −3047 | −2378 | −2570 | −2115 | 254 | 1830 | −1783 | −1441 | 185 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 133(K) | −2382 | −3084 | −2779 | −1906 | −3480 | −3186 | −1412 | −563 | 3569 | −2849 | −2226 | −1941 | −3205 | 185 | −333 | −2373 | −2209 | −664 | −3109 | −2822 | 186 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 134(L) | −2611 | −2332 | −4972 | −4508 | −1725 | −4314 | −3571 | −413 | −4186 | 2461 | −619 | −4123 | −180 | −3692 | −3999 | −3552 | −2603 | 2258 | −3031 | −2851 | 187 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 135(L) | −3561 | −3470 | −4972 | −5000 | −2527 | −4319 | −4274 | −2132 | −4722 | 2904 | −1522 | −4638 | 2196 | −4380 | −4502 | −4088 | −3732 | −2706 | −3760 | −3674 | 188 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 136(W) | −4178 | −3738 | −5370 | −5358 | −1338 | −4715 | −2806 | −2734 | −4647 | −2000 | 3289 | −4520 | −4875 | −4300 | −4355 | −4520 | −4225 | −3205 | 5740 | −1122 | 189 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 137(N) | 142 | −1989 | −2878 | −2702 | −3612 | 1917 | −2689 | −3274 | −2730 | −3523 | −2701 | 2927 | −2900 | −2506 | −2962 | −414 | −1684 | 1320 | −3855 | −3498 | 190 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 138(T) | −3014 | −3363 | −4795 | −5109 | −5200 | −3551 | −4612 | −5219 | −5081 | −5386 | −4862 | −4270 | −4241 | −4876 | −4829 | −3277 | 4049 | −4432 | −4902 | −5198 | 191 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 139(A) | 2832 | −1972 | −4244 | −4339 | −4463 | −760 | −3712 | −4243 | −4136 | −4497 | −3564 | −2941 | −3041 | −3711 | −3978 | 1060 | 1917 | −3080 | −4688 | −4571 | 192 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 140(N) | −2239 | −3351 | −994 | −1271 | −4465 | −2566 | −2158 | −4418 | −2073 | −4368 | −3639 | 3979 | −3136 | 445 | −2533 | 245 | −2444 | −3731 | −4441 | −3700 | 193 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 141(M) | −1488 | 1901 | −3790 | −3168 | −1094 | −3058 | −1949 | −467 | −2783 | 2250 | 2832 | −414 | −3076 | −2387 | −2597 | −2155 | −1430 | 533 | −1764 | −1453 | 194 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 142(F) | −5308 | −4420 | −5610 | −5948 | 4547 | −4921 | −3048 | −4656 | −5852 | −3992 | −4112 | −4995 | −5217 | −5110 | −5315 | −5363 | −5399 | −4866 | −2341 | −1279 | 195 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 143(T) | −1333 | −1921 | −3518 | −3324 | −3642 | 123 | −3003 | −3307 | −3160 | −3578 | 1028 | −2602 | −2954 | −2918 | −3250 | 1815 | 3158 | −2607 | −3929 | −3640 | 196 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 144(H) | −2587 | −4410 | 687 | −793 | −4549 | −2586 | 4208 | −4506 | −1989 | −4378 | −3682 | 2832 | −3090 | 194 | −2726 | −2268 | −2637 | −4002 | −4523 | −3562 | 197 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 145(P) | −777 | −3430 | −1097 | −93 | −4208 | −2659 | −1777 | −3899 | 593 | −3828 | −3084 | −1470 | 3745 | −1415 | −1541 | −2135 | −2319 | −3430 | −3945 | −3364 | 198 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 146(R) | −550 | −1933 | −2864 | −2364 | −2830 | −927 | −2070 | −2310 | −1691 | −2646 | −1918 | −2140 | −2867 | −1879 | 3417 | −1633 | −92 | 1325 | −3074 | −2717 | 199 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 147(F) | −4998 | −3935 | −5388 | −5739 | 3810 | −5262 | −1482 | −3879 | −5300 | −3188 | −3284 | −3899 | −5127 | −4036 | −4670 | −4527 | −4855 | −4043 | −729 | 3525 | 200 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |

TABLE 3-continued

| | | | | | | | | | | | | | | | | | | | | | |
|---|---|---|---|---|---|---|---|---|---|---|---|---|---|---|---|---|---|---|---|---|---|
| 148(M) | −1239 | −1212 | −2845 | −2242 | −1184 | −92 | −1512 | −579 | 1562 | 39 | 2941 | −2060 | −2743 | −1703 | −1901 | −1745 | −1181 | 1944 | −1681 | −1320 | 201 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 149(H) | 593 | −3227 | 1964 | 442 | −3513 | −2264 | 3263 | −3299 | −948 | −3231 | −2358 | 1914 | −2532 | −764 | −1529 | −462 | −1628 | −2836 | −3408 | −2646 | 202 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 150(G) | −4740 | −4445 | −5364 | −5738 | −6131 | 3840 | −5265 | −6903 | −6030 | −6539 | −6235 | −5426 | −5034 | −5814 | −5624 | −5041 | −5115 | −6153 | −5123 | −6096 | 203 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 151(W) | −204 | 887 | 46 | 246 | −204 | −619 | 891 | −475 | 338 | −941 | 659 | 291 | −334 | 598 | 147 | −143 | 7 | −471 | 1260 | 199 | 204 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 152(A) | 3079 | −1981 | −4321 | −4534 | −4388 | 1735 | −3806 | −3957 | −4337 | −4384 | −3516 | −3010 | −3078 | −3869 | −4090 | −1647 | −1847 | −409 | −4664 | −4550 | 205 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 153(A) | 2589 | −1888 | −3886 | −3806 | 2401 | −778 | −3205 | −3235 | −3632 | −3529 | −2743 | −2783 | −3003 | −3276 | −3573 | 1465 | −1739 | −2566 | −3839 | −3512 | 206 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 154(T) | −1493 | −2101 | −3952 | −4245 | −4536 | −2355 | −3794 | −4349 | −4195 | −4644 | −3761 | −2999 | −3149 | −3828 | −4010 | −557 | 3902 | −3205 | −4753 | −4602 | 207 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 155(S) | 540 | −2055 | −3002 | −2865 | −4153 | −2245 | −2899 | −3915 | −2898 | −4091 | −3185 | 1991 | −2931 | −2672 | −3128 | 2781 | 1118 | −2953 | −4296 | −3964 | 208 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 156(C) | −1362 | 3283 | −2411 | −2080 | −3450 | −2276 | −2150 | −3137 | −1861 | −3298 | −2470 | 2369 | 2823 | −1857 | −547 | −338 | −1614 | −2541 | −3575 | −3147 | 209 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 157(D) | −1060 | −2512 | 2344 | 682 | 408 | −2001 | −688 | −2563 | −290 | −2522 | −1608 | 1941 | −2113 | −236 | 126 | 73 | −1002 | −2126 | −2701 | −334 | 210 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 158(A) | 2203 | −1406 | −2316 | −1761 | 1179 | −2422 | −1413 | −1077 | −1508 | −1393 | −717 | −1726 | 1050 | −1393 | 1435 | −1489 | −1163 | 75 | −1934 | −1529 | 211 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 159(D) | −1108 | −2589 | 2572 | 1474 | −2902 | −2021 | −725 | −2655 | 395 | −2602 | −1685 | 326 | −2145 | −272 | −851 | 251 | −169 | −2207 | 1553 | −2081 | 212 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 160(V) | −2769 | −2275 | −5444 | −5141 | −2907 | −5216 | −5273 | 1475 | −5092 | −1669 | −1617 | −4931 | −5004 | −5033 | −5244 | −4603 | −2770 | 3537 | −4643 | −4129 | 213 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 161(F) | −3052 | −2695 | −4546 | −4247 | 3203 | −4202 | −1494 | −2262 | −3699 | −2242 | −1900 | −3317 | −4178 | −3190 | 2010 | −3345 | −2975 | 767 | −879 | 2654 | 214 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 162(A) | 3042 | −2119 | −3426 | −3206 | −4202 | −2348 | −2904 | −3925 | −2474 | −4083 | −3222 | −2583 | −3032 | −2685 | 1719 | 534 | −1849 | −3011 | −4246 | −4000 | 215 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 163(Y) | −3964 | −3336 | −5040 | −5039 | 1445 | −4787 | −1468 | −3083 | −4580 | −2777 | 836 | −3655 | −4704 | −3678 | 1014 | −3973 | −3862 | −3132 | 2650 | 4219 | 216 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 164(A) | 3397 | −1996 | −4237 | −4525 | −4627 | −310 | −3879 | −4438 | −4443 | −4696 | −3743 | −3000 | −3071 | −3927 | −4178 | 218 | −1854 | −3173 | −4847 | −4779 | 217 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |

TABLE 3-continued

| | | | | | | | | | | | | | | | | | | | | | |
|---|---|---|---|---|---|---|---|---|---|---|---|---|---|---|---|---|---|---|---|---|---|
| 165(A) | 2613 | −1126 | −3505 | −2891 | −69 | −991 | −1733 | 690 | −2525 | 734 | −274 | −2447 | −2880 | −2171 | −2378 | −1919 | −1233 | −16 | −1624 | −1284 | 218 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 166(A) | 2400 | −1805 | −2420 | −1934 | −2555 | 164 | −1841 | −2139 | −1713 | −2410 | −1660 | −1850 | −2680 | −1637 | 1676 | −1432 | 551 | 718 | −2846 | −2430 | 219 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 167(Q) | −3216 | −3916 | −3036 | −2340 | −4750 | −3581 | −1704 | −4191 | 2500 | −3828 | −3184 | −2315 | −3640 | 3726 | −379 | −3075 | −2950 | −3942 | −3629 | −3505 | 220 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 168(V) | −1889 | −1609 | −4294 | −3746 | −1809 | −3673 | −2738 | 1337 | −3430 | 223 | −879 | −3321 | −3670 | −3122 | −3314 | −452 | 114 | 3027 | −2565 | −2197 | 221 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 169(K) | −1988 | −1815 | −3867 | −3265 | −61 | −3579 | −2411 | 608 | 3002 | 1068 | −398 | −3036 | −3519 | −2605 | −2843 | −2673 | −1920 | 280 | −2274 | −1989 | 222 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 170(H) | −256 | −2524 | −929 | 393 | −2858 | −2038 | 2453 | −2595 | 2209 | −2532 | −1615 | 617 | −2127 | −214 | 1169 | −956 | 416 | −2154 | −2687 | −2028 | 223 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 171(A) | 1760 | −2287 | −1318 | −859 | −3091 | 1259 | −1172 | −2823 | −819 | −2844 | −1946 | 1423 | −2360 | 334 | −1298 | 1120 | 170 | −2306 | −3051 | −2433 | 224 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 172(M) | −3851 | −3263 | −6245 | −5660 | −1466 | −5999 | −4689 | 2110 | −5449 | 2475 | 2821 | −5714 | −5087 | −4261 | −4955 | −5348 | −3701 | −1503 | −3271 | −3471 | 225 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 173(D) | −2907 | −4984 | 3077 | 2640 | −5091 | −2646 | −2094 | −5089 | −2514 | −4917 | −4353 | 575 | −3236 | −1786 | −3527 | −2508 | −3007 | −4525 | −5119 | −3978 | 226 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 174(I) | 1132 | −1695 | −4439 | −3899 | −1866 | −3834 | −2908 | 2259 | −3592 | 1435 | −900 | −3481 | −3802 | −3276 | −3473 | −2983 | −597 | 1521 | −2695 | −2335 | 227 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 175(T) | 2228 | −1974 | −4202 | −4278 | −4460 | 1638 | −3685 | −4242 | −4085 | −4491 | −3558 | −2925 | −3038 | −3671 | −3948 | 523 | 2255 | −3080 | −4681 | −4557 | 228 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 176(K) | 692 | −1650 | −1775 | −1196 | −1722 | −2391 | 1742 | 714 | 2556 | −1538 | −836 | −1336 | −2470 | −892 | −1164 | −1384 | −1131 | 634 | −2040 | −1598 | 229 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 177(E) | −1319 | −2706 | −1195 | 2572 | −3079 | −2247 | −809 | −2780 | 1335 | −2691 | −1802 | −886 | −2327 | 234 | 1489 | −1200 | −369 | −2360 | −2812 | 310 | 230 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 178(L) | −3875 | −3291 | −6254 | −5672 | −1457 | −5994 | −4687 | −834 | −5446 | 3095 | 1236 | −5724 | −5089 | −4257 | −4949 | −5349 | −3726 | 117 | −3263 | −3460 | 231 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 179(G) | −2536 | −3114 | −2855 | −3225 | −5099 | 3685 | −3752 | −5315 | −4127 | −5358 | −4624 | 59 | −3784 | −3697 | −4300 | −2703 | −2949 | −4249 | −4910 | −4848 | 232 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 180(A) | 2480 | −2007 | −3784 | −3834 | −4416 | 2311 | −3496 | −4197 | −3742 | −4425 | −3503 | −2804 | −3029 | −3419 | −1816 | 1068 | −1817 | −3076 | −4613 | −4438 | 233 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 181(E) | −2358 | −3954 | −688 | 3489 | −4290 | −2588 | −1658 | −4076 | −137 | −3947 | −3188 | −1202 | −2990 | −287 | −1831 | −242 | −2356 | −3617 | −4074 | −3314 | 234 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |

TABLE 3-continued

| | | | | | | | | | | | | | | | | | | | | | |
|---|---|---|---|---|---|---|---|---|---|---|---|---|---|---|---|---|---|---|---|---|---|
| 182(N) | −1197 | −1819 | −2024 | −1565 | −2415 | −764 | −1594 | −14 | −1466 | −2263 | −1508 | 3406 | −2581 | −1353 | −1820 | −247 | 1313 | −893 | −2696 | −2243 | 235 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 183(Y) | −4914 | −3888 | −5384 | −5705 | 1863 | −5254 | −1485 | −3696 | −5262 | −1015 | −3107 | −3892 | −5106 | −4013 | −4642 | −4501 | −4770 | −3900 | −732 | 4560 | 236 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 184(V) | −3382 | −3135 | −5319 | −5407 | −3802 | −4379 | −4923 | −1179 | −5325 | −2915 | −2860 | −4909 | −4787 | −5200 | −5168 | −4266 | −3561 | 3821 | −4638 | −4461 | 237 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 185(F) | −245 | −1976 | −4569 | −3955 | 3611 | −3896 | −2734 | −630 | −3595 | 1079 | 1156 | −3542 | −3766 | −3052 | −3355 | −3019 | −2168 | 266 | −2302 | −2075 | 238 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 186(W) | −6178 | −4896 | −5848 | −6204 | −4109 | −4952 | −4743 | −6650 | −6203 | −5992 | −6031 | −5971 | −5371 | −6028 | −5699 | −6531 | −6329 | −6559 | 6291 | −3733 | 239 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 187(G) | −3000 | −3383 | −4355 | −4713 | −5554 | 3708 | −4577 | −5789 | −5128 | −5785 | −5102 | −4100 | 282 | −4765 | −4941 | −3242 | −3441 | −4699 | −5042 | −5532 | 240 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 188(G) | −4740 | −4445 | −5364 | −5738 | −6131 | 3840 | −5265 | −6903 | −6030 | −6539 | −6235 | −5426 | −5034 | −5814 | −5624 | −5041 | −5115 | −6153 | −5123 | −6096 | 241 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 189(R) | −5156 | −4675 | −5377 | −4998 | −5777 | −4641 | −4103 | −6271 | −3143 | −5805 | −5439 | −4840 | −4993 | −4014 | 4230 | −5318 | −5151 | −5964 | −4773 | −5292 | 242 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 190(E) | −4894 | −4877 | −3044 | 3932 | −5916 | −4252 | −4190 | −6541 | −4583 | −6183 | −5913 | −3747 | −4767 | −4175 | −4884 | −4792 | −5049 | −6107 | −5083 | −5486 | 243 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 191(G) | −4740 | −4445 | −5364 | −5738 | −6131 | 3840 | −5265 | −6903 | −6030 | −6539 | −6235 | −5426 | −5034 | −5814 | −5624 | −5041 | −5115 | −6153 | −5123 | −6096 | 244 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 192(Y) | 1128 | −2151 | −3615 | −3697 | −2169 | −2532 | −2750 | −3414 | −3639 | −3566 | −2927 | −2840 | −3221 | −3299 | −3585 | 346 | −2022 | −2806 | −2762 | 4321 | 245 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 193(E) | −380 | −3053 | 283 | 3153 | −3334 | −2232 | −1107 | −3096 | −834 | −3054 | 1184 | −859 | −2470 | 595 | −1389 | −1391 | −1518 | −2659 | −3248 | −2518 | 246 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 194(T) | −1103 | 1142 | −2635 | −2048 | 226 | −2529 | −1370 | −640 | −1798 | −977 | −315 | 492 | −2600 | −1565 | −1879 | 1469 | 2053 | 325 | −1553 | 1510 | 247 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 195(L) | −2451 | −3826 | 1344 | 380 | −3974 | −118 | −1886 | −3714 | −2079 | 2668 | −3117 | −1233 | −3073 | −1582 | −2813 | −2228 | −2503 | −3386 | −4143 | −3340 | 248 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 196(W) | 386 | −1134 | −2676 | −2101 | −1119 | −347 | 779 | −682 | −1838 | 2157 | −357 | −1927 | −2623 | −1612 | −1910 | 39 | −1078 | −582 | 2407 | −1210 | 249 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 197(N) | 1013 | −2090 | −2983 | −3038 | −4320 | −2272 | −3125 | −4091 | −3254 | −4290 | −3387 | 3818 | −2998 | −2951 | −3423 | −234 | 228 | −3062 | −4487 | −4194 | 250 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 198(T) | −1798 | −2527 | −2472 | −2321 | −4196 | −165 | −2323 | −3864 | 1571 | −3911 | −3113 | −2201 | −3114 | −2006 | −1736 | −1923 | 3444 | −3160 | −4006 | −3686 | 251 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |

TABLE 3-continued

| | | | | | | | | | | | | | | | | | | | | | |
|---|---|---|---|---|---|---|---|---|---|---|---|---|---|---|---|---|---|---|---|---|---|
| 199(D) | −2628 | −4493 | 3630 | −795 | −4689 | −2595 | −1891 | −4588 | 78 | −4447 | −3759 | 761 | −3106 | 1043 | −2749 | −2297 | −2679 | −4074 | −4622 | −3654 | 252 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 200(M) | −97 | −1073 | −3318 | −2701 | −998 | −2739 | −1606 | −472 | −2346 | 1093 | 3659 | −2307 | −2785 | 467 | −2231 | −1817 | −59 | 1113 | −1534 | −1193 | 253 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 201(K) | −294 | −2512 | −898 | 178 | −2843 | −95 | −659 | −2584 | 2469 | −2522 | −1603 | 266 | −2109 | 522 | 1551 | −254 | −990 | −2140 | −2680 | −2014 | 254 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 202(W) | −204 | 887 | 46 | 246 | −204 | −619 | 891 | −475 | 338 | −941 | 659 | 291 | −334 | 598 | 147 | −143 | 7 | −471 | 1260 | 199 | 255 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 203(R) | 515 | −2100 | −67 | −484 | 1101 | −2050 | −726 | −1947 | 420 | 512 | −1227 | −760 | −2139 | 1266 | 1890 | −975 | −948 | −993 | −2369 | −1782 | 256 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 204(E) | 1191 | −2588 | −1433 | 3261 | −3616 | −2449 | −2074 | −2773 | −1979 | −3329 | −2647 | −1665 | −2946 | −1764 | −2429 | −1806 | −1937 | −133 | −3820 | −3246 | 257 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 205(L) | −1513 | −1884 | −2260 | −1562 | −1940 | −2676 | −1221 | −1499 | 519 | 2067 | 848 | −1624 | −2718 | 1781 | 725 | −1719 | −1418 | −1369 | 1760 | −1802 | 258 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 206(D) | −745 | −4362 | 3177 | 2316 | −4570 | −2552 | −1843 | −4464 | −1204 | −4345 | −3627 | −1146 | −3050 | −1496 | −2798 | −856 | −2573 | −3948 | −4537 | −3568 | 259 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 207(H) | −1159 | −2582 | −194 | −438 | −2895 | −2097 | 3162 | −2638 | −245 | −2581 | −1678 | 2194 | −2196 | 1039 | 1482 | −1040 | −1092 | −2210 | 1571 | −2082 | 260 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 208(M) | −667 | −1277 | −3818 | −3186 | 164 | −3048 | −1914 | 1188 | −2791 | 1720 | 3132 | −2694 | −3054 | −2373 | −2581 | −2141 | −1411 | 370 | −1706 | 1039 | 261 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 209(A) | 2605 | −2502 | −1660 | −1121 | −3271 | 74 | −1239 | −2944 | 508 | −2930 | −2076 | −1300 | −2572 | −823 | 1599 | −500 | −1463 | −2485 | −3089 | −2569 | 262 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 210(R) | −254 | −2474 | −853 | 1591 | −2798 | −1977 | −630 | −2545 | 1166 | −2488 | −1564 | 387 | −2070 | 471 | 2128 | −309 | 332 | −2098 | −2652 | −1975 | 263 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 211(F) | 948 | −1050 | −3245 | −2644 | 3385 | −798 | −1571 | 28 | −2300 | −901 | 1472 | −2239 | −893 | −1973 | −2197 | −1725 | −1113 | −475 | −1528 | −1174 | 264 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 212(F) | −2629 | −2312 | −4914 | −4321 | 2717 | −4278 | −2852 | −858 | −3964 | 1977 | 2554 | −3882 | −4056 | −3300 | −3668 | −3416 | −2538 | −122 | −2251 | 1119 | 265 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 213(H) | −1020 | −2488 | 1097 | −309 | −2812 | −1983 | 2931 | −2560 | 749 | −2502 | −1579 | 918 | −2079 | 1776 | 469 | −899 | 752 | −2112 | −2667 | −1988 | 266 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 214(M) | −359 | −1579 | −4116 | −3488 | 569 | −3396 | −2253 | 143 | −3109 | 1631 | 3928 | −3036 | −3351 | −2647 | −2893 | −2497 | −246 | −756 | −1968 | −1708 | 267 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 215(A) | 2548 | 947 | −3783 | −3180 | −1231 | −3043 | −2001 | −310 | −2809 | 672 | 1303 | −2705 | −3092 | −2442 | −2643 | −2151 | −1419 | 1111 | −1853 | −1521 | 268 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |

TABLE 3-continued

| | | | | | | | | | | | | | | | | | | | | | |
|---|---|---|---|---|---|---|---|---|---|---|---|---|---|---|---|---|---|---|---|---|---|
| 216(V) | 787 | 844 | −1857 | −1289 | −1397 | −389 | 570 | 555 | 958 | −1259 | −562 | −1384 | −2419 | −995 | 817 | −1338 | −1009 | 1831 | −1782 | −1359 | 269 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 217(D) | −208 | −3213 | 2902 | 1429 | −3501 | −609 | −1166 | −3288 | −924 | −3217 | −2340 | 436 | −2518 | 976 | −1504 | −420 | −1608 | −2823 | −3391 | −2630 | 270 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 218(Y) | −4881 | −3957 | −5031 | −5318 | −128 | −5096 | 2506 | −3985 | −4860 | −3314 | −3388 | −3861 | −5053 | −3965 | −4419 | −4476 | −4777 | −4116 | −844 | 4614 | 271 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 219(A) | 2495 | −1569 | −1878 | −1335 | −1756 | −621 | −1246 | −153 | 939 | −1605 | −891 | −1427 | −2466 | −1072 | −1499 | −411 | −1115 | 571 | −2102 | −1665 | 272 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 220(K) | −986 | −2457 | −27 | 762 | −2778 | −1959 | 1449 | −834 | 2054 | −2472 | −1546 | 980 | −2052 | 603 | 1183 | −866 | 205 | −2079 | −2639 | −1958 | 273 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 221(E) | −254 | −2564 | 1369 | 2076 | −2882 | −2009 | −700 | −2635 | 1371 | −2578 | −1658 | −642 | −2125 | −245 | −31 | 858 | −1025 | −2185 | −2745 | −2056 | 274 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 222(I) | −2688 | −3306 | −3275 | −2169 | −3815 | −3397 | −1438 | 3178 | 1262 | −3125 | −2452 | −2120 | −3365 | 1862 | 561 | −2654 | −2443 | −3013 | −3178 | −2982 | 275 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 223(G) | −2637 | −3974 | 390 | −1153 | −5020 | 3488 | −2357 | −5035 | −2776 | −4946 | −4322 | 291 | −3293 | −2075 | −3657 | −2438 | −2858 | −4295 | −5047 | −4127 | 276 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 224(Y) | −4400 | −3612 | −5188 | −5335 | 3494 | −5009 | 1099 | −3457 | −4913 | −1074 | −2941 | −3762 | −4903 | −3843 | −4408 | −919 | −4284 | −3538 | −732 | 3504 | 277 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 225(D) | −991 | −2464 | 1721 | 213 | −2784 | 477 | 823 | −2534 | 919 | −1132 | −1553 | 893 | −2056 | 1223 | −713 | −871 | 944 | −2085 | −2647 | −1964 | 278 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 226(G) | 624 | −1134 | −2638 | −2059 | −1134 | 2287 | −1399 | −199 | −1811 | 555 | −355 | −1900 | 408 | −1582 | −1898 | −1575 | −499 | −578 | −1599 | 672 | 279 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 227(Q) | −1134 | −2497 | −1028 | −462 | −2811 | −2101 | −720 | −622 | 101 | −2489 | −1598 | 278 | −1086 | 2837 | 1581 | −1029 | 1381 | −2117 | −2667 | −2040 | 280 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 228(F) | −3742 | −3197 | −6068 | −5484 | 3900 | −5732 | −4235 | 207 | −5233 | 1117 | 1544 | −5389 | −4953 | −4113 | −4759 | −5019 | −3594 | −1653 | −3024 | −2977 | 281 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 229(L) | 1551 | −2659 | −4811 | −4712 | −2094 | −3608 | −3887 | −1436 | −4392 | 2837 | −1006 | −3969 | −4022 | −3904 | −4164 | −3002 | −2754 | −1827 | −3457 | −3347 | 282 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 230(I) | −3359 | −2829 | −5847 | −5421 | −1855 | −5595 | −4779 | 3551 | −5239 | 1256 | −646 | −5322 | −5043 | −4488 | −4999 | −4988 | −3295 | −533 | −3603 | −3558 | 283 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 231(E) | −4894 | −4877 | −3044 | +Z,31 | −5916 | −4252 | −4190 | −6541 | −4583 | −6183 | −5913 | −3747 | −4767 | −4175 | −4884 | −4792 | −5049 | −6107 | −5083 | −5486 | 284 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 232(P) | −5161 | −4627 | −5479 | −5844 | −6102 | −4639 | −5314 | −6971 | −6053 | −6538 | −6341 | −5638 | 4316 | −5917 | −5641 | −5486 | −5496 | −6390 | −5102 | −6043 | 285 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |

TABLE 3-continued

| | | | | | | | | | | | | | | | | | | | | | |
|---|---|---|---|---|---|---|---|---|---|---|---|---|---|---|---|---|---|---|---|---|---|
| 233(K) | −4797 | −4587 | −4692 | −4321 | −5682 | −4474 | −3615 | −5879 | +Z,32 | −5471 | −5024 | −4244 | −4783 | −3408 | −2493 | −4857 | −4726 | −5584 | −4639 | −5025 | 286 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 234(P) | −513 | −2636 | −4047 | −4375 | −4929 | −2842 | −4112 | −4853 | −4533 | −5052 | −4279 | −3436 | 4155 | −4192 | −4369 | −2335 | −2548 | −3772 | −4881 | −4955 | 287 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 235(K) | −1854 | −3064 | −1724 | −1121 | −3517 | −2674 | −1100 | −3136 | 2701 | −3003 | 1908 | 2081 | −2743 | 1586 | −404 | −1736 | −1732 | −2775 | −3062 | −2601 | 288 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 236(E) | −4894 | −4877 | −3044 | 3932 | −5916 | −4252 | −4190 | −6541 | −4583 | −6183 | −5913 | −3747 | −4767 | −4175 | −4884 | −4792 | −5049 | −6107 | −5083 | −5486 | 289 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 237(P) | −5161 | −4627 | −5479 | −5844 | −6102 | −4639 | −5314 | −6971 | −6053 | −6538 | −6341 | −5638 | 4316 | −5917 | −5641 | −5486 | −5496 | −6390 | −5102 | −6043 | 290 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 238(T) | −1947 | −2421 | −3165 | −2413 | −2978 | −2880 | −1827 | −2467 | −892 | −2555 | 1753 | −2247 | −3160 | −1548 | 2098 | −2129 | 3164 | −2270 | −3058 | −2755 | 291 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 239(K) | −484 | −2389 | −1045 | −493 | −2703 | 1249 | −755 | −2401 | 2460 | −2412 | 376 | −776 | −2191 | 560 | −730 | −1027 | 996 | −2019 | −2628 | −2010 | 292 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 240(H) | −3186 | −4015 | 2118 | −1712 | 238 | −3267 | 4734 | −4101 | −2845 | −3764 | −3475 | −1967 | −3709 | −2311 | −3399 | −2927 | −3243 | −3909 | −2018 | −872 | 293 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 241(Q) | −2896 | −3052 | −3270 | −3166 | −2696 | −3713 | −2865 | 2002 | −2306 | −2048 | −2010 | −3126 | −4018 | 3975 | −2353 | −3246 | −2972 | −1751 | −3437 | −2918 | 294 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 242(Y) | −4742 | −3801 | −5383 | −5639 | 926 | −5232 | −1545 | −3295 | −5204 | 588 | −2693 | −3920 | −5066 | −3993 | −4610 | −4477 | −4604 | −3605 | −791 | 4507 | 295 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 243(D) | −3103 | −3191 | 3532 | −2696 | 707 | −3852 | −2334 | −1817 | −3417 | 1062 | −1316 | −2809 | −4046 | −2871 | −3673 | −3321 | −3098 | −2210 | −2109 | −1168 | 296 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 244(F) | −78 | −1005 | −3333 | −2714 | 2786 | −2679 | −1509 | −502 | −2343 | −852 | −208 | −2267 | 1364 | −1992 | −2198 | −1758 | 336 | 525 | 1608 | 1606 | 297 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 245(D) | −2674 | −3777 | 3647 | −1466 | −4960 | −2802 | −2593 | −4914 | −2986 | −4935 | −4319 | −1779 | −3430 | −2333 | −3759 | −2551 | 1960 | −4212 | −4943 | −4224 | 298 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 246(V) | 1871 | −1480 | −3615 | −3153 | −1890 | −2627 | −2297 | −306 | −2859 | −1673 | −1071 | −2602 | −2996 | −2560 | −2812 | 319 | 356 | 2553 | −2416 | −2073 | 299 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 247(A) | 2611 | −2786 | −991 | 446 | −3556 | 1526 | −1508 | −3306 | −1293 | −3323 | −2474 | −1193 | −2662 | 380 | −1815 | −724 | −1690 | −2792 | −3540 | −2870 | 300 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 248(T) | −1575 | −2397 | −1716 | −1668 | −3555 | −2353 | 2795 | −3355 | −1840 | −3474 | −2665 | −42 | −2866 | −1754 | −2195 | −42 | 3311 | −2773 | −3678 | −3134 | 301 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 249(A) | 1906 | −1213 | −2611 | −2044 | −1274 | −749 | −1459 | −806 | −1803 | −1153 | 1226 | −1896 | −2621 | −1594 | −618 | −1555 | 1741 | 1404 | −1729 | −1356 | 302 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |

TABLE 3-continued

| | | | | | | | | | | | | | | | | | | | | | |
|---|---|---|---|---|---|---|---|---|---|---|---|---|---|---|---|---|---|---|---|---|---|
| 250(I) | −1289 | −1106 | −3622 | −2990 | 447 | −2843 | 556 | 2280 | −2590 | 1525 | 1089 | −2484 | −2875 | −2195 | −2387 | −1931 | −1228 | 105 | −1521 | 1527 | 303 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 251(A) | 2994 | −2060 | −3318 | −3466 | −4480 | 1477 | −3420 | −4277 | −3713 | −4492 | −3567 | 555 | −3034 | −3314 | −3765 | −61 | −1848 | −3134 | −4669 | −4455 | 304 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 252(F) | −4510 | −3775 | −5456 | −5636 | 4401 | −5131 | −2010 | −2624 | −5257 | −859 | −2061 | −4236 | −5048 | −4187 | −4724 | −4603 | −4458 | −3115 | −1246 | −111 | 305 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 253(W) | −204 | 887 | 46 | 246 | −204 | −619 | 891 | −475 | 338 | −941 | 659 | 291 | −334 | 598 | 147 | −143 | 7 | −471 | 1260 | 199 | 306 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 254(L) | −3584 | −3041 | −6020 | −5465 | −1547 | −5724 | −4559 | 2056 | −5257 | 2650 | 1509 | −5420 | −4986 | −4234 | −4854 | −5036 | −3464 | −85 | −3297 | −3428 | 307 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 255(Q) | −1021 | 248 | 260 | 920 | −2812 | −1989 | 1097 | −2558 | 2005 | −2499 | −1576 | −625 | −2082 | 2156 | 985 | −901 | −958 | −2111 | −2661 | −1987 | 308 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 256(Q) | −387 | −2464 | −846 | 769 | −2785 | −1226 | −626 | −2533 | 1569 | −2478 | −1554 | −607 | −2064 | 1918 | 125 | −280 | 1845 | −2086 | −2645 | −1968 | 309 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 257(Y) | −4615 | −3726 | −5293 | −5520 | 1958 | −5121 | 2666 | −3552 | −5082 | 1275 | −3001 | −3826 | −4994 | −3925 | −4517 | −4347 | −4486 | −3686 | −731 | 3736 | 310 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 258(G) | −747 | −4382 | 2188 | 1513 | −4595 | 2379 | −1856 | −4494 | −2029 | −4373 | −3659 | 909 | −3058 | −1510 | −2839 | −2220 | −2589 | −3973 | −4566 | −3588 | 311 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 259(L) | −2849 | −3066 | −3826 | −2761 | −2395 | −3664 | 902 | −2487 | −656 | 2698 | −1855 | −2584 | −3649 | −1532 | 1920 | −2997 | −2656 | −2597 | −2707 | −2185 | 312 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 260(D) | −1081 | −2552 | 2320 | 1262 | −2865 | −682 | −702 | −2615 | 533 | −2565 | 328 | −642 | 1396 | −249 | −820 | −956 | 36 | −2170 | −2738 | −2050 | 313 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 261(K) | −1509 | −3060 | 1864 | 1703 | −3356 | −449 | −1058 | −3134 | 2145 | −3064 | −2175 | 56 | −2431 | 967 | −1320 | −1342 | −1471 | −2672 | −3234 | −2495 | 314 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 262(H) | −1002 | −2068 | 1504 | 952 | −2245 | −2050 | 1617 | −504 | −395 | −182 | 481 | −767 | −2139 | −339 | 266 | −215 | −39 | −604 | −2345 | 1579 | 315 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 263(F) | −2939 | −2542 | −4828 | −4519 | 3955 | −4337 | −1860 | 649 | −4141 | −1500 | −1361 | −3601 | −4252 | −3447 | −3825 | −3494 | −2868 | 491 | −1216 | 1328 | 316 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 264(K) | −3285 | −3787 | −3212 | −3069 | −5220 | 1761 | −2834 | −5042 | 3532 | −4797 | −4163 | −3047 | −4026 | −2528 | −1831 | −3329 | −3400 | −4504 | −4387 | −4430 | 317 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 265(L) | −3149 | −2690 | −5597 | −5054 | 1255 | −5177 | −4100 | 997 | −4810 | 2411 | −428 | −4847 | −4706 | −4033 | −4515 | −4417 | −3061 | 1824 | −3171 | −3136 | 318 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 266(N) | −4313 | −4359 | −3728 | −4093 | −5358 | −4169 | −4424 | −6344 | −4850 | −6082 | −5725 | 4411 | −4732 | −4593 | −4904 | −4442 | −4627 | −5689 | −4872 | −5035 | 319 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |

TABLE 3-continued

| | | | | | | | | | | | | | | | | | | | | | |
|---|---|---|---|---|---|---|---|---|---|---|---|---|---|---|---|---|---|---|---|---|---|
| 267(I) | −2513 | −2147 | −4957 | −4435 | −1823 | −4442 | −3529 | 2351 | −4159 | 1722 | −717 | −4099 | 1949 | −3712 | −4007 | −3631 | −2464 | 904 | −3048 | −2816 | 320 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 268(E) | −4894 | −4877 | −3044 | 3932 | −5916 | −4252 | −4190 | −6541 | −4583 | −6183 | −5913 | −3747 | −4767 | −4175 | −4884 | −4792 | −5049 | −6107 | −5083 | −5486 | 321 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 269(A) | 2088 | 1365 | −3378 | −2828 | 487 | 698 | −1799 | −836 | −2493 | −1210 | −556 | −2334 | −2768 | −2166 | −2396 | −1684 | 1302 | 1028 | −1808 | −1465 | 322 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 270(N) | 11 | −2335 | −2305 | −2622 | −4638 | 1373 | −3163 | −4488 | −3477 | −4658 | −3784 | 3837 | −3115 | −3000 | −3729 | −1807 | −2052 | −3368 | −4789 | −4432 | 323 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 271(H) | −5506 | −4764 | −5029 | −5331 | −4362 | −4732 | 5444 | −6634 | −5266 | −6082 | −5977 | −5274 | −5186 | −5341 | −5054 | −5722 | −5705 | −6336 | −4332 | −3976 | 324 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 272(A) | 3116 | −3101 | −1551 | 1884 | −4671 | −2707 | −2717 | −4449 | −2864 | −4585 | −3878 | −2034 | −3343 | −2468 | −3340 | −2287 | −2556 | −3712 | −4673 | −4159 | 325 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 273(T) | −1255 | −2072 | −1391 | −875 | −1774 | −2311 | −946 | −1843 | −693 | −1995 | −1243 | 873 | −2410 | 1832 | −1084 | −1286 | 2808 | −1615 | 1353 | 355 | 326 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 274(M) | −4049 | −3435 | −6360 | −5790 | −1437 | −6127 | −4754 | −942 | −5533 | 2883 | 3227 | −5895 | −5154 | −4292 | −4999 | −5549 | −3886 | −1796 | −3261 | −3457 | 327 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 275(A) | 3290 | −2018 | −4238 | −4530 | −4608 | −2288 | −3883 | −4417 | −4424 | −4691 | −3755 | −3019 | −3092 | −3936 | −4162 | 1337 | −1879 | −3180 | −4829 | −4744 | 328 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 276(G) | −2006 | −2603 | −2686 | −2983 | −51 | 3566 | −2982 | −4201 | −3636 | −4266 | −3635 | −99 | −3416 | −3230 | −3787 | −2185 | −2398 | −3434 | −3413 | −2529 | 329 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 277(H) | −3898 | −3709 | −4252 | −4240 | −1538 | −4376 | 4892 | −2923 | −3417 | 1381 | −2343 | −3896 | −4606 | −3607 | −3347 | −4116 | −3942 | −3297 | −2280 | −1292 | 330 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 278(T) | −1794 | −2944 | 99 | −1062 | −3953 | −2361 | −1803 | −3744 | −1729 | −3753 | −2919 | 2222 | −2829 | −1442 | −2305 | 1194 | 2849 | −3137 | −3957 | −3248 | 331 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 279(F) | −4666 | 1469 | −5329 | −5600 | 4144 | −5120 | −1487 | −3637 | −5160 | −3061 | −3095 | −3851 | −5019 | −3971 | −4573 | −4367 | −4562 | −3771 | −742 | 2400 | 332 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 280(E) | −993 | −2363 | −876 | 2071 | −2644 | −1981 | 2018 | −2365 | −241 | −2362 | 390 | −634 | −40 | 1941 | −739 | −894 | 426 | −384 | −2572 | −1915 | 333 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 281(H) | −3635 | −4141 | −2481 | −2626 | −2997 | −3692 | 5257 | −4886 | −2082 | −4514 | −4107 | −2763 | −4095 | 92 | −2165 | −3525 | −3677 | −4578 | −3303 | −2455 | 334 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 282(E) | −310 | −4317 | 520 | 3226 | −4661 | 1262 | −1926 | −4565 | −2136 | −4453 | −3755 | −1193 | −3092 | −1590 | −2961 | −2255 | −2635 | −4020 | −4649 | −3669 | 335 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 283(I) | −3109 | −2594 | −5687 | −5258 | −2040 | −5447 | −4789 | 2687 | −5127 | 2204 | −803 | −5121 | −4973 | −4528 | −4983 | −4783 | −3057 | 1096 | −3762 | −3679 | 336 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |

TABLE 3-continued

| | | | | | | | | | | | | | | | | | | | | | |
|---|---|---|---|---|---|---|---|---|---|---|---|---|---|---|---|---|---|---|---|---|---|
| 284(R) | 1930 | −2801 | −1080 | 241 | −3166 | −2275 | −912 | −2874 | −337 | −2798 | −1919 | 868 | −2397 | 569 | 2445 | −1288 | −1343 | −2456 | −2934 | −2321 | 337 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 285(Q) | −1119 | 867 | −3256 | −2635 | 296 | −2643 | −1503 | −469 | −2274 | −824 | 1432 | −2219 | −2695 | 2042 | −2148 | −1719 | 1528 | 1807 | −1431 | 1003 | 338 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 286(A) | 3647 | −2999 | −4758 | −5092 | −5144 | −3219 | −4514 | −5091 | −5094 | −5303 | −4637 | −3980 | −3954 | −4741 | −4797 | −2812 | −3007 | −4128 | −4931 | −5200 | 339 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 287(R) | −438 | −1218 | −2385 | −1792 | −1208 | −2507 | −1291 | 204 | −277 | 1082 | −410 | −1737 | −2569 | −1360 | 2522 | −410 | −1068 | 702 | −1647 | −1266 | 340 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 288(W) | 180 | −1750 | 1481 | 940 | −1841 | −2159 | −866 | 977 | −643 | −920 | −906 | 114 | −2242 | −565 | −1063 | −1106 | 370 | −499 | 2833 | 79 | 341 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 289(H) | 1869 | −1372 | −1935 | −1371 | 128 | −2386 | 2326 | −951 | −1207 | 263 | −557 | 1380 | −2458 | −1069 | −1489 | −476 | −1037 | −822 | −1723 | 344 | 342 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 290(G) | −2602 | −4486 | 1035 | 201 | −4670 | 3031 | −1891 | −4579 | −363 | −4449 | −3755 | 1477 | −3090 | −1551 | −2902 | −2272 | −2659 | −4058 | −4641 | −3646 | 343 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 291(M) | 251 | −1162 | −3387 | −2773 | −1077 | −2851 | −1716 | 431 | 1723 | 1291 | 2513 | −2402 | −2886 | −2100 | −2325 | −1930 | −1249 | 891 | −1646 | −1308 | 344 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 292(L) | −4115 | −3482 | −6205 | −5777 | 1065 | −5951 | −3943 | −1092 | −5536 | 3135 | −370 | −5542 | −5143 | −4288 | −4987 | −5397 | −3959 | −1932 | −2773 | −2309 | 345 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 293(G) | −2777 | −2893 | −4388 | −4459 | 2368 | 3236 | −2287 | −2772 | −4264 | −1129 | −2377 | −3541 | −4076 | −3729 | −4048 | −3027 | −3020 | −2799 | −1729 | −655 | 346 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 294(H) | −1953 | −2855 | −1413 | −1605 | −3687 | −2513 | 3228 | −4087 | −2128 | −4093 | −3338 | 332 | −3088 | −1980 | −2503 | 3011 | −2205 | −3384 | −3901 | −3137 | 347 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 295(I) | −2891 | −2384 | −5528 | −5155 | −2443 | −5319 | −4964 | 3155 | −5067 | 1192 | −1186 | −4980 | −4973 | −4745 | −5079 | −4666 | −2864 | 1741 | −4142 | −3869 | 348 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 296(D) | −4886 | −4905 | 4186 | −3339 | −5949 | −4221 | −4195 | −6666 | −4787 | −6283 | −6022 | −3676 | −4750 | −4186 | −5191 | −4762 | −5055 | −6188 | −5117 | −5507 | 349 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 297(A) | 3106 | −2388 | −4425 | −4439 | −2714 | −3005 | −3693 | −1978 | −4125 | 1368 | −1762 | −3486 | −3618 | −3799 | −3953 | −2396 | −2377 | −2053 | −3726 | −3485 | 350 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 298(N) | −4313 | −4359 | −3728 | −4093 | −5358 | −4169 | −4424 | −6344 | −4850 | −6082 | −5725 | 4411 | −4732 | −4593 | −4904 | −4442 | −4627 | −5689 | −4872 | −5035 | 351 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 299(Q) | −1050 | −2442 | −224 | −369 | −2747 | 1053 | −681 | −2473 | −248 | −2449 | 544 | −670 | −2117 | 2694 | 1514 | −944 | 498 | −2058 | −2641 | −1985 | 352 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 300(G) | −2973 | −3542 | −2659 | −2952 | −5121 | 3336 | −3467 | −5361 | −3342 | −5272 | −4637 | −3006 | −3958 | 2548 | −3517 | −3070 | −3300 | −4530 | −4778 | −4688 | 353 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |

TABLE 3-continued

| | | | | | | | | | | | | | | | | | | | | | |
|---|---|---|---|---|---|---|---|---|---|---|---|---|---|---|---|---|---|---|---|---|---|
| 301(D) | −1715 | −3268 | 3029 | −581 | −3564 | −2306 | 1979 | −3347 | −946 | −3273 | −2410 | 1223 | −2578 | −803 | 1209 | −403 | −1686 | −2889 | −3440 | −2693 | 354 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 302(M) | −558 | −1400 | −1835 | −1269 | −1420 | 890 | −1097 | −990 | 950 | 207 | 1982 | −1370 | 1756 | −980 | −1393 | −1333 | −1014 | −854 | −1800 | 1377 | 355 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 303(Q) | −1128 | −1286 | −2178 | −1630 | −1284 | −2459 | −1259 | 1117 | −1410 | 1858 | −477 | −456 | −570 | 2119 | −1614 | −710 | −1072 | −723 | −1713 | −1319 | 356 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 304(W) | −204 | 887 | 46 | 246 | −204 | −619 | 891 | −475 | 338 | −941 | 659 | 291 | −334 | 598 | 147 | −143 | 7 | −471 | 1260 | 199 | 357 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 305(L) | −1103 | −1400 | −1916 | −1340 | −1417 | −2382 | −1126 | 637 | 1258 | 1645 | −580 | 975 | −2451 | −1022 | 117 | −1378 | −44 | 68 | −1800 | −1383 | 358 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 306(G) | −4196 | −3631 | −4960 | −5174 | 1957 | 3226 | −1563 | −3645 | −4889 | −3130 | −3107 | −3746 | −4818 | −3883 | −4436 | −4054 | −4213 | −3704 | −843 | 2077 | 359 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 307(W) | −4933 | −4706 | 2215 | −3821 | −3602 | −4386 | −3866 | −6001 | −4863 | −5555 | −5403 | −4024 | −4864 | −4404 | −5022 | −4890 | −5088 | −5755 | 5837 | −3163 | 360 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 308(D) | −3069 | −4812 | 3638 | −1083 | −5072 | −2828 | −2301 | −5194 | −2654 | −5012 | −4468 | −1476 | −3411 | 2464 | −3523 | −2710 | −3180 | −4638 | −5009 | −4074 | 361 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 309(T) | −1461 | −1742 | 1783 | −1718 | −1846 | −2672 | −1664 | 872 | −1706 | −1478 | 697 | −1809 | −2839 | −1548 | −2007 | −1775 | 2886 | −761 | −2357 | −1930 | 362 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 310(D) | −3546 | −4222 | 3684 | −2153 | −3783 | −3505 | −3081 | −3676 | −3519 | 1330 | −3277 | −2487 | −4027 | −2939 | −4117 | −3445 | −3684 | −3809 | −4315 | −3781 | 363 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 311(E) | −1512 | −2828 | −1244 | 2417 | −3192 | −2375 | −959 | −2865 | −303 | −2800 | −1945 | −1024 | −2482 | 2385 | 1159 | −1395 | −1429 | 514 | −2934 | −2364 | 364 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 312(F) | −4608 | −3778 | −5235 | −5513 | 4303 | −5053 | −1486 | −3725 | −5109 | −3128 | −3164 | −3822 | −4992 | −3954 | −4550 | −914 | −4537 | −3840 | −745 | 1588 | 365 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −61 | −8312 | −4703 | −894 | −1115 | −701 | −1378 | * | * | | | | | | | | | | | | |
| 313(P) | −1888 | −2446 | −3444 | −3643 | −4185 | 1827 | −3530 | −4064 | −3734 | −780 | −3561 | −3019 | 3618 | −3530 | −3731 | −2122 | −2300 | −3299 | −4374 | −4144 | 366 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8258 | −9300 | −894 | −1115 | −545 | −1668 | * | * | | | | | | | | | | | | |
| 314(T) | −273 | −2001 | −1163 | −623 | −2217 | −2089 | 1932 | 12 | −526 | −2008 | −1201 | 1155 | −1093 | −465 | −983 | 551 | 2418 | −1582 | −2356 | −1797 | 367 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 315(D) | −1847 | −3447 | 2925 | 425 | −3721 | 1133 | −1341 | −3520 | −1177 | −1150 | −2603 | 1047 | −2659 | −937 | −1790 | 212 | −1833 | −3055 | −3636 | −2845 | 368 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 316(V) | −1151 | −1254 | 1271 | −1753 | −1247 | −2524 | −1330 | 1068 | −1572 | 1200 | −440 | 684 | −2591 | −99 | −1758 | −1555 | −1093 | 1616 | −1703 | −1314 | 369 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 317(Y) | −1131 | −1223 | −2356 | 151 | −1178 | −2505 | −1285 | 128 | −1515 | 1083 | −410 | −1730 | −2569 | −1365 | −371 | −327 | −1070 | −653 | −1626 | 3372 | 370 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |

TABLE 3-continued

| | | | | | | | | | | | | | | | | | | | | | |
|---|---|---|---|---|---|---|---|---|---|---|---|---|---|---|---|---|---|---|---|---|---|
| 318(E) | −66 | −2443 | 1230 | 1971 | −2759 | −1957 | −616 | −2506 | 514 | −1253 | 320 | −594 | −2050 | −158 | 115 | 620 | 475 | −2062 | −2629 | −1949 | 371 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 319(T) | 1585 | −1443 | −1997 | −1450 | −1562 | −2339 | −1262 | −37 | −1291 | −222 | −725 | 1400 | −2485 | −1158 | −1581 | −369 | 2133 | −963 | −1947 | −1528 | 372 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 320(T) | 1918 | −1866 | −4124 | −4033 | −3557 | −2298 | −3314 | −2998 | −3763 | −3472 | −2711 | −2860 | −3018 | −3397 | −3649 | −371 | 3024 | 789 | −3927 | −3691 | 373 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 321(F) | −55 | −1078 | −2947 | −2361 | 2116 | −724 | −1483 | −590 | −2061 | 2010 | −278 | −2084 | −2676 | 498 | −2047 | −1671 | −171 | −506 | −1537 | −1178 | 374 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 322(A) | 2342 | −969 | −3431 | −2800 | 739 | −2681 | −1551 | 746 | −2407 | −373 | −168 | −2310 | −2731 | −2040 | −2226 | −639 | −1077 | 1060 | 1858 | −1084 | 375 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 323(M) | −2508 | −2232 | −4761 | −4150 | −1237 | −4143 | −2920 | −798 | −3746 | 1337 | 4541 | −3775 | −3961 | −3190 | −3504 | −3281 | −381 | −1230 | 1231 | −2166 | 376 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 324(Y) | −1183 | −1021 | −3411 | −2790 | −854 | −2712 | 739 | −517 | −2406 | −192 | 1479 | −2312 | −2761 | −2042 | −2240 | −406 | −1123 | 1661 | 1953 | 3240 | 377 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 325(E) | −1745 | −3328 | 1991 | 2779 | −3608 | −2301 | −1256 | −3398 | −1050 | −3330 | −2469 | −915 | −2592 | 1001 | −1642 | −220 | −1723 | −626 | −3510 | −2737 | 378 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 326(I) | −2844 | −2383 | −5395 | −4937 | 151 | −5038 | −4287 | 2475 | −4753 | 1393 | −861 | −4697 | −4716 | −4269 | −4629 | −4304 | −2798 | 2345 | −3556 | −3362 | 379 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 327(L) | −3363 | −2830 | −5881 | −5398 | −1770 | −5628 | −4722 | 1688 | −5234 | 2786 | −540 | −5318 | −5008 | −4398 | −4954 | −4964 | −3282 | 734 | −3526 | −3572 | 380 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 328(K) | −365 | −2488 | 41 | 1718 | −2813 | −1989 | −641 | −2559 | 2204 | −1130 | −1578 | −624 | −2083 | 814 | 944 | −903 | −960 | −2112 | −2664 | −1989 | 381 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 329(N) | 716 | −2390 | −858 | 192 | −377 | −873 | 712 | −2414 | −222 | −2394 | 336 | 2657 | −2061 | 626 | −263 | 421 | −924 | −1997 | −2590 | −1924 | 382 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 330(G) | 66 | −2442 | 172 | −2179 | −4601 | 3363 | −2899 | −4434 | −3223 | −4571 | −3714 | −2119 | −3077 | −2685 | −3642 | −14 | −2069 | −3384 | −4750 | −4279 | 383 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −244 | −8312 | −2711 | −894 | −1115 | −701 | −1378 | * | * | | | | | | | | | | | | |
| 331(G) | −1329 | −1980 | −1953 | −1910 | 214 | 3238 | −2065 | −2824 | −2078 | −3015 | −2271 | −1831 | −2735 | 197 | −2364 | 190 | −1589 | −2329 | −3112 | −2499 | 384 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −8 | −8076 | −9118 | −894 | −1115 | −1192 | −831 | * | * | | | | | | | | | | | | |
| 332(F) | −2519 | −2199 | −4819 | −4218 | 2372 | −4220 | −2969 | 1473 | −3877 | 2085 | −110 | −3854 | 1128 | −3227 | −3601 | −3367 | −2431 | −1024 | −2364 | −2136 | 385 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −1585 | −8137 | −593 | −894 | −1115 | −1458 | −653 | * | * | | | | | | | | | | | | |
| 333(D) | −901 | −2417 | 2169 | 499 | −2834 | 1682 | −424 | −2665 | −438 | −2621 | −1844 | 1572 | −1628 | −64 | −1115 | −688 | −954 | −2173 | −2820 | −1986 | 386 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −555 | −6574 | −1696 | −894 | −1115 | −3087 | −181 | * | * | | | | | | | | | | | | |
| 334(G) | −771 | −1114 | −1327 | −1503 | −2474 | 3336 | −1576 | −2519 | −1737 | −2659 | −2097 | −1339 | −1786 | −1606 | −1805 | −971 | −1107 | −1936 | −2209 | −2293 | 387 |
| — | −148 | −500 | 233 | 43 | −381 | 399 | 106 | −626 | 210 | −466 | −720 | 275 | 394 | 45 | 96 | 359 | 118 | −369 | −294 | −249 | |
| — | −1217 | −830 | −7094 | −156 | −3286 | −3231 | −162 | * | * | | | | | | | | | | | | |

TABLE 3-continued

| | | | | | | | | | | | | | | | | | | | | | |
|---|---|---|---|---|---|---|---|---|---|---|---|---|---|---|---|---|---|---|---|---|---|
| 335(P) | −947 | −1231 | −1366 | −1466 | −2201 | −1324 | −1470 | −2177 | −1504 | −2284 | −1843 | −1373 | 3767 | −1487 | −1585 | −1143 | −1229 | −1796 | −2061 | −2037 | 389 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −33 | −6052 | −7094 | −894 | −1115 | −2145 | −370 | * | * | | | | | | | | | | | | |
| 336(G) | 1354 | −1173 | −535 | −238 | −2069 | 1779 | −486 | −1725 | 1105 | −1853 | −1038 | −370 | −1543 | −134 | −464 | −352 | −421 | −1271 | −2125 | −1610 | 390 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −21 | −6683 | −7725 | −894 | −1115 | −113 | −3725 | * | * | | | | | | | | | | | | |
| 337(Y) | 923 | −2098 | −152 | −490 | −2292 | 773 | −737 | −1954 | 123 | −2065 | −1235 | −765 | 927 | −341 | −870 | −977 | 771 | −667 | −2379 | 2237 | 391 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 338(T) | −596 | −2454 | −27 | 443 | −2775 | −1955 | 675 | −2525 | 1003 | −2470 | −1543 | 140 | 1222 | 782 | 953 | −43 | 1528 | −2076 | −2637 | −1955 | 392 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 339(G) | −4740 | −4445 | −5364 | −5738 | −6131 | 3840 | −5265 | −6903 | −6030 | −6539 | −6235 | −5426 | −5034 | −5814 | −5624 | −5041 | −5115 | −6153 | −5123 | −6096 | 393 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 340(G) | −2931 | −3331 | −4304 | −4658 | −5520 | 3378 | −4536 | −5732 | −5076 | −5740 | −5043 | −4039 | 2291 | −4709 | −4901 | −3171 | −3373 | −4635 | −5035 | −5498 | 394 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 341(L) | −1644 | −1468 | −3782 | −3157 | 438 | −3201 | −2041 | 710 | −2752 | 2206 | −223 | −2773 | −3187 | −2399 | 1799 | −2291 | 253 | −697 | −1864 | −1566 | 395 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 342(N) | −3133 | −4000 | −1625 | −1938 | −3244 | −3217 | 3075 | −4941 | −2575 | −4694 | −4212 | 3945 | −3753 | −2478 | −2897 | −2996 | −3298 | −4437 | −3600 | −2686 | 396 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 343(F) | −5308 | −4420 | −5610 | −5948 | 4547 | −4921 | −3048 | −4656 | −5852 | −3992 | −4112 | −4995 | −5217 | −5110 | −5315 | −5363 | −5399 | −4866 | −2341 | −1279 | 397 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 344(D) | −3598 | −4594 | 4015 | −1825 | −3014 | −3354 | −2628 | −5167 | −3365 | −4864 | −4554 | −2168 | −3906 | −2692 | −4098 | −3307 | −3726 | −4804 | −3495 | 737 | 398 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 345(A) | 3015 | −2000 | −3678 | −3337 | 863 | −3026 | −1786 | −1924 | −3083 | −2118 | −1567 | −2743 | −3353 | −2703 | −3034 | −485 | −2005 | −1776 | −1454 | 1913 | 399 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 346(K) | −3437 | −3998 | −3427 | −2630 | −4447 | −3747 | 1328 | −4350 | 3785 | −3966 | −3350 | −2554 | −3806 | −1483 | −516 | −3312 | −3161 | −4115 | −3603 | −3389 | 400 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 347(V) | 467 | −1371 | −3451 | −2935 | −1595 | −2710 | −2060 | −662 | −2633 | −346 | −783 | −2500 | 2276 | −2347 | −2594 | −1872 | 715 | 2313 | −2129 | −1779 | 401 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 348(R) | −1896 | −2633 | −2566 | −1895 | −3409 | −2759 | −1580 | −3013 | −629 | −715 | −2292 | −1894 | 174 | −1218 | 3522 | 651 | −1925 | −2662 | −3190 | −2839 | 402 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 349(R) | −5156 | −4675 | −5377 | −4998 | −5777 | −4641 | −4103 | −6271 | −3143 | −5805 | −5439 | −4840 | −4993 | −4014 | 4230 | −5318 | −5151 | −5964 | −4773 | −5292 | 403 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 350(T) | 361 | −2459 | −832 | 770 | −2780 | −972 | −644 | −2526 | −232 | −2480 | −1560 | 624 | −666 | 1428 | −740 | 39 | 2295 | −2083 | −2655 | −1976 | 404 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 351(S) | −2650 | −4418 | 471 | 1677 | −4792 | −2597 | −2009 | −4725 | −2280 | −4605 | −3943 | −1231 | −3150 | −1685 | −3140 | 3091 | −2749 | −4162 | −4795 | −3785 | 405 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −383 | −8312 | −2119 | −894 | −1115 | −701 | −1378 | * | * | | | | | | | | | | | | |

TABLE 3-continued

| | | | | | | | | | | | | | | | | | | | | | |
|---|---|---|---|---|---|---|---|---|---|---|---|---|---|---|---|---|---|---|---|---|---|
| 352(F) | −1686 | −1643 | −3313 | −2900 | 3471 | −2934 | −1275 | −1319 | −2616 | −1518 | −978 | −2397 | −3095 | −2241 | −2563 | −216 | 1898 | −1228 | −906 | 1070 | 406 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −9 | −7937 | −8980 | −894 | −1115 | −254 | −2629 | * | * | | | | | | | | | | | | |
| 353(D) | 395 | −2586 | 2498 | 794 | −2902 | −678 | −718 | −2657 | 1205 | −2600 | −1681 | −648 | −2139 | 585 | −841 | −973 | 248 | −2206 | −2769 | −2076 | 407 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 354(W) | −204 | 887 | 46 | 246 | −204 | −619 | 891 | −475 | 338 | −941 | 659 | 291 | −334 | 598 | 147 | −143 | 7 | −471 | 1260 | 199 | 408 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 355(P) | 574 | −1802 | 174 | 209 | 242 | −2139 | −841 | −414 | 215 | −426 | 693 | −939 | 1418 | 345 | −227 | −1082 | −961 | 254 | −2132 | 883 | 409 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 356(E) | −1666 | −3205 | 2244 | 2653 | −3457 | −2276 | −1194 | −3250 | −962 | −3199 | −2337 | −894 | −2544 | 492 | −1537 | −1489 | −1638 | −1099 | −3379 | 987 | 410 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 357(D) | −3359 | −4413 | 3698 | −1801 | −5459 | 1768 | −2962 | −5658 | −3441 | −5486 | −4961 | −2153 | −3821 | −2730 | −4255 | −3154 | −3567 | −4971 | −5125 | −4670 | 411 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 358(L) | −3209 | −2692 | −5753 | −5295 | −1892 | −5491 | −4700 | 887 | −5141 | 2651 | −663 | −5173 | −4965 | −4433 | −4931 | −4819 | −3144 | 1908 | −3615 | −3591 | 412 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 359(W) | −3018 | −2633 | −4761 | −4491 | 3489 | −4266 | −1661 | 1631 | −4078 | −1724 | −1536 | −3487 | −1838 | −3365 | −3744 | −3422 | −2946 | −2006 | 4055 | 56 | 413 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 360(Y) | 828 | −1415 | −340 | −305 | −1437 | −2319 | 1172 | 1116 | −1057 | 992 | −593 | −1325 | −2393 | −936 | −276 | −1304 | −999 | −869 | −1810 | 2176 | 414 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 361(A) | 2490 | −1883 | −3530 | −3268 | 392 | 1317 | −2915 | −3137 | −3094 | −3410 | −2609 | −2570 | −2929 | −2839 | −3197 | 1570 | −155 | −2497 | −3780 | −3478 | 415 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 362(H) | 1671 | −2732 | −3104 | −3318 | −3618 | −2860 | 4890 | −4439 | −3288 | −4509 | −3848 | −2949 | −3546 | −3299 | −3341 | −2352 | −2548 | −3629 | −3930 | −3278 | 416 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 363(I) | 372 | −1510 | −2804 | −2153 | −1581 | −2814 | −1570 | 3136 | 406 | −1345 | −734 | −2057 | −2878 | −1575 | 172 | −1891 | −1390 | 26 | −2021 | −1655 | 417 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 364(A) | 2824 | −1953 | −4254 | −4336 | −4278 | 1795 | −3663 | −3992 | −4116 | −4288 | −3398 | −2940 | −3040 | −3690 | −3947 | 484 | −1804 | −87 | −4541 | −4398 | 418 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 365(G) | 440 | 2735 | −4017 | −4164 | −4414 | 3094 | −3664 | −4182 | −4084 | −4444 | −3530 | 1340 | −3050 | −3662 | −3947 | −1624 | −1829 | −3066 | −4648 | −4508 | 419 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 366(M) | −3435 | −3070 | −5645 | −5292 | −1686 | −5048 | −4285 | 177 | −4844 | −362 | 5058 | −5009 | −4816 | −4199 | −4559 | −4488 | −3429 | −1290 | −3293 | −3151 | 420 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 367(D) | −2500 | −3942 | 3572 | −1015 | −4586 | −2633 | −1974 | −4469 | −1888 | −4357 | −3653 | −1359 | −3145 | −1638 | 1771 | −503 | −2599 | −3914 | −4464 | −3654 | 421 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 368(T) | 1100 | −1830 | −2203 | −1732 | −2569 | −2230 | −1735 | −2187 | −1612 | −2425 | 2062 | 435 | −2620 | −1496 | −1953 | 1109 | 2598 | −1840 | −2841 | −2399 | 422 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |

TABLE 3-continued

| | | | | | | | | | | | | | | | | | | | | | |
|---|---|---|---|---|---|---|---|---|---|---|---|---|---|---|---|---|---|---|---|---|---|
| 369(Y) | −4358 | −3577 | −5299 | −5430 | 3019 | −5078 | −1573 | −2961 | −5006 | −1623 | 2952 | −3869 | −4923 | −3893 | −4468 | −4298 | −4237 | −3252 | −830 | 3643 | 423 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 370(A) | 3106 | −2388 | −4425 | −4439 | −2714 | −3005 | −3693 | −1978 | −4125 | 1368 | −1762 | −3486 | −3618 | −3799 | −3953 | −2396 | −2377 | −2053 | −3726 | −3485 | 424 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 371(R) | 722 | −1126 | −2900 | −2287 | −1095 | −2649 | −1470 | 1035 | −567 | 1406 | −311 | −2061 | −2701 | −1716 | 1956 | −1708 | −1121 | 435 | −1583 | −1225 | 425 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 372(G) | 1248 | −1889 | −3801 | −3776 | −3523 | 2775 | −3223 | −3143 | −3626 | 1237 | −2695 | −2780 | −3011 | −3284 | −3555 | −677 | −1747 | −2517 | −3884 | −3627 | 426 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 373(L) | −2143 | −2281 | −3312 | −2427 | 697 | −3298 | −1645 | −1581 | 1855 | 2371 | −1066 | −2323 | −3278 | −1496 | 360 | −2446 | −2014 | −1662 | −2346 | −1935 | 427 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 374(K) | −1243 | −2663 | −484 | 1864 | −3023 | −2175 | −770 | −2741 | 2247 | −1301 | −1757 | −811 | −2263 | 491 | 1587 | −1121 | −1167 | −2309 | −2789 | −2166 | 428 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 375(V) | 135 | −1595 | −1634 | −1081 | −1703 | −685 | −1060 | −548 | −931 | −1546 | −820 | 692 | −2371 | −843 | 1741 | −469 | −1038 | 2254 | −2023 | −1565 | 429 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 376(A) | 3481 | −2081 | −4434 | −4657 | −4120 | −2450 | −3905 | −2895 | −4402 | −3809 | −3256 | −3167 | −3225 | −3995 | −4150 | −1826 | −1986 | −149 | −4587 | −4404 | 430 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 377(A) | 1962 | −2221 | −948 | 716 | −2449 | −2010 | 1143 | −2137 | 247 | −1046 | −1336 | 675 | −2101 | −258 | −794 | −334 | −934 | −427 | −2463 | 1197 | 431 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 378(K) | 2235 | −3511 | −3265 | −2182 | −4396 | −3362 | −1483 | −3787 | 2511 | −3506 | −2802 | −2133 | −3385 | −1064 | 1852 | −2645 | −2521 | −3495 | −3399 | −3235 | 432 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 379(M) | −3847 | −3277 | −6201 | −5593 | 2394 | −5898 | −4497 | 240 | −5358 | 2214 | 3316 | −5599 | −5021 | −4167 | −4850 | −5211 | −3688 | −1727 | −3154 | −3303 | 433 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 380(I) | −1275 | −1329 | −2647 | −1990 | −1321 | −2643 | 565 | 2209 | 625 | 584 | −515 | −1883 | −2692 | −1414 | 1794 | −1698 | −1203 | 413 | −1741 | −1377 | 434 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 381(E) | 944 | −2571 | 656 | 2380 | −2887 | −2009 | −705 | −2642 | 620 | −2585 | −1665 | 137 | −2128 | 844 | −823 | −959 | −41 | −2191 | −2754 | −2062 | 435 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 382(D) | −598 | −4837 | 3833 | 578 | −5072 | −2648 | −2116 | −5055 | −2532 | −4904 | −4335 | −1252 | −3241 | −1811 | −3527 | −2501 | −2990 | −4481 | −5103 | −3988 | 436 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 383(P) | −1003 | −2474 | −144 | −294 | −2795 | 1002 | −631 | −2545 | 989 | −2490 | −1565 | 774 | 1615 | 611 | 937 | 553 | −942 | −2097 | −2657 | −1975 | 437 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 384(F) | 81 | −1956 | −1130 | 1500 | 1552 | −2090 | −781 | −1736 | 41 | −1894 | −1096 | −841 | 683 | 68 | −936 | −136 | −956 | 1365 | −2258 | −1704 | 438 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 385(F) | −2039 | −1782 | −4382 | −3777 | 2108 | −3679 | −2463 | 807 | −3406 | 1823 | −321 | −3311 | −3599 | −2912 | −3176 | −2794 | −1969 | 1752 | −2089 | 943 | 439 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |

TABLE 3-continued

| | | | | | | | | | | | | | | | | | | | | | |
|---|---|---|---|---|---|---|---|---|---|---|---|---|---|---|---|---|---|---|---|---|---|
| 386(D) | −987 | 436 | 2031 | 1591 | −2780 | −1958 | −618 | −2531 | 514 | −2475 | −1549 | 86 | −2053 | 1563 | 61 | −143 | −197 | −2081 | −2643 | −1960 | 440 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 387(E) | −507 | −2601 | 840 | 1955 | −2917 | −2021 | −726 | −2673 | 1456 | −2615 | −1696 | 1166 | −2147 | 1657 | −852 | −409 | −1056 | −2221 | −2783 | −2088 | 441 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 388(M) | 1019 | −961 | −3469 | −2834 | 1400 | −2682 | −1552 | 1329 | −2431 | 1012 | 1489 | −2324 | −2730 | −2055 | −255 | −1766 | −1074 | 894 | 1470 | −1077 | 442 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 389(M) | −1149 | −1013 | −3253 | −2628 | −962 | −2671 | −1525 | 2021 | −134 | 1151 | 2066 | −2232 | −2720 | −223 | −304 | −1746 | −1089 | 1184 | −1468 | −1122 | 443 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 390(A) | 1814 | −2486 | 567 | 1223 | −2807 | −1975 | −640 | −2557 | 1226 | −2501 | −1576 | −610 | −2073 | 413 | 729 | −291 | −953 | −2108 | −2667 | −1985 | 444 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 391(E) | 1007 | −2465 | 333 | 2274 | −2786 | −1961 | 536 | −2537 | 738 | −2481 | −1555 | 281 | −2057 | 320 | −172 | −872 | −68 | −2087 | −2649 | −1965 | 445 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 392(R) | 73 | −2800 | −1762 | −1095 | −3205 | −2591 | −1056 | −2829 | 795 | −2778 | −1964 | −1292 | −2658 | −633 | 3242 | 417 | −1588 | −2495 | −2901 | 541 | 446 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 393(Y) | −2721 | −3376 | −2973 | −2154 | −3188 | −727 | −1495 | −3439 | 891 | −3279 | −2619 | −2128 | −3405 | −1166 | 820 | −2667 | −2523 | −3217 | −2977 | 4298 | 447 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 394(A) | 1285 | −2377 | −872 | 585 | −2664 | −1977 | −638 | −2390 | 605 | −788 | −1475 | −626 | −2069 | 1284 | 427 | 1071 | −929 | 395 | −2580 | −1920 | 448 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 395(S) | 131 | −2423 | 336 | 386 | −341 | −50 | −762 | −2464 | −386 | −2470 | −1581 | −713 | −2161 | −325 | −890 | 2478 | −324 | −2059 | −2688 | −2031 | 449 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 396(F) | −3512 | −3303 | 10 | 1365 | 3217 | −4329 | −1411 | −3102 | −3530 | −2820 | −2586 | −3109 | −4323 | −3009 | −3565 | −3461 | −3428 | −3094 | 3031 | 2760 | 450 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 397(D) | −990 | −2441 | 1836 | −293 | −2754 | −1964 | −625 | −2498 | 1161 | 389 | −1533 | 1125 | −131 | −168 | 2 | −164 | 557 | −2059 | −2630 | −1953 | 451 |
| — | −147 | −500 | 233 | 43 | −381 | 399 | 105 | −627 | 211 | −466 | −721 | 276 | 393 | 45 | 96 | 359 | 117 | −370 | −295 | −250 | |
| — | −466 | −1865 | −9354 | −73 | −4335 | −701 | −1378 | * | * | | | | | | | | | | | | |
| 398(E) | −84 | −2457 | −258 | 1626 | −2777 | −455 | −617 | −2527 | 254 | −2472 | −1546 | −593 | −2051 | 799 | 115 | 1531 | 906 | −2078 | −2640 | −1958 | 453 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 399(G) | −1414 | −2476 | −1090 | 1358 | −2997 | 2543 | −1296 | −2678 | −1035 | −762 | −1957 | −1125 | 1149 | −921 | −1515 | −1387 | −149 | −2292 | −3069 | −2463 | 454 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 400(I) | 128 | −1033 | −3266 | −2651 | −1007 | −2701 | −1569 | 2545 | −778 | 400 | −239 | −2262 | −914 | −1978 | −2197 | −1777 | 1346 | 618 | −1515 | −1165 | 455 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 401(G) | 129 | −2062 | −3816 | −3956 | −3724 | 3250 | −3484 | −3244 | −3864 | 847 | −2909 | −2938 | −3156 | −3542 | −3752 | −1788 | −1933 | −2674 | −4165 | −3918 | 456 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −79 | −8312 | −4317 | −894 | −1115 | −701 | −1378 | * | * | | | | | | | | | | | | |
| 402(Q) | 1462 | −2384 | −811 | 38 | −2692 | −1184 | −584 | −2431 | 1433 | −354 | 117 | 801 | −2020 | 1472 | 466 | −836 | −887 | −1999 | −2574 | −1903 | 457 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8240 | −9282 | −894 | −1115 | −509 | −1750 | * | * | | | | | | | | | | | | |

TABLE 3-continued

| | | | | | | | | | | | | | | | | | | | | | |
|---|---|---|---|---|---|---|---|---|---|---|---|---|---|---|---|---|---|---|---|---|---|
| 403(D) | 286 | −2477 | 2128 | 1000 | −2797 | −1001 | −633 | −2548 | 308 | −2493 | −1568 | −601 | 199 | 1422 | −727 | 187 | −166 | −2099 | −2661 | −1976 | 458 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 404(W) | −204 | 887 | 46 | 246 | −204 | −619 | 891 | −475 | 338 | −941 | 659 | 291 | −334 | 598 | 147 | −143 | 7 | −471 | 1260 | 199 | 459 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 405(I) | −1225 | −1056 | −3499 | −2876 | 1632 | 939 | −1661 | 2615 | −2494 | −822 | 1196 | −2403 | −126 | −2131 | −2324 | −1865 | −1168 | 223 | −1539 | −1195 | 460 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −183 | −8312 | −3109 | −894 | −1115 | −701 | −1378 | * | * | | | | | | | | | | | | |
| 406(E) | −156 | −1264 | −2093 | 2168 | −1299 | −2445 | −1234 | 765 | −347 | 105 | −458 | −1568 | −2508 | −1200 | −1588 | −1457 | −1033 | 1607 | −1750 | −1344 | 461 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −8 | −8137 | −9179 | −894 | −1115 | −1458 | −653 | * | * | | | | | | | | | | | | |
| 407(E) | 360 | −2380 | 448 | 1932 | −2699 | −673 | −533 | −2451 | 240 | −2395 | −1470 | 1122 | −1965 | 522 | −630 | 837 | −34 | −2001 | −2563 | −1878 | 462 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −8 | −8137 | −9179 | −894 | −1115 | −373 | −2136 | * | * | | | | | | | | | | | | |
| 408(G) | −306 | −1754 | −2167 | −1874 | −1807 | 2904 | −1682 | −1676 | −1831 | −397 | −1274 | −3 | −2773 | −1677 | −2075 | −1633 | −1459 | −1477 | −2248 | 1794 | 463 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 409(K) | 356 | −2456 | −833 | 230 | −2777 | −1959 | 716 | −2527 | 2040 | −2472 | −1546 | 519 | −2052 | 1143 | 415 | 499 | 717 | −2078 | −2639 | −1958 | 464 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 410(A) | 1615 | −2218 | 495 | 834 | −2445 | −2009 | 454 | −2132 | −307 | −625 | 696 | −690 | −2100 | −258 | −151 | −93 | 780 | −5 | −2460 | −1840 | 465 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 411(D) | −1190 | −2605 | 1765 | 410 | −2890 | −2073 | −813 | −2627 | −455 | 475 | −1718 | 532 | −2218 | −375 | −974 | 1045 | 1564 | −2211 | −2813 | −2132 | 466 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 412(F) | −2934 | −2588 | −5133 | −4524 | 2606 | −4635 | −3270 | −872 | −262 | 2523 | 1205 | −4222 | −4303 | −3468 | −3837 | −3796 | −2830 | −1448 | −2581 | −2349 | 467 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 413(E) | 1449 | −2456 | −323 | 1515 | −2776 | −1957 | 1150 | −2526 | 1493 | −2471 | −1545 | 270 | −1061 | −157 | −422 | −422 | 54 | −2077 | −2639 | −1957 | 468 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 414(D) | −185 | −2555 | 2037 | 1092 | −2872 | −2002 | −694 | −2626 | 851 | −2570 | −1649 | −635 | −2118 | 444 | −809 | 1514 | −290 | −2176 | −2739 | −2048 | 469 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 415(L) | −76 | −1139 | −2558 | −1967 | −1115 | −2532 | −1344 | −133 | −1691 | 2129 | −330 | −1845 | −2594 | 221 | 1015 | −484 | −1055 | 439 | −1577 | −1205 | 470 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 416(E) | 1511 | 1129 | −1595 | 1751 | −1576 | −2259 | −999 | −1157 | −900 | −416 | −704 | −1196 | −2339 | −797 | −1260 | 687 | −49 | −278 | −1911 | 36 | 471 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 417(K) | 1530 | −2471 | −17 | 1044 | −2791 | −1963 | −628 | −2542 | 1572 | −2487 | −1561 | 676 | −2060 | 1100 | −720 | −173 | −45 | −2093 | −2654 | −1971 | 472 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 418(Y) | −3642 | −3323 | −4353 | −3980 | 2403 | −4454 | 1728 | −3120 | −855 | −2839 | −2606 | −3260 | −4404 | −2976 | 133 | −3614 | −3524 | −3122 | −870 | 4083 | 473 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 419(A) | 2435 | −1847 | −629 | 808 | −1986 | −901 | −1033 | 1094 | −847 | −1803 | −1059 | −1095 | −2363 | −746 | −1268 | −1239 | −1109 | −542 | −2252 | −1747 | 474 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |

TABLE 3-continued

| | | | | | | | | | | | | | | | | | | | | | |
|---|---|---|---|---|---|---|---|---|---|---|---|---|---|---|---|---|---|---|---|---|---|
| 420(E) | 67 | −2239 | 224 | 1346 | −452 | −709 | −673 | 230 | 575 | 996 | −1351 | −680 | −2095 | 263 | −785 | −91 | −453 | −1814 | −2476 | −1850 | 475 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 421(D) | −160 | −2437 | 1202 | 1064 | 1123 | −1958 | −618 | −2495 | 267 | −897 | −1528 | 1077 | −2052 | 1118 | −708 | 595 | −921 | −2054 | −2625 | −70 | 476 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 422(H) | −986 | −2410 | 1343 | −303 | −2711 | −1966 | 2413 | −86 | 1142 | −644 | −1505 | 1346 | 594 | −174 | −432 | −876 | −284 | −2021 | −2605 | −1935 | 477 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −72 | −8312 | −4460 | −894 | −1115 | −701 | −1378 | * | * | | | | | | | | | | | | |
| 423(N) | 209 | −2403 | −80 | 227 | −2718 | 589 | 404 | −2465 | 586 | −861 | 708 | 808 | 710 | 802 | −666 | 242 | −2 | −673 | −2589 | −1910 | 478 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −110 | −8247 | −3828 | −894 | −1115 | −1040 | −961 | * | * | | | | | | | | | | | | |
| 424(Q) | −887 | −2330 | 1492 | 1492 | −2638 | −585 | 686 | −431 | −111 | −450 | −1423 | −504 | −1958 | 1578 | −617 | −233 | 439 | −1945 | −2521 | −1846 | 479 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −848 | −8144 | −1181 | −894 | −1115 | −1434 | −667 | * | * | | | | | | | | | | | | |
| 425(A) | 2076 | −2279 | 957 | 892 | −2676 | −1567 | −534 | −2428 | −295 | −2418 | −1560 | −263 | −1843 | −126 | −852 | 1085 | −887 | −1985 | −2630 | −1917 | 480 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −942 | −7310 | −1080 | −894 | −1115 | −2709 | −239 | * | * | | | | | | | | | | | | |
| 426(E) | −381 | −1604 | 25 | 1852 | −1759 | −1234 | 69 | −1535 | 1212 | −1562 | −736 | 96 | −1382 | 470 | 131 | −287 | −318 | −1195 | −1742 | 1116 | 481 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −246 | −6394 | −2788 | −894 | −1115 | −3145 | −173 | * | * | | | | | | | | | | | | |
| 427(L) | −1340 | −1019 | −3303 | −2788 | −110 | −3122 | −2028 | 1936 | −2461 | 2161 | 988 | −2637 | −2874 | −2038 | −2380 | −2319 | −1277 | 781 | −1493 | −1288 | 482 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −30 | −6178 | −7220 | −894 | −1115 | −1475 | −643 | * | * | | | | | | | | | | | | |
| 428(A) | 996 | −971 | −924 | 841 | −1028 | −1637 | −368 | 796 | −239 | −251 | −142 | 675 | −1717 | −142 | −613 | −33 | −383 | 557 | −1348 | −882 | 483 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −15 | −7202 | −8244 | −894 | −1115 | −137 | −3462 | * | * | | | | | | | | | | | | |
| 429(I) | 1151 | −1159 | −2438 | −631 | 77 | −2505 | −1313 | 1901 | −92 | −1018 | −354 | −1776 | 1747 | −1430 | −1772 | −1536 | −1043 | 561 | −1598 | −1219 | 484 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 430(Q) | 1025 | −2430 | −838 | 1164 | −2741 | −144 | −619 | −1061 | 878 | −2442 | −1522 | 203 | −2052 | 1476 | 325 | −866 | −41 | −346 | −2620 | 236 | 485 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 431(N) | 351 | −2447 | 158 | 275 | −2764 | −782 | 1793 | −2512 | −198 | −80 | −1537 | 1907 | −2050 | 1346 | −99 | −864 | 569 | −2067 | −2632 | −1952 | 486 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 432(K) | −983 | −2449 | 67 | 142 | −2768 | −1958 | 1110 | −2516 | 1671 | −360 | −1539 | −594 | −622 | 1599 | 1436 | −865 | 334 | −883 | −2634 | −1953 | 487 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 433(S) | −1458 | −2150 | −2472 | −2476 | −3880 | 1432 | −2696 | −3646 | −2704 | −880 | −3001 | 42 | −2954 | −2482 | −2971 | 3040 | −1805 | −2869 | −4076 | −3665 | 488 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 434(G) | −1089 | 904 | 851 | −1707 | 768 | 2205 | −1253 | −740 | −1503 | −279 | 1286 | −92 | −2527 | −1318 | −1686 | −1483 | −1029 | −632 | −1617 | 645 | 489 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 435(H) | 818 | −2554 | −999 | −433 | −2894 | −123 | 2729 | −2621 | 956 | −2556 | −1648 | −726 | −235 | 755 | 1964 | −1012 | −1059 | −2189 | −2708 | −2066 | 490 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 436(Q) | −344 | −1587 | −3692 | −3091 | 1883 | −3276 | −2091 | 243 | −2760 | 1475 | −247 | −2787 | −3253 | 2905 | −2674 | −2360 | −1672 | −801 | −1929 | −1608 | 491 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |

TABLE 3-continued

| | | | | | | | | | | | | | | | | | | | | |
|---|---|---|---|---|---|---|---|---|---|---|---|---|---|---|---|---|---|---|---|---|
| 437(E) | −2248 | −2420 | −2316 | 3407 | −2671 | −3394 | −2628 | 379 | −2488 | −1817 | −1617 | −2456 | −3632 | −2387 | −2824 | −2708 | −2279 | 738 | −3560 | −3048 | 492 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 438(R) | 204 | −2356 | −880 | 414 | −2634 | −1980 | 1194 | −2355 | 610 | 446 | −1456 | −633 | −2072 | 1010 | 1766 | −263 | −928 | −735 | −2564 | 773 | 493 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 439(L) | −358 | −1562 | −4144 | −3535 | −1264 | −3440 | −2330 | 1655 | −3166 | 2331 | −351 | −3080 | −3407 | −2740 | −2969 | −2549 | −1736 | 200 | −2069 | 1544 | 494 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 440(K) | −1751 | −3345 | 1209 | 2128 | −3630 | −2309 | −1249 | −3421 | 2410 | −3341 | −2478 | 882 | −2595 | 337 | −1587 | −1558 | −1726 | −2954 | −3510 | −2742 | 495 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 441(Q) | 854 | −2432 | 264 | −308 | −2743 | −1971 | −641 | −2483 | −231 | −2448 | 681 | 1414 | −2070 | 2317 | −737 | 1098 | −280 | −2050 | −2632 | −1958 | 496 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 442(L) | −1684 | −1481 | −3911 | −3303 | −1234 | −3289 | −2179 | 1310 | −2938 | 2230 | −330 | −2893 | −3277 | −217 | −2785 | −2389 | 1516 | 294 | −1986 | −1687 | 497 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 443(I) | 1388 | −1660 | −4350 | −3774 | 339 | −3691 | −2667 | 1898 | −3436 | 1384 | −620 | −3337 | −3648 | −3052 | −3269 | −2821 | −1888 | 1594 | −2412 | −2096 | 498 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 444(N) | −429 | −1301 | −2255 | −1692 | −1310 | −2510 | −1317 | 965 | −1486 | −1142 | 1274 | 3200 | −2583 | 280 | −1696 | −1534 | −1102 | 282 | −1758 | −1363 | 499 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 445(H) | −989 | −2462 | 1140 | 1287 | −2782 | −1959 | 2073 | −2533 | −202 | −2477 | 1021 | 761 | −2054 | 1813 | 414 | 304 | −929 | −2083 | −2645 | −1962 | 500 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 446(Y) | −570 | −3515 | −4109 | −4216 | −224 | −4378 | 3141 | −3593 | −3871 | −3148 | −3048 | −3397 | −4538 | −3440 | −3721 | −3699 | −3833 | −3587 | −932 | 4339 | 501 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8312 | −9354 | −894 | −1115 | −701 | −1378 | * | * | | | | | | | | | | | | |
| 447(L) | −2249 | 853 | −4575 | −3952 | −1251 | −3905 | −2751 | 1774 | −3586 | 2535 | 1585 | −3549 | −3766 | −365 | −3344 | −3026 | −2171 | −949 | −2320 | −2132 | 502 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −183 | −8312 | −3108 | −894 | −1115 | −701 | −1378 | * | * | | | | | | | | | | | | |
| 448(F) | −1766 | −1521 | −4129 | −3513 | 1880 | −3413 | −2296 | 1109 | −3142 | 1880 | 1149 | −3061 | −3355 | −2682 | −2926 | −2524 | −64 | 1400 | −1992 | −1730 | 503 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −152 | −8137 | −3370 | −894 | −1115 | −1459 | −652 | * | * | | | | | | | | | | | | |
| 449(G) | −169 | −2301 | 1066 | 908 | −2620 | 1545 | −453 | −2372 | 447 | −2316 | −1391 | 848 | −1885 | 582 | 351 | 31 | −765 | −1922 | −2484 | −1799 | 504 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −149 | −7993 | −3412 | −894 | −1115 | −1838 | −473 | * | * | | | | | | | | | | | | |
| 450(A) | 1384 | −1474 | −1057 | 562 | −1568 | −1895 | −607 | −94 | 456 | −1390 | −635 | −723 | −1980 | −310 | −804 | −19 | 849 | 1219 | −1821 | −1317 | 505 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −253 | −7853 | −2678 | −894 | −1115 | −2104 | −382 | * | * | | | | | | | | | | | | |
| 451(R) | −58 | 1062 | −1873 | −1289 | −813 | −2052 | −847 | 394 | −1021 | 1151 | −9 | 206 | −2122 | −888 | 2151 | −1078 | −635 | −237 | −1248 | −861 | 506 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −368 | −7612 | −2186 | −894 | −1115 | −2433 | −295 | * | * | | | | | | | | | | | | |
| 452(G) | 887 | −1428 | −559 | −11 | −1592 | 1139 | −219 | −1235 | 94 | −486 | −578 | 661 | −1615 | 151 | 428 | 120 | −400 | −968 | −1734 | 343 | 507 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −296 | −7258 | −2484 | −894 | −1115 | −2747 | −233 | * | * | | | | | | | | | | | | |
| 453(K) | 359 | −1852 | −165 | 1529 | −2167 | −1348 | −26 | −1905 | 1558 | −1860 | −953 | 11 | −1461 | 1054 | −76 | 506 | −357 | −1473 | −2035 | −1367 | 508 |
| — | −147 | −500 | 233 | 43 | −381 | 398 | 105 | −626 | 210 | −465 | −721 | 275 | 394 | 45 | 96 | 359 | 117 | −369 | −295 | −250 | |
| — | −1078 | −936 | −8022 | −95 | −3976 | −125 | −3592 | * | * | | | | | | | | | | | | |

TABLE 3-continued

| | | | | | | | | | | | | | | | | | | | | | |
|---|---|---|---|---|---|---|---|---|---|---|---|---|---|---|---|---|---|---|---|---|---|
| 454(W) | −204 | 887 | 46 | 246 | −204 | −619 | 891 | −475 | 338 | −941 | 659 | 291 | −334 | 598 | 147 | −143 | 7 | −471 | 1260 | 199 | 510 |
| — | −148 | −500 | 233 | 43 | −381 | 399 | 107 | −627 | 211 | −466 | −721 | 276 | 394 | 45 | 96 | 359 | 118 | −369 | −295 | −250 | |
| — | −166 | −3224 | −9354 | −1658 | −550 | −701 | −1378 | * | * | | | | | | | | | | | | |
| 455(W) | −204 | 887 | 46 | 246 | −204 | −619 | 891 | −475 | 338 | −941 | 659 | 291 | −334 | 598 | 147 | −143 | 7 | −471 | 1260 | 199 | 518 |
| — | * | * | * | * | * | * | * | * | * | * | * | * | * | * | * | * | * | * | * | * | |
| — | * | * | * | * | * | * | * | * | 0 | | | | | | | | | | | | |

[1]Program name and version
[2]Name of the input sequence alignment file
[3]Length of the alignment: include indels
[4]Type of residues
[5]Map of the match states to the columns of the alignment
[6]Commands used to generate the file: this one means that hmmbuild (default parameters) was applied to the alignment file
[7]Commands used to generate the file: this one means that hmmcalibrate (default parameters) was pplied to the hmm profile
[8]Number of sequences in the alignment
[9]When the file was generated
[10]The trasition probability distribution for the null model (single G state).
[11]The symbol emission probability distribution for the null model (G tate); consists of K integers. The null probability used to convert these back to model probabilities is 1/K.
[12]The extreme value distribution parameters μ and lambda respectively, both floating point values. Lambda is positive and nonzero. These values are set when the model is calibrated with hmmcalibrate.

TABLE 4

HMMER2.0 [2.2 g][1]
NAME rpiA__exp__ver__seqs__aln__new[2]
LENG 253[3]
ALPH Amino[4]
MAP yes[5]
COM /app/public/hmmer/current/bin/hmmbuild rpiA__exp__ver__seqs__aln__new__hmm rpiA__exp__ver__seqs__aln__new.aln[6]
COM /app/public/hmmer/current/bin/hmmcalibrate rpiA__exp__ver__seqs__aln__new__hmm[7]
NSEQ 15[8]
DATE Sat Jan 16 09:55:05 2010[9]
XT −8455 −4 −1000 −1000 −8455 −4 −8455 −4
NULT −4 −8455[10]
NULE 595 −1558 85 338 −294 453 −1158 197 249 902 −1085 −142 −21 −313 45 531 201 384 −1998 −644[11]
EVD −207.921417 0.159331[12]

| HMM | A<br>m->m | C<br>m->i | D<br>m->d | E<br>i->m | F<br>i->i | G<br>d->m | H<br>d->d | I<br>b->m | K<br>m->e | L | M | N | P | Q | R | S | T | V | W | Y | |
|---|---|---|---|---|---|---|---|---|---|---|---|---|---|---|---|---|---|---|---|---|---|
| | −230 | * | −2761 | | | | | | | | | | | | | | | | | | |
| 1(P) | −737 | −726 | −2336 | −1756 | −665 | −2165 | −1015 | −235 | −1488 | 712 | 69 | −1565 | 2093 | −1249 | −1544 | 305 | −688 | 847 | −1150 | 1747 | 1 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −11 | −7657 | −8699 | −894 | −1115 | −701 | −1378 | −230 | * | | | | | | | | | | | | |
| 2(E) | −896 | −2357 | −337 | 1937 | −2694 | 686 | −508 | −2450 | −163 | −2405 | −1508 | −359 | 1381 | 1232 | −689 | 490 | −857 | −2002 | −2585 | −1884 | 2 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −11 | −7657 | −8699 | −894 | −1115 | −701 | −1378 | * | * | | | | | | | | | | | | |
| 3(T) | 776 | −1568 | −848 | −299 | −1788 | −1722 | −484 | −1424 | −182 | −181 | −788 | −539 | 400 | −126 | 1155 | 829 | 1334 | −1155 | −1948 | −1403 | 3 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −164 | −7657 | −3284 | −894 | −1115 | −701 | −1378 | * | * | | | | | | | | | | | | |
| 4(M) | −722 | −907 | −1742 | 801 | −904 | −2057 | −841 | −449 | −989 | 571 | 2667 | −1198 | 409 | −831 | −1222 | 254 | −664 | 1036 | −1329 | −929 | 4 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −470 | −1847 | * | * | | | | | | | | | | | | |
| 5(M) | −854 | −1678 | −1050 | 768 | −1792 | 350 | −656 | −1412 | −393 | 839 | 1786 | 1317 | −2043 | 938 | −829 | −899 | −793 | 175 | −2001 | −1473 | 5 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −8 | −8026 | −9069 | −894 | −1115 | −701 | −1378 | * | * | | | | | | | | | | | | |
| 6(M) | 1489 | −1440 | −2497 | −1913 | −1434 | −2652 | −1456 | −980 | −1560 | 1063 | 3173 | 713 | −2731 | −1485 | 475 | −1692 | −1258 | −881 | −1874 | −1492 | 6 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8494 | −9536 | −894 | −1115 | −701 | −1378 | * | * | | | | | | | | | | | | |
| 7(P) | −1584 | −2285 | −2925 | −2913 | −4391 | −2437 | −3074 | −4165 | −3104 | −4334 | −3436 | 781 | 2689 | −2852 | −3344 | 1622 | 2304 | −3192 | −4531 | −4184 | 7 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8494 | −9536 | −894 | −1115 | −701 | −1378 | * | * | | | | | | | | | | | | |
| 8(Q) | −1529 | −1399 | −3529 | −2918 | −1266 | −3053 | −1906 | 710 | −2581 | 1247 | 2483 | 397 | −3086 | 2619 | −2501 | −2127 | −1468 | 501 | −1851 | −1517 | 8 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 9(D) | −3187 | −5226 | 2990 | 2718 | −5370 | −2929 | −2384 | −5371 | −2804 | −5200 | −4638 | −1518 | 637 | −2077 | −3812 | −2793 | −3290 | −4804 | −5388 | −4266 | 9 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 10(E) | −2442 | −4166 | 1948 | 2627 | −4408 | 189 | −1849 | −4252 | −1830 | −4154 | −3356 | −1303 | −3115 | 1028 | −2521 | 981 | −2456 | −3759 | −4336 | −3463 | 10 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 11(M) | 943 | −1386 | −3607 | −2981 | −1221 | −3043 | −1881 | −775 | −2556 | 2149 | 2228 | −2596 | −3078 | −2268 | 405 | −2123 | −1463 | −762 | −1801 | 1047 | 11 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |

TABLE 4-continued

| | | | | | | | | | | | | | | | | | | | | | |
|---|---|---|---|---|---|---|---|---|---|---|---|---|---|---|---|---|---|---|---|---|---|
| 12(K) | 169 | -3490 | -3589 | -3166 | -5083 | -3480 | -2618 | -4660 | 3794 | -4506 | -3835 | -2964 | -3899 | -2271 | -1432 | -2981 | -3039 | -4100 | -4333 | -4249 | 12 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -6 | -8606 | -9649 | -894 | -1115 | -701 | -1378 | * | * | | | | | | | | | | | | |
| 13(K) | -3239 | -3946 | -3896 | -2586 | -4772 | 115 | -1733 | -4104 | 3369 | -455 | -3105 | -2492 | -3753 | -1313 | 1582 | -3127 | -2940 | -3870 | -3649 | -3533 | 13 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -6 | -8606 | -9649 | -894 | -1115 | -701 | -1378 | * | * | | | | | | | | | | | | |
| 14(I) | 1509 | -2463 | -1132 | 514 | -2708 | -35 | -865 | 1583 | 582 | -861 | -1574 | -873 | -2292 | 670 | 608 | -1119 | -1135 | -2044 | -2692 | -2064 | 14 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -6 | -8606 | -9649 | -894 | -1115 | -701 | -1378 | * | * | | | | | | | | | | | | |
| 15(A) | 3213 | -2363 | -4869 | -5046 | -4146 | -2886 | -4289 | -2125 | -4791 | -3574 | -3168 | -3587 | -3630 | -4386 | -4544 | -2261 | -2328 | 1716 | -4821 | -4601 | 15 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -6 | -8606 | -9649 | -894 | -1115 | -701 | -1378 | * | * | | | | | | | | | | | | |
| 16(A) | 3284 | -2506 | -4607 | -4949 | -5111 | 1562 | -4350 | -4970 | -4949 | -5213 | -4291 | -3502 | -3559 | -4436 | -4658 | -2168 | -2389 | -3707 | -5210 | -5250 | 16 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -6 | -8606 | -9649 | -894 | -1115 | -701 | -1378 | * | * | | | | | | | | | | | | |
| 17(W) | -1293 | -1726 | -1890 | -43 | 736 | -2518 | 1428 | -1343 | 1054 | -1609 | -900 | -1471 | -2593 | -1075 | -1526 | 156 | -1233 | 353 | 3270 | 2559 | 17 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -6 | -8606 | -9649 | -894 | -1115 | -701 | -1378 | * | * | | | | | | | | | | | | |
| 18(K) | 1539 | -2931 | -1365 | 1110 | -3311 | 17 | -1038 | -3017 | 2042 | -2929 | -2039 | -1095 | -2543 | -588 | 1487 | -1418 | -1461 | -2592 | -3051 | -2448 | 18 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -6 | -8606 | -9649 | -894 | -1115 | -701 | -1378 | * | * | | | | | | | | | | | | |
| 19(A) | 3342 | 2232 | -4964 | -5274 | -4911 | 359 | -4286 | -4696 | -4933 | -4984 | -4038 | -3392 | -3380 | -4389 | -4561 | -1937 | -2154 | -3450 | -5135 | -5108 | 19 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -6 | -8606 | -9649 | -894 | -1115 | -701 | -1378 | * | * | | | | | | | | | | | | |
| 20(V) | 116 | -1749 | -4396 | -3834 | -1888 | 940 | -2760 | 904 | -3499 | 980 | -991 | -3381 | -3735 | -3170 | -3361 | -2847 | -1962 | 2618 | -2595 | -2237 | 20 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -6 | -8606 | -9649 | -894 | -1115 | -701 | -1378 | * | * | | | | | | | | | | | | |
| 21(K) | 96 | -2683 | 1087 | 1620 | -3002 | -25 | -837 | -2753 | 1918 | -468 | -1775 | -799 | -2267 | 841 | -934 | -1087 | -1150 | -2304 | -2867 | -2182 | 21 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -6 | -8606 | -9649 | -894 | -1115 | -701 | -1378 | * | * | | | | | | | | | | | | |
| 22(Y) | -1358 | -1336 | -2944 | -2345 | 1772 | -2797 | -1583 | -854 | 291 | -31 | 1632 | -2161 | -2854 | -1821 | 421 | -327 | -1297 | -762 | -1716 | 3221 | 22 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -6 | -8606 | -9649 | -894 | -1115 | -701 | -1378 | * | * | | | | | | | | | | | | |
| 23(V) | 49 | -2304 | -5310 | -4886 | 865 | -4900 | -4331 | 1688 | -4706 | -1790 | -1614 | -4565 | -4771 | -4499 | -4702 | -4149 | -2706 | 3181 | -3977 | -3543 | 23 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -6 | -8606 | -9649 | -894 | -1115 | -701 | -1378 | * | * | | | | | | | | | | | | |
| 24(Q) | -2247 | -3872 | 861 | 1799 | -4155 | -2664 | -1668 | -3953 | 1967 | -3853 | -3025 | -1269 | -3002 | 3006 | -1994 | -2025 | -2231 | -3484 | -4010 | -3228 | 24 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -6 | -8606 | -9649 | -894 | -1115 | -701 | -1378 | * | * | | | | | | | | | | | | |
| 25(D) | -2501 | -4054 | 2742 | -1070 | -4562 | -2747 | -2018 | -4408 | 73 | -4325 | -3550 | -1429 | 282 | -1657 | -2695 | 2457 | -2567 | -3871 | -4505 | -3648 | 25 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -6 | -8606 | -9649 | -894 | -1115 | -701 | -1378 | * | * | | | | | | | | | | | | |
| 26(G) | -3037 | -4879 | 844 | -1122 | -5169 | 3241 | 1798 | -5175 | -2686 | -5034 | -4423 | 896 | -3469 | -2028 | -3602 | -2695 | -3147 | -4601 | -5204 | -4139 | 26 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -6 | -8606 | -9649 | -894 | -1115 | -701 | -1378 | * | * | | | | | | | | | | | | |
| 27(M) | -1469 | 2013 | -3003 | -2471 | -2046 | -2661 | -1984 | -1596 | 409 | -1917 | 4312 | -2265 | -2961 | -2007 | -2198 | -161 | 1213 | -1418 | -2455 | -2088 | 27 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -6 | -8606 | -9649 | -894 | -1115 | -701 | -1378 | * | * | | | | | | | | | | | | |
| 28(V) | -2412 | -2097 | -4795 | -4276 | -2457 | -4302 | -3498 | 2310 | -3835 | -1736 | -1426 | -3927 | -4279 | -3728 | 1385 | -3488 | 351 | 2653 | -3372 | -2980 | 28 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -6 | -8606 | -9649 | -894 | -1115 | -701 | -1378 | * | * | | | | | | | | | | | | |

TABLE 4-continued

| | | | | | | | | | | | | | | | | | | | | | |
|---|---|---|---|---|---|---|---|---|---|---|---|---|---|---|---|---|---|---|---|---|---|
| 29(I) | −2696 | −2288 | −5253 | −4805 | −2613 | 12 | −4162 | 2603 | −4599 | 965 | −1484 | −4475 | −4685 | −4347 | −4561 | −4044 | −2671 | 2370 | −3804 | −3421 | 29 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 30(G) | −5249 | −4846 | −5805 | −6182 | −6521 | 3848 | −5650 | −7348 | −6455 | −6931 | −6666 | −5891 | −5413 | −6249 | −6011 | −5566 | −5614 | −6629 | −5452 | −6497 | 30 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 31(L) | 37 | −2467 | −5417 | −4944 | −2323 | −4975 | −4218 | 1048 | −4726 | 2497 | −1169 | −4643 | −4761 | −4320 | −4618 | −4207 | −2845 | 1769 | −3670 | −3419 | 31 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 32(G) | −5249 | −4846 | −5805 | −6182 | −6521 | 3848 | −5650 | −7348 | −6455 | −6931 | −6666 | −5891 | −5413 | −6249 | −6011 | −5566 | −5614 | −6629 | −5452 | −6497 | 32 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 33(T) | −1742 | −2395 | −3358 | −3587 | −4782 | −2578 | −3671 | −4600 | −3940 | −4815 | −3908 | 840 | −3343 | −3566 | −4000 | 1239 | 3538 | −3465 | −4970 | −4726 | 33 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 34(G) | −2161 | −2733 | −4416 | −4762 | −5231 | 3632 | −4392 | −5148 | −4912 | −5359 | −4485 | −3619 | −3739 | −4472 | −4692 | −2409 | 608 | −3930 | −5223 | −5307 | 34 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 35(S) | −2873 | −3334 | −4781 | −5130 | −5373 | −3522 | −4723 | −5714 | −5297 | −5786 | −5056 | −4198 | −4255 | −4941 | −5056 | 3723 | −3329 | −4590 | −5178 | −5309 | 35 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 36(T) | −3493 | −3798 | −5272 | −5603 | −5670 | −3975 | −5053 | −5807 | −5594 | −5903 | −5378 | −4752 | −4656 | −5368 | −5298 | −3760 | 4069 | −4969 | −5264 | −5668 | 36 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 37(A) | 2501 | −2145 | −4938 | −4524 | −2662 | −4096 | −3781 | 1043 | −4277 | −1902 | −1607 | −4013 | −4259 | −4022 | −4221 | −3341 | 283 | 2230 | −3629 | −3236 | 37 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 38(A) | 1970 | 1799 | −1743 | −1181 | 624 | −2445 | −1173 | −1434 | 1352 | −1689 | −962 | 288 | −2526 | −945 | 436 | −1413 | −1196 | 338 | −2161 | −1697 | 38 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 39(H) | −4508 | −3790 | −5387 | −5470 | 1683 | −5200 | 3664 | −3594 | −5055 | −299 | −3093 | −3993 | 617 | −4051 | −4592 | −4400 | −4398 | −3664 | −1018 | 3609 | 39 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 40(F) | 1988 | −1682 | −4234 | −3615 | 2416 | −3501 | −2380 | −678 | −3235 | 314 | 1738 | −3145 | −3486 | −2808 | −3032 | −2603 | −1835 | 1303 | −2141 | −1841 | 40 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 41(V) | 101 | −2050 | −4873 | −4368 | −2350 | −4322 | −3494 | 2224 | −4095 | −23 | −1334 | −3975 | 459 | −3818 | −4011 | −3497 | −2359 | 2700 | −3265 | −2882 | 41 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 42(D) | −199 | −2647 | 1670 | 1649 | −2967 | −2145 | −806 | −2718 | 613 | −586 | −1737 | 777 | −2240 | −347 | 505 | 732 | −1114 | −2269 | −2831 | −2148 | 42 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 43(R) | 551 | −2283 | −1313 | 1080 | −2461 | −2298 | −969 | −2110 | −600 | −480 | −1419 | −1024 | −2387 | −583 | 2635 | −1234 | 447 | −1829 | −2558 | 937 | 43 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 44(I) | −4159 | −3553 | −6565 | −5989 | −1742 | −6358 | −5051 | 2598 | −5794 | 2452 | 1878 | −6079 | −5396 | −4572 | −5288 | −5733 | −4007 | −1733 | −3572 | −3789 | 44 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 45(G) | 946 | −3028 | 669 | −1058 | −3786 | 2588 | −1624 | −3558 | 551 | −3534 | −2655 | −1340 | −2817 | −1217 | −1911 | 814 | −1831 | −3015 | −3719 | −3026 | 45 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |

TABLE 4-continued

| | | | | | | | | | | | | | | | | | | | | | |
|---|---|---|---|---|---|---|---|---|---|---|---|---|---|---|---|---|---|---|---|---|---|
| 46(Q) | −1298 | −2751 | −1122 | 1954 | −3088 | −2248 | −885 | −2826 | 726 | −2758 | −1843 | 1435 | −2342 | 2103 | 593 | −1176 | 850 | −2383 | −2910 | −2251 | 46 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −185 | −8606 | −3083 | −894 | −1115 | −701 | −1378 | * | * | | | | | | | | | | | | |
| 47(R) | 283 | −1953 | −1693 | −1097 | −2055 | 115 | −1074 | −1648 | 625 | 1378 | −1117 | −1278 | −2505 | −786 | 1948 | −1413 | −1239 | −1458 | −2268 | 1170 | 47 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8427 | −9469 | −894 | −1115 | −1600 | −578 | * | * | | | | | | | | | | | | |
| 48(L) | −2911 | −2569 | −5151 | 303 | 1149 | −4652 | −3420 | 1605 | −4248 | 2578 | −352 | −4269 | −4351 | −3576 | −3981 | −3811 | −2817 | −1280 | −2759 | −2609 | 48 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8427 | −9469 | −894 | −1115 | −1600 | −578 | * | * | | | | | | | | | | | | |
| 49(K) | −1564 | −2916 | −1478 | 645 | −3330 | −2470 | 1776 | −3006 | 2205 | −2887 | −2013 | −1109 | −2537 | 1193 | 2170 | −71 | −1467 | −2594 | −2975 | −2424 | 49 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8427 | −9469 | −894 | −1115 | −333 | −2277 | * | * | | | | | | | | | | | | |
| 50(M) | 651 | −2637 | 567 | 1694 | −2956 | −2140 | −799 | −2706 | −380 | −2652 | 1818 | 777 | −2234 | 670 | 506 | 212 | 437 | −2258 | −2821 | −2139 | 50 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 51(W) | −246 | 982 | 39 | 198 | −144 | −596 | 928 | −456 | 289 | −954 | 709 | 281 | −285 | 575 | 131 | −180 | −17 | −477 | 1369 | 255 | 51 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 52(G) | −1840 | −3290 | −1005 | 1266 | −3716 | 2571 | −1423 | −3480 | 1230 | −3415 | −2544 | −1185 | 523 | −1002 | −1594 | −140 | −1825 | −3009 | −3580 | −2871 | 52 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 53(K) | −2019 | −3475 | −1064 | 1977 | −3902 | 872 | −1515 | −3655 | 2684 | −3564 | −2713 | −1281 | −2892 | −1099 | −1547 | 214 | −1995 | −3192 | −3702 | −3015 | 53 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 54(L) | −2125 | −1933 | −4188 | −360 | 979 | −3693 | −2514 | 1391 | −3240 | 2496 | −450 | −3247 | −3638 | 472 | −3100 | −2790 | −2053 | −1108 | −2268 | −1993 | 54 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 55(K) | 169 | −2564 | −1050 | 285 | −2852 | −2157 | 1513 | 583 | 1919 | −2566 | −1662 | −805 | −2249 | 692 | −913 | 147 | 883 | −2168 | −2767 | 905 | 55 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −452 | −8606 | −1909 | −894 | −1115 | −701 | −1378 | * | * | | | | | | | | | | | | |
| 56(D) | −2633 | −4616 | 2798 | 1104 | −4766 | 1497 | −1872 | −4720 | −2192 | −4570 | −3939 | 2177 | −3037 | −1549 | −3116 | −2268 | −2714 | −4175 | −4770 | −3697 | 56 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −8 | −8162 | −9204 | −894 | −1115 | −201 | −2945 | * | * | | | | | | | | | | | | |
| 57(I) | −1788 | −1923 | −2876 | −34 | −2012 | −3091 | −1729 | 2383 | 146 | −1745 | −1130 | −2188 | −3132 | −1628 | 630 | −2165 | −1708 | 2312 | −2394 | −2024 | 57 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 58(V) | 950 | −1303 | −3775 | −3161 | 749 | 481 | −1956 | 1236 | −2782 | −1142 | −531 | −2677 | −3091 | −2425 | −2614 | −2126 | 478 | 2311 | −1840 | −1493 | 58 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −254 | −8606 | −2657 | −894 | −1115 | −701 | −1378 | * | * | | | | | | | | | | | | |
| 59(G) | 1097 | 2397 | −4641 | −4884 | −4602 | 3072 | −3964 | −4394 | −4563 | −4663 | −3717 | −3098 | −3108 | −4043 | −4241 | 663 | −1876 | −3167 | −4840 | −4782 | 59 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8359 | −9402 | −894 | −1115 | −282 | −2492 | * | * | | | | | | | | | | | | |
| 60(V) | −3033 | −2523 | −5726 | −5424 | −3217 | −5556 | −5669 | 2753 | −5400 | −1961 | −1904 | −5240 | −5307 | −5371 | −5582 | −4951 | −3030 | 3063 | −5010 | −4474 | 60 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 61(P) | −2379 | −3335 | −1479 | 534 | −4966 | −2801 | −2763 | −4855 | −2948 | −4880 | −4125 | −2019 | 3631 | −2490 | −3505 | 1442 | −2680 | −4001 | −5009 | −4336 | 61 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 62(T) | −1747 | −2400 | −3347 | −3588 | −4790 | −2581 | −3681 | −4611 | −3958 | −4826 | −3921 | 841 | −3347 | −3581 | −4014 | 849 | 3623 | −3472 | −4980 | −4736 | 62 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |

TABLE 4-continued

| | | | | | | | | | | | | | | | | | | | | | |
|---|---|---|---|---|---|---|---|---|---|---|---|---|---|---|---|---|---|---|---|---|---|
| 63(S) | −1904 | −2581 | −2882 | −3144 | −4596 | 354 | 1785 | −4698 | −3630 | −4845 | −3985 | −2780 | −3416 | −3330 | −3787 | 3370 | −2324 | −3611 | −4803 | −4364 | 63 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 64(W) | −1305 | −1269 | −49 | −2357 | 2148 | −2761 | −1589 | 1112 | 541 | −1124 | −466 | −2157 | −2819 | −1834 | 306 | −1811 | 53 | 1055 | 2259 | 963 | 64 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 65(Q) | 1055 | −2636 | 499 | 528 | −2956 | −2140 | −799 | −2705 | 391 | −500 | −1725 | −776 | −2233 | 1686 | 1507 | 253 | 37 | −2257 | −2820 | −2138 | 65 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 66(T) | 1634 | −2258 | −4701 | −4919 | −4847 | −2541 | −4146 | −4631 | −4680 | −4902 | −3957 | −3298 | −3344 | −4195 | −4415 | 1536 | 3130 | −3409 | −5076 | −5002 | 66 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 67(K) | −171 | −2654 | −1044 | 1165 | −2977 | −2164 | 1013 | −2723 | 1667 | −2667 | −1744 | −800 | −2256 | 668 | 1361 | −1073 | 1426 | −2278 | −2833 | 365 | 67 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 68(E) | −1375 | −2585 | −1158 | 2308 | −2791 | −2325 | −1026 | −2474 | −645 | 884 | 1250 | 799 | −2444 | 1760 | −1110 | −1302 | −1316 | −2150 | −2817 | −2202 | 68 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 69(Q) | −2625 | −3132 | −3243 | −2304 | −2997 | −3502 | −1672 | −2796 | 1761 | 1816 | −2138 | −2292 | −3490 | 2657 | −650 | −2681 | −2442 | −2718 | 2444 | −2596 | 69 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 70(A) | 2473 | 2023 | −4541 | −3996 | −1860 | −3722 | −2896 | 1588 | −3650 | 1105 | −917 | −3494 | −3791 | −3269 | −3484 | −2883 | −2090 | −455 | −2677 | −2364 | 70 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 71(M) | −163 | −1413 | −2467 | −184 | −1401 | −2662 | −1451 | 1231 | 941 | 1253 | 1459 | −1863 | −2726 | −1500 | 1249 | −1682 | −1234 | 130 | −1839 | −1450 | 71 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 72(S) | −132 | −2663 | 576 | 1175 | −2984 | −2154 | −818 | −2735 | 664 | −2679 | −1753 | −789 | −2251 | 1678 | 545 | 1847 | −1129 | −2285 | −2845 | −2162 | 72 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 73(L) | −1356 | −2091 | −1474 | 385 | −2077 | −2434 | 1400 | −1797 | −948 | 1932 | −1251 | 741 | −2540 | −869 | −1365 | 189 | −1298 | −1590 | −2351 | 1829 | 73 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 74(G) | −3022 | −4956 | 843 | 559 | −5144 | 3241 | −2261 | −5081 | 488 | −4930 | −4294 | −1476 | −3437 | −1936 | −3360 | −2665 | −3099 | −4543 | −5117 | −4079 | 74 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 75(I) | −3760 | −3207 | −6240 | −5795 | −2030 | −6009 | −5114 | 3491 | −5625 | 1544 | −811 | −5748 | −5357 | −4747 | −5322 | −5422 | −3681 | −963 | −3819 | −3848 | 75 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 76(P) | −2101 | −3282 | −1794 | −1339 | −3744 | −2873 | 578 | −3375 | 489 | −3279 | −2468 | −1559 | 3420 | 1078 | −804 | −1992 | 838 | −3013 | −3367 | −2886 | 76 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 77(L) | −3556 | −3020 | −6109 | −5654 | −2129 | −5886 | −5095 | 1390 | −5518 | 2765 | −891 | −5573 | −5293 | −4749 | −5286 | −5238 | −3487 | 1330 | −3904 | −3921 | 77 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 78(S) | 637 | −1674 | −2006 | −1449 | 1219 | 13 | −1333 | −1332 | 426 | −1615 | −906 | −1557 | −2615 | −1182 | −1625 | 1757 | 430 | 993 | −2120 | −1685 | 78 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 79(D) | −1806 | −3240 | 2835 | 629 | −3592 | −2475 | −1415 | −3345 | −1173 | −3327 | −2466 | −1143 | −2741 | −1003 | −1736 | 964 | 1574 | −398 | −3534 | −2811 | 79 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |

TABLE 4-continued

| | | | | | | | | | | | | | | | | | | | | | |
|---|---|---|---|---|---|---|---|---|---|---|---|---|---|---|---|---|---|---|---|---|---|
| 80(L) | −3783 | 1558 | −6171 | −5577 | −1700 | −5769 | −4529 | 789 | −5319 | 2913 | 1869 | −5467 | −5104 | −4311 | −4901 | −5031 | −3656 | −1664 | −3378 | −3488 | 80 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 81(D) | −2988 | −4951 | 3191 | 1435 | −5107 | 233 | −2239 | −5050 | −2530 | −4905 | −4255 | 1432 | 516 | −1912 | −3432 | −2631 | −3062 | −4510 | −5103 | −4047 | 81 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 82(E) | −199 | −2647 | 182 | 1998 | −2968 | −2144 | −805 | −2719 | 666 | −2663 | −1736 | −779 | 233 | 1687 | 617 | 713 | −1113 | −2269 | −2830 | −2147 | 82 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 83(H) | −1636 | −2253 | −1701 | 345 | −1931 | −2676 | 3730 | −1933 | −1146 | −2136 | −1426 | −1506 | −2794 | 509 | −1481 | −1727 | −1574 | 1746 | −2290 | 1947 | 83 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 84(P) | −130 | −2884 | 1913 | −1849 | −4557 | 177 | −2566 | −4373 | −2611 | −4425 | −3568 | −1983 | 3043 | −2250 | −3137 | 1124 | −2248 | −3531 | −4610 | −3997 | 84 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −228 | −8606 | −2799 | −894 | −1115 | −701 | −1378 | * | * | | | | | | | | | | | | |
| 85(H) | 205 | −2492 | −882 | 1369 | −2809 | −2006 | 1655 | −2556 | 559 | −2506 | −1583 | 870 | −2099 | −206 | 1522 | 468 | −970 | 403 | −2677 | −1998 | 85 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8385 | −9427 | −894 | −1115 | −299 | −2417 | * | * | | | | | | | | | | | | |
| 86(I) | −3224 | −2707 | −5857 | −5478 | −2594 | −5663 | −5269 | 2819 | −5394 | 1787 | −1334 | −5328 | −5265 | −4992 | −5371 | −5020 | −3192 | 1785 | −4337 | −4130 | 86 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 87(D) | −3875 | −4833 | 4046 | −2276 | −5882 | −17 | −3426 | −6149 | −3929 | −5938 | −5452 | −2631 | −4258 | −3213 | −4722 | −3665 | −4079 | −5478 | −5444 | −5121 | 87 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 88(I) | −3346 | −2848 | −5896 | −5433 | −2183 | −5600 | −4817 | 2575 | −5270 | 1760 | 1774 | −5271 | −5138 | −4629 | −5085 | −4902 | −3286 | 1748 | −3845 | −3780 | 88 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 89(A) | 2412 | 2004 | −3508 | −2967 | −1606 | −2730 | −2026 | −1145 | −2653 | −1500 | −839 | −2515 | −2981 | −2346 | −2595 | 433 | 476 | 526 | −2086 | 1664 | 89 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 90(I) | −3029 | −2537 | −5660 | −5302 | 1731 | −5418 | −4966 | 3297 | −5207 | −1645 | −1625 | −5066 | −5155 | −4983 | −5255 | −4749 | −3011 | 1800 | −4310 | −3807 | 90 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 91(D) | −5403 | −5247 | 4201 | −3898 | −6360 | −4647 | −4682 | −7143 | −5306 | −6710 | −6481 | −4228 | −5165 | −4724 | −5628 | −5311 | −5571 | −6677 | −5444 | −5968 | 91 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 92(G) | −5249 | −4846 | −5805 | −6182 | −6521 | 3848 | −5650 | −7348 | −6455 | −6931 | −6666 | −5891 | −5413 | −6249 | −6011 | −5566 | −5614 | −6629 | −5452 | −6497 | 92 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 93(A) | 3485 | −2326 | −4694 | −5003 | −4905 | −2605 | −4239 | −4596 | −4794 | −4945 | −4047 | −3372 | −3411 | −4314 | −4490 | −1981 | 567 | −3438 | −5129 | −5076 | 93 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 94(D) | −5403 | −5247 | 4201 | −3898 | −6360 | −4647 | −4682 | −7143 | −5306 | −6710 | −6481 | −4228 | −5165 | −4724 | −5628 | −5311 | −5571 | −6677 | −5444 | −5968 | 94 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 95(E) | −5429 | −5227 | −3611 | 3948 | −6343 | −4680 | −4698 | −7062 | −5156 | −6644 | −6413 | −4312 | −5188 | −4740 | −5393 | −5360 | −5587 | −6630 | −5420 | −5964 | 95 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 96(V) | −3033 | −2523 | −5726 | −5424 | −3217 | −5555 | −5668 | 2643 | −5400 | −1961 | −1904 | −5239 | −5306 | −5370 | −5581 | −4949 | −3030 | 3136 | −5009 | −4473 | 96 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |

TABLE 4-continued

| | | | | | | | | | | | | | | | | | | | | | |
|---|---|---|---|---|---|---|---|---|---|---|---|---|---|---|---|---|---|---|---|---|---|
| 97(D) | −6 | −5112 | 3589 | 565 | −5264 | −2894 | −2320 | −5237 | −2694 | −5079 | −4481 | 1439 | −3470 | −2006 | −3663 | −2720 | −3193 | −4680 | −5282 | −4176 | 97 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 98(P) | 804 | −2571 | −1486 | 1220 | −3189 | 876 | −1637 | −2859 | −1407 | −376 | −2177 | −1471 | 2820 | −1281 | −1874 | −1625 | −1682 | −2469 | −3304 | −2730 | 98 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 99(N) | −205 | −2652 | 1485 | −493 | −105 | −114 | 1258 | −2705 | −428 | −2663 | −1746 | 2523 | −2265 | 1041 | −936 | −1085 | 326 | −2268 | −2842 | −2164 | 99 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 100(L) | −3639 | −3200 | −5894 | −5269 | 1023 | −5456 | −4056 | −1167 | −4824 | 2795 | 1608 | −5071 | −4913 | −4047 | 1212 | −4670 | −3510 | −1887 | −3119 | −3039 | 100 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 101(N) | 92 | −2719 | 216 | 355 | 350 | −2197 | −889 | −2773 | −493 | −2730 | −1816 | 2867 | −2312 | 1644 | −1006 | −1141 | 440 | −2334 | −2909 | −2225 | 101 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 102(W) | −246 | 982 | 39 | 198 | −144 | −596 | 928 | −456 | 289 | −954 | 709 | 281 | −285 | 575 | 131 | −180 | −17 | −477 | 1369 | 255 | 102 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 103(L) | −3490 | 2064 | −5882 | −5291 | −1694 | −5373 | −4208 | −978 | −5002 | 2833 | 2334 | −5074 | −4889 | −4137 | −4644 | −4594 | −3387 | 66 | −3257 | −3288 | 103 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 104(I) | −3039 | −2533 | −5727 | −5426 | −3184 | −5538 | −5636 | 3576 | −5395 | −1926 | −1879 | −5235 | −5297 | −5348 | −5564 | −4933 | −3037 | 1922 | −4967 | −4448 | 104 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 105(K) | −5328 | −4974 | −5211 | −4878 | −6129 | −4874 | −4145 | −6424 | 4029 | −5979 | −5562 | −4797 | −5200 | −3978 | −3061 | −5417 | −5268 | −6124 | −5037 | −5529 | 105 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 106(G) | −5249 | −4846 | −5805 | −6182 | −6521 | 3848 | −5650 | −7348 | −6455 | −6931 | −6666 | −5891 | −5413 | −6249 | −6011 | −5566 | −5614 | −6629 | −5452 | −6497 | 106 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 107(R) | −2636 | −3198 | −3874 | −3158 | −4390 | 2550 | −2437 | −4040 | −1266 | −3942 | 1570 | −2880 | −3743 | −2106 | 3016 | −2763 | −2767 | −3611 | −3984 | −3796 | 107 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 108(G) | −5249 | −4846 | −5805 | −6182 | −6521 | 3848 | −5650 | −7348 | −6455 | −6931 | −6666 | −5891 | −5413 | −6249 | −6011 | −5566 | −5614 | −6629 | −5452 | −6497 | 108 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 109(G) | 2252 | −2525 | −4568 | −4913 | −5126 | 3079 | −4351 | −4991 | −4948 | −5230 | −4310 | −3506 | −3573 | −4435 | −4665 | −2186 | −2407 | −3727 | −5216 | −5259 | 109 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 110(C) | 2793 | 4147 | −4964 | −5261 | −4862 | −2544 | −4256 | −4638 | −4898 | −4930 | −3986 | −3366 | −3355 | −4357 | −4530 | 672 | −2123 | −3409 | −5104 | −5057 | 110 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 111(L) | −4311 | −3952 | −5060 | −5019 | −1868 | −5013 | 2699 | −2439 | −4294 | 3063 | −1762 | −4672 | −5079 | −4226 | −4142 | −4791 | −4305 | −3086 | −2839 | −2000 | 111 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 112(T) | 164 | −1449 | −3931 | −3315 | 932 | −3182 | −2099 | −660 | −2935 | 1773 | −491 | −2835 | −3223 | −2550 | −2754 | −2281 | 2260 | 597 | −1938 | −1612 | 112 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 113(R) | −2890 | −3436 | −3581 | −2475 | −3522 | −3676 | −1754 | −3027 | −525 | −186 | 1460 | −2430 | −3634 | 2800 | 3084 | −2906 | −2666 | −3028 | −3334 | −3116 | 113 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |

TABLE 4-continued

| | | | | | | | | | | | | | | | | | | | | | |
|---|---|---|---|---|---|---|---|---|---|---|---|---|---|---|---|---|---|---|---|---|---|
| 114(E) | −5429 | −5227 | −3611 | 3948 | −6343 | −4680 | −4698 | −7062 | −5156 | −6644 | −6413 | −4312 | −5188 | −4740 | −5393 | −5360 | −5587 | −6630 | −5420 | −5964 | 114 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 115(K) | −5328 | −4974 | −5211 | −4878 | −6129 | −4874 | −4145 | −6424 | 4029 | −5979 | −5562 | −4797 | −5200 | −3978 | −3061 | −5417 | −5268 | −6124 | −5037 | −5529 | 115 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 116(I) | −3952 | −3380 | −6396 | −5850 | −1816 | −6157 | −4982 | 3216 | −5657 | 1173 | 3054 | −5863 | −5334 | −4575 | −5231 | −5508 | −3828 | −1412 | −3614 | −3770 | 116 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 117(V) | −3031 | −2523 | −5722 | −5421 | −3211 | −5544 | −5655 | 2189 | −5395 | −1957 | −1901 | −5233 | −5300 | −5363 | −5573 | −4938 | −3029 | 3361 | −4999 | −4465 | 117 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 118(E) | 1970 | −3440 | 671 | 2293 | −3739 | −2490 | −1412 | −3525 | −1174 | −3457 | −2584 | −1111 | −2758 | 1033 | −1753 | 247 | −1851 | −3060 | −3634 | −2874 | 118 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 119(Y) | 479 | −1939 | −1580 | −1027 | −2064 | 986 | −1121 | −1671 | −906 | −1890 | 979 | −1235 | −2471 | −829 | 456 | 1294 | 1228 | −1462 | −2320 | 1715 | 119 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 120(M) | 1611 | −1324 | −2720 | −2134 | −1301 | −2713 | −1527 | 300 | −1897 | −1184 | 1616 | 422 | −2775 | −1681 | 273 | 867 | −1236 | 1045 | −1761 | 1090 | 120 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 121(A) | 2919 | −2259 | −4733 | −4972 | −4875 | −2541 | −4174 | −4667 | −4727 | −4936 | −3986 | −3309 | −3346 | −4229 | −4444 | 1993 | 632 | −3423 | −5102 | −5039 | 121 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 122(K) | −208 | −2868 | 1748 | 32 | −3182 | −119 | −979 | −2941 | 2184 | −2882 | −1967 | 693 | −2391 | −529 | −1126 | 931 | −1319 | −2488 | −3051 | −2350 | 122 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 123(K) | −1319 | −2748 | −1178 | 1128 | −3085 | −2275 | −895 | −2813 | 2147 | −527 | −1841 | 1533 | −2363 | −440 | 682 | −1201 | 1137 | −2380 | −2902 | −2257 | 123 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 124(F) | −5282 | −4222 | −5670 | −6022 | 4365 | −5536 | −1776 | −4163 | −5588 | −3467 | −3566 | −4190 | −5408 | −4327 | −4958 | −4815 | −5143 | −4332 | −1023 | 1795 | 124 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 125(I) | −2903 | −2437 | −5499 | −5129 | −2762 | −5200 | −4596 | 3199 | −4992 | −1834 | −1726 | −4835 | −5012 | −4813 | −5032 | −4497 | −2886 | 2318 | −4089 | 1137 | 125 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 126(V) | −2960 | 3127 | −5650 | −5327 | −3175 | −5388 | −5384 | 1758 | −5271 | −1976 | −1886 | −5095 | −5193 | −5212 | −5414 | −4747 | −2959 | 3177 | −4838 | −4319 | 126 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 127(I) | −3151 | −2634 | −5806 | −5453 | −2784 | −5630 | −5388 | 3436 | −5389 | 727 | −1511 | −5292 | −5279 | −5110 | −5436 | −4998 | −3128 | 1449 | −4536 | −4235 | 127 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 128(A) | 2586 | −2237 | −4702 | −4879 | −4297 | 267 | −4054 | −3146 | −4639 | −4101 | −3401 | −3348 | −3405 | −4170 | −4370 | −1993 | −2139 | 2577 | −4712 | −4545 | 128 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 129(D) | −5403 | −5247 | 4201 | −3898 | −6360 | −4647 | −4682 | −7143 | −5306 | −6710 | −6481 | −4228 | −5165 | −4724 | −5628 | −5311 | −5571 | −6677 | −5444 | −5968 | 129 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 130(E) | −30 | −2617 | 1256 | 1786 | 485 | −421 | 1430 | −2656 | −420 | −2624 | −1712 | −802 | −2257 | −375 | −925 | 940 | −1128 | −2228 | −2811 | 881 | 130 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |

TABLE 4-continued

| | | | | | | | | | | | | | | | | | | | | | |
|---|---|---|---|---|---|---|---|---|---|---|---|---|---|---|---|---|---|---|---|---|---|
| 131(S) | −1461 | −2264 | −2052 | −1528 | −2919 | 128 | −1620 | −2558 | −1253 | −285 | −1920 | −1643 | −2754 | −1284 | 1946 | 2096 | 1496 | −2197 | −3053 | −2562 | 131 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 132(K) | −5328 | −4974 | −5211 | −4878 | −6129 | −4874 | −4145 | −6424 | 4029 | −5979 | −5562 | −4797 | −5200 | −3978 | −3061 | −5417 | −5268 | −6124 | −5037 | −5529 | 132 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 133(L) | 684 | −2365 | 1274 | −665 | −2565 | −2248 | −924 | −2233 | 1265 | 1502 | 818 | −946 | −2341 | 793 | −1026 | −1179 | −1166 | −1922 | −2623 | −2025 | 133 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 134(V) | −1773 | 2120 | −4891 | −4942 | −3801 | −2776 | −3984 | −2112 | −4590 | −3422 | −2885 | −3451 | −3498 | −4162 | −4326 | 1728 | −2163 | 3177 | −4388 | −4131 | 134 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −254 | −8606 | −2657 | −894 | −1115 | −701 | −1378 | * | * | | | | | | | | | | | | |
| 135(D) | −1208 | −2701 | 2036 | 489 | −3015 | −2087 | −811 | −2772 | 1571 | −2713 | −1799 | −717 | 1406 | 1207 | −945 | −1073 | 556 | −2321 | −2881 | −2183 | 135 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8359 | −9402 | −894 | −1115 | −282 | −2492 | * | * | | | | | | | | | | | | |
| 136(K) | −1197 | −2365 | −1180 | −629 | −2575 | 284 | 1001 | −107 | 2043 | −2332 | −1485 | 700 | −2311 | 1006 | −996 | −1142 | −1135 | 636 | −2616 | 1441 | 136 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 137(H) | −1429 | −1419 | −2861 | −2369 | −1354 | −75 | 2475 | 852 | −2094 | 2161 | −613 | 587 | −2915 | −1899 | −2147 | −1910 | −1379 | −840 | −1840 | −1448 | 137 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 138(G) | −2094 | 2048 | −4883 | −4935 | −3577 | 2953 | −3965 | −3084 | −4561 | 1742 | −2783 | −3648 | −3705 | −4191 | −4306 | −2408 | −2479 | −2819 | −4182 | −3948 | 138 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −310 | −8606 | −2390 | −894 | −1115 | −701 | −1378 | * | * | | | | | | | | | | | | |
| 139(G) | −2035 | −3386 | −760 | 751 | −3993 | 2992 | −1663 | −3772 | −1503 | −3736 | −2940 | −1204 | −2871 | 1135 | −2038 | −1880 | 718 | −3272 | −3927 | −3185 | 139 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −461 | −8303 | −1886 | −894 | −1115 | −1966 | −427 | * | * | | | | | | | | | | | | |
| 140(D) | −940 | −2299 | 1878 | −180 | −2604 | −1821 | −574 | −2327 | 1163 | −2325 | 1838 | −487 | −1974 | −143 | −692 | 1766 | −894 | −1924 | −2537 | −1874 | 140 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −930 | −7851 | −1087 | −894 | −1115 | −2707 | −240 | * | * | | | | | | | | | | | | |
| 141(Q) | −938 | −2159 | −672 | −169 | −2594 | −1727 | −223 | −2242 | 616 | −2123 | −1305 | 1962 | −1829 | 2203 | 2006 | −820 | −833 | −1874 | −2189 | −1702 | 141 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −18 | −6939 | −7981 | −894 | −1115 | −3303 | −154 | * | * | | | | | | | | | | | | |
| 142(W) | −3267 | −2487 | −3870 | −3996 | 1146 | −3755 | −293 | −2351 | −3496 | −1826 | −1813 | −2554 | −3686 | −2607 | −3080 | −3042 | −3163 | −2460 | 5179 | 3293 | 142 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −18 | −6939 | −7981 | −894 | −1115 | −94 | −3981 | * | * | | | | | | | | | | | | |
| 143(K) | −1377 | −2796 | −1249 | −677 | −3147 | −515 | 1562 | −2869 | 2277 | −2795 | −1891 | −19 | 370 | −473 | 1735 | −1258 | 973 | −2437 | −2936 | −2306 | 143 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 144(F) | −1269 | −1674 | −1906 | −1343 | 2267 | 740 | −1243 | −1281 | 445 | 884 | 1381 | 644 | −2580 | 894 | −1502 | −1486 | −1208 | −1134 | −2059 | −1617 | 144 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −124 | −8606 | −3645 | −894 | −1115 | −701 | −1378 | * | * | | | | | | | | | | | | |
| 145(P) | 2399 | −2218 | −4242 | −4533 | −4827 | 1387 | −4028 | −4645 | −4562 | −4894 | −3951 | −3166 | 2828 | −4060 | −4339 | −1852 | −2073 | −3390 | −5022 | −4957 | 145 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8488 | −9530 | −894 | −1115 | −402 | −2040 | * | * | | | | | | | | | | | | |
| 146(V) | −3180 | −2691 | −5763 | −5333 | −2397 | −5475 | −4843 | 1633 | −5189 | 1010 | 2091 | −5138 | −5106 | −4711 | −5091 | −4778 | −3137 | 2910 | −4012 | −3842 | 146 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 147(P) | −5672 | −5016 | −5908 | −6280 | −6507 | −5021 | −5699 | −7438 | −6489 | −6950 | −6782 | −6096 | 4323 | −6350 | −6037 | −6019 | −5995 | −6875 | −5439 | −6461 | 147 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |

TABLE 4-continued

| | | | | | | | | | | | | | | | | | | | | | |
|---|---|---|---|---|---|---|---|---|---|---|---|---|---|---|---|---|---|---|---|---|---|
| 148(V) | −3064 | −2549 | −5744 | −5416 | −3044 | −5587 | −5526 | 2767 | −5376 | 28 | −1748 | −5243 | −5290 | −5253 | −5507 | −4963 | −3050 | 2845 | −4804 | −4365 | 148 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 149(E) | −5429 | −5227 | −3611 | 3948 | −6343 | −4680 | −4698 | −7062 | −5156 | −6644 | −6413 | −4312 | −5188 | −4740 | −5393 | −5360 | −5587 | −6630 | −5420 | −5964 | 149 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 150(V) | −3034 | −2523 | −5726 | −5424 | −3217 | −5557 | −5670 | 2853 | −5401 | −1960 | −1903 | −5240 | −5307 | −5371 | −5582 | −4951 | −3030 | 2987 | −5010 | −4474 | 150 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 151(I) | −3098 | −2584 | −5765 | −5423 | −2910 | −5595 | −5432 | 2858 | −5369 | 805 | −1628 | −5253 | −5275 | −5169 | −5457 | −4964 | −3080 | 2522 | −4655 | −4287 | 151 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 152(P) | −2100 | −2801 | −2590 | −2765 | −4693 | −2808 | −3070 | −4508 | −2721 | −4590 | −3817 | −2613 | 3846 | 1368 | −2863 | −2250 | 500 | −3643 | −4688 | −4333 | 152 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 153(W) | −246 | 982 | 39 | 198 | −144 | −596 | 928 | −456 | 289 | −954 | 709 | 281 | −285 | 575 | 131 | −180 | −17 | −477 | 1369 | 255 | 153 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 154(M) | −1341 | −1294 | −3042 | −2451 | 2731 | −39 | −1637 | −803 | −2166 | 94 | 2746 | −2223 | −2861 | 603 | −2187 | 830 | −1285 | −718 | −1726 | −1352 | 154 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 155(C) | 2726 | 3556 | −4940 | −5212 | −4865 | 1173 | −4237 | −4662 | −4867 | −4931 | −3980 | −3353 | −3349 | −4328 | −4516 | 426 | −2116 | −3416 | −5102 | −5057 | 155 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 156(W) | 196 | 1347 | −3336 | −2725 | −1130 | −2867 | 1000 | 667 | −2371 | −1106 | −459 | −2376 | −2920 | −2077 | 889 | −1936 | −1310 | −678 | 3362 | 3169 | 156 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 157(K) | 166 | −2638 | 141 | 579 | −2958 | −2143 | −801 | −2708 | 1684 | −2654 | −1728 | −778 | −2236 | 1044 | 1226 | 619 | −1108 | 845 | −2822 | −2141 | 157 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 158(Y) | 1212 | −1470 | −2316 | −1741 | 1052 | −2622 | −1397 | −1026 | 300 | −1339 | −658 | −1763 | 1264 | −1389 | 476 | −1632 | −1227 | 1091 | −1884 | 1942 | 158 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 159(V) | −2101 | −1824 | −4475 | −3923 | −2016 | −3881 | −2921 | 1555 | −3607 | 44 | −1092 | 18 | −3873 | −3304 | −3498 | −3016 | 1758 | 2629 | −2759 | −2390 | 159 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 160(I) | 972 | −1454 | −2361 | −1785 | −1451 | −2633 | −1415 | 1648 | 368 | 1218 | −644 | −1793 | −2701 | −1422 | −48 | 121 | 475 | −891 | −1875 | −1479 | 160 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 161(R) | −1557 | −2965 | −1351 | 1883 | −3340 | −504 | −1043 | −3048 | 1177 | −2952 | −2061 | 809 | −2552 | 675 | 2434 | −1431 | −1477 | −2620 | −3069 | −2464 | 161 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −254 | −8606 | −2657 | −894 | −1115 | −701 | −1378 | * | * | | | | | | | | | | | | |
| 162(R) | 903 | −2511 | 733 | 684 | −2833 | −2001 | −664 | −2583 | 1048 | −2526 | −1601 | 891 | −2099 | 1582 | 1672 | −916 | −977 | −2134 | −2692 | −2010 | 162 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8359 | −9402 | −894 | −1115 | −282 | −2492 | * | * | | | | | | | | | | | | |
| 163(L) | 145 | −1585 | −4123 | −3529 | −1544 | −3387 | −2364 | 775 | −3163 | 2487 | −687 | −3055 | −3428 | −2796 | −2997 | 41 | −1740 | 743 | −2201 | −1870 | 163 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 164(V) | 623 | −2039 | −1412 | 108 | −2154 | −2315 | −1012 | 280 | 569 | 456 | −1187 | −1099 | −2400 | 576 | 118 | 778 | −1150 | 1235 | −2361 | −1832 | 164 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |

TABLE 4-continued

| | | | | | | | | | | | | | | | | | | | | | |
|---|---|---|---|---|---|---|---|---|---|---|---|---|---|---|---|---|---|---|---|---|---|
| 165(K) | −1216 | −2691 | 495 | 1744 | −3009 | −2168 | −843 | −69 | 1908 | −2706 | −1783 | 414 | 339 | −385 | −943 | 718 | −1157 | −2312 | −2875 | −2189 | 165 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 166(L) | −1936 | −1746 | −4126 | −3499 | 807 | −3503 | −2344 | 1202 | −3118 | 2065 | 1628 | −3097 | −3473 | 1712 | 416 | −2594 | −1866 | −1010 | −2120 | −1846 | 166 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −764 | −8606 | −1291 | −894 | −1115 | −701 | −1378 | * | * | | | | | | | | | | | | |
| 167(F) | 691 | −862 | −2216 | −1632 | 1624 | −2234 | −1030 | −388 | 779 | 1008 | −53 | −1526 | 340 | −1183 | −1510 | −1269 | −765 | −290 | −1267 | 1539 | 167 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −9 | −7851 | −8893 | −894 | −1115 | −2707 | −240 | * | * | | | | | | | | | | | | |
| 168(H) | −775 | −2159 | −652 | 1820 | 958 | −1752 | 2010 | −2178 | 869 | −2157 | −1258 | −401 | −1844 | 47 | 694 | −670 | 847 | −1769 | −2349 | −1698 | 168 |
| — | −149 | −500 | 234 | 44 | −381 | 399 | 105 | −627 | 210 | −465 | −721 | 275 | 393 | 45 | 96 | 359 | 117 | −368 | −295 | −250 | |
| — | −3016 | −1080 | −1310 | −59 | −4631 | −2707 | −240 | * | * | | | | | | | | | | | | |
| 169(K) | −541 | −1272 | −806 | −243 | −1261 | −1631 | −278 | −993 | 1962 | 241 | −435 | −447 | −1715 | 16 | −261 | 651 | −475 | −788 | −1498 | 1368 | 170 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7111 | −8154 | −894 | −1115 | −99 | −3908 | * | * | | | | | | | | | | | | |
| 170(G) | 388 | −2469 | −3206 | −3555 | −4977 | 3463 | −3801 | −4826 | −4249 | −5038 | −4124 | 688 | −3400 | −3725 | −4295 | −2031 | −2269 | −3602 | −5156 | −4941 | 171 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 171(C) | 239 | 3977 | −3406 | 371 | −4560 | 2817 | −3588 | −4292 | −3864 | −4544 | −3674 | −2915 | −3327 | −3491 | −3939 | −1950 | −2149 | −3315 | −4780 | −4534 | 172 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 172(E) | −1178 | −2643 | 222 | 2198 | −2961 | −2149 | −810 | −2709 | 1271 | −2657 | −1733 | −785 | −2244 | −351 | 406 | 253 | 392 | 577 | −2828 | −2147 | 173 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 173(C) | 1981 | 2011 | −3741 | −3203 | −1581 | −2800 | −2105 | −1042 | −2847 | −1469 | −825 | −2650 | 1660 | −2506 | −2717 | −1959 | −1483 | 1766 | −2081 | 1103 | 174 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 174(K) | −1192 | 1182 | 577 | 1872 | −2980 | −2156 | −821 | −2729 | 2052 | −2676 | −1752 | 374 | −2254 | 1044 | −912 | −1072 | −1132 | −141 | −2845 | −2163 | 175 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 175(L) | −3000 | −2617 | −5418 | −4862 | −1799 | −4884 | −3769 | 2006 | −4568 | 2395 | −719 | −4533 | −4605 | −3952 | −4324 | −4068 | −2927 | 662 | −3117 | 1709 | 176 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 176(R) | −5677 | −5058 | −5817 | −5522 | −6223 | −5022 | −4626 | −6808 | −3755 | −6307 | −5975 | −5374 | −5388 | −4598 | 4244 | −5871 | −5687 | −6494 | −5162 | −5792 | 177 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 177(M) | −1747 | −2635 | −1848 | 98 | −2811 | −2728 | −1267 | −2408 | 687 | 200 | 3892 | −1465 | −2798 | 2232 | −853 | −1743 | −1654 | −2188 | −2826 | −2358 | 178 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −79 | −8606 | −4299 | −894 | −1115 | −701 | −1378 | * | * | | | | | | | | | | | | |
| 178(G) | 922 | −2759 | 587 | 373 | −3075 | 2180 | −884 | −2829 | 383 | −2772 | −1855 | 470 | −2305 | −432 | 613 | −1143 | −1217 | −2379 | −2940 | −2247 | 179 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −1034 | −8533 | −975 | −894 | −1115 | −477 | −1829 | * | * | | | | | | | | | | | | |
| 179(G) | −790 | −1342 | −3029 | −2997 | −3043 | 2428 | −2604 | −2480 | −2911 | −2963 | −2201 | −2139 | −2429 | −2602 | −2908 | 1256 | −1178 | 2138 | −3389 | −3113 | 180 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −11 | −7657 | −8699 | −894 | −1115 | −1036 | −965 | * | * | | | | | | | | | | | | |
| 180(N) | 461 | −2422 | 1127 | 1087 | −2741 | 255 | −569 | −2493 | 973 | −2437 | −1513 | 1736 | −1998 | −111 | 780 | −820 | −885 | −2043 | −2604 | −1918 | 181 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8163 | −9206 | −894 | −1115 | −792 | −1243 | * | * | | | | | | | | | | | | |
| 181(K) | −1687 | −3170 | −887 | 367 | −3526 | 141 | −1200 | −3278 | 3100 | −3197 | −2324 | 933 | −2601 | −772 | −1257 | −55 | −1646 | −2827 | −3347 | −2656 | 182 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −94 | −8427 | −4055 | −894 | −1115 | −1600 | −578 | * | * | | | | | | | | | | | | |

TABLE 4-continued

| | | | | | | | | | | | | | | | | | | | | | |
|---|---|---|---|---|---|---|---|---|---|---|---|---|---|---|---|---|---|---|---|---|---|
| 182(C) | 1482 | 2044 | 1980 | −748 | −2923 | 825 | −1048 | −2641 | −684 | −2673 | −1786 | −989 | −2306 | −625 | 668 | 105 | −1157 | −2179 | −2898 | −2278 | 183 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −100 | −8340 | −3967 | −894 | −1115 | −1870 | −461 | * | * | | | | | | | | | | | | |
| 183(G) | −71 | −3298 | −742 | 1596 | −3878 | 2844 | −1523 | −3647 | 365 | −3594 | −2781 | −1128 | −2775 | −1140 | −1774 | −1771 | −1968 | −3153 | −3766 | −3044 | 184 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8247 | −9289 | −894 | −1115 | −928 | −1076 | * | * | | | | | | | | | | | | |
| 184(P) | −110 | −1791 | −3943 | −3559 | 992 | −2983 | −2522 | 779 | −3255 | −1495 | −1119 | −2960 | 3564 | −2915 | −3152 | −2210 | −1838 | −1020 | −2439 | −1945 | 185 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8427 | −9469 | −894 | −1115 | −333 | −2277 | * | * | | | | | | | | | | | | |
| 185(V) | −324 | −1581 | −4163 | −3574 | 1465 | −3444 | −2271 | 858 | −3201 | −1285 | −779 | −3069 | −3463 | −2829 | −3021 | −2550 | −1757 | 2742 | −2054 | 2219 | 186 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 186(V) | −3012 | −2513 | −5669 | −5326 | 736 | −5459 | −5193 | 2647 | −5256 | −1783 | −1738 | −5111 | −5200 | −5109 | −5353 | −4805 | −2998 | 2946 | −4562 | −4059 | 187 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 187(T) | −1742 | −2352 | −4396 | −4706 | −4890 | −2611 | −4150 | −4724 | −4630 | −4997 | −4079 | −3309 | −3413 | −4199 | −4395 | 385 | 3854 | −3505 | −5101 | −4993 | 188 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 188(D) | −5403 | −5247 | 4201 | −3898 | −6360 | −4647 | −4682 | −7143 | −5306 | −6710 | −6481 | −4228 | −5165 | −4724 | −5628 | −5311 | −5571 | −6677 | −5444 | −5968 | 189 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 189(N) | −1971 | −2698 | −2354 | −2707 | −4989 | 227 | −3384 | −4887 | −3747 | −5029 | −4165 | 4036 | −3410 | −3211 | −4065 | 339 | −2390 | −3740 | −5140 | −4724 | 190 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 190(G) | −1970 | −3190 | −1651 | −1272 | −3823 | 2887 | −1466 | −3495 | 690 | −3390 | −2549 | 837 | −2933 | −1041 | 348 | 520 | −1935 | −3053 | −3480 | −2950 | 191 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 191(N) | −3572 | −4363 | −2064 | −2403 | −3700 | −3611 | 1730 | −5474 | −3143 | −5200 | −4750 | 4219 | −4166 | −2994 | −3470 | −3447 | −3764 | −4934 | −4032 | −3152 | 192 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 192(Y) | −2601 | −2317 | −4832 | −4277 | 2774 | −4169 | −2557 | −1161 | −3899 | 976 | 1646 | −3718 | −4055 | −3312 | −3626 | −3291 | −2522 | 912 | −2037 | 2952 | 193 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 193(I) | −3062 | −2579 | −5722 | −5432 | −3070 | −5435 | −5500 | 3834 | −5371 | −1812 | −1799 | −5204 | −5248 | −5259 | −5489 | −4839 | −3069 | 763 | −4808 | −4338 | 194 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 194(I) | 887 | −2367 | −5400 | −4982 | −2747 | −5034 | −4493 | 2447 | −4817 | 1065 | −1570 | −4691 | −4862 | −4594 | −4817 | −4295 | −2785 | 2222 | −4070 | −3675 | 195 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 195(D) | −5403 | −5247 | 4201 | −3898 | −6360 | −4647 | −4682 | −7143 | −5306 | −6710 | −6481 | −4228 | −5165 | −4724 | −5628 | −5311 | −5571 | −6677 | −5444 | −5968 | 196 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 196(W) | 1374 | 1831 | −3697 | −3062 | 844 | −2906 | −1776 | −647 | −2659 | 765 | 1206 | −2550 | −2953 | −2280 | −2460 | −1991 | −1296 | 1458 | 3242 | −1297 | 197 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −110 | −8606 | −3817 | −894 | −1115 | −701 | −1378 | * | * | | | | | | | | | | | | |
| 197(Y) | −1155 | −2581 | 629 | −465 | 498 | −2127 | 2018 | −2629 | 1786 | −2586 | −1675 | −768 | −2218 | 1110 | 633 | −1041 | −1091 | −2200 | −2747 | 2249 | 198 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8502 | −9544 | −894 | −1115 | −422 | −1978 | * | * | | | | | | | | | | | | |
| 198(F) | −2529 | −2378 | −4709 | −4312 | 3957 | 634 | −2487 | −1330 | −3952 | −208 | −1164 | −3613 | −4025 | −3430 | −3724 | −3098 | −2553 | 37 | −1994 | −1161 | 199 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |

TABLE 4-continued

| | | | | | | | | | | | | | | | | | | | | | |
|---|---|---|---|---|---|---|---|---|---|---|---|---|---|---|---|---|---|---|---|---|---|
| 199(M) | 167 | −2600 | 543 | 1350 | −2902 | 752 | −812 | −2640 | −400 | −1391 | 2204 | −793 | 865 | 697 | −905 | −1060 | 393 | −2212 | −2794 | −2123 | 200 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −115 | −8606 | −3756 | −894 | −1115 | −701 | −1378 | * | * | | | | | | | | | | | | |
| 200(E) | −1224 | −2674 | −1052 | 1892 | −3010 | −2175 | −811 | −2747 | 1260 | −2681 | −1766 | 736 | 426 | −355 | 1729 | −1102 | 795 | −2306 | −2834 | −2176 | 201 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −279 | −8497 | −2532 | −894 | −1115 | −415 | −2000 | * | * | | | | | | | | | | | | |
| 201(I) | −1660 | −2384 | 1157 | −1375 | −2958 | −2441 | −1854 | 2571 | −1864 | −2787 | −2075 | −1563 | 2045 | −1604 | −2319 | 1056 | −1780 | −2140 | −3245 | −2715 | 202 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −7 | −8357 | −9399 | −894 | −1115 | −280 | −2501 | * | * | | | | | | | | | | | | |
| 202(I) | 196 | −1230 | 1001 | −2733 | −1199 | −45 | −1718 | 2445 | −2404 | −65 | 1177 | −2387 | −2913 | −2094 | −2330 | −1931 | 133 | 622 | −1697 | −1345 | 203 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 203(W) | −246 | 982 | 39 | 198 | −144 | −596 | 928 | −456 | 289 | −954 | 709 | 281 | −285 | 575 | 131 | −180 | −17 | −477 | 1369 | 255 | 204 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 204(D) | −1192 | −2666 | 1987 | −479 | −2987 | 905 | 1522 | −2738 | 930 | −2681 | −1756 | 453 | −2253 | 1000 | 618 | 271 | −1131 | −2288 | −2848 | −2165 | 205 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 205(D) | 433 | −4013 | 3168 | −1096 | −4558 | −2754 | −2037 | −4393 | 494 | −4319 | −3549 | −1451 | 2098 | −1679 | −2685 | −2287 | −2573 | −3858 | −4503 | −3661 | 206 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 206(W) | −161 | −1534 | 335 | −1559 | −1543 | −2564 | −1329 | 1049 | 30 | 1134 | −717 | −1634 | 1219 | −1254 | −1672 | −251 | −1207 | −980 | 3174 | −1526 | 207 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −596 | −8606 | −1574 | −894 | −1115 | −701 | −1378 | * | * | | | | | | | | | | | | |
| 207(E) | −832 | −2017 | −804 | 1137 | 888 | −167 | −525 | −1912 | −156 | 672 | −1136 | −542 | −1944 | 1015 | 975 | 594 | −771 | −1582 | −2267 | −1657 | 208 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −8 | −8018 | −9061 | −894 | −1115 | −169 | −3177 | * | * | | | | | | | | | | | | |
| 208(E) | 1587 | −2677 | 450 | 1606 | −2995 | −113 | −834 | −2745 | 1329 | −2692 | −1769 | −797 | −2264 | 736 | −931 | −1084 | −1146 | −505 | −2862 | −2177 | 209 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 209(M) | 902 | −1495 | −4062 | −3447 | −1420 | −3322 | −2227 | 824 | −3067 | 1877 | 1985 | −2965 | −3339 | −2688 | −2882 | −2422 | 401 | 1163 | −2053 | −1722 | 210 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 210(H) | 166 | 1605 | −1017 | 1752 | −2953 | −472 | 2332 | −2700 | −396 | −2651 | −1729 | 778 | −2244 | 1043 | −903 | 884 | −1116 | −2256 | −2824 | −2145 | 211 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 211(R) | −1176 | −2646 | 827 | 301 | −2967 | −2147 | −805 | −80 | 1073 | −2661 | −1735 | 563 | −2241 | 1045 | 2046 | −1056 | 1141 | −2268 | −2828 | −2147 | 212 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 212(A) | 1952 | −3041 | 678 | 1917 | −3353 | −2343 | −1113 | −3113 | −750 | −3050 | −2149 | −969 | −2516 | 694 | 1371 | −1391 | −1488 | −2661 | −3218 | −2511 | 213 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 213(I) | −3825 | −3264 | −6294 | −5832 | −1978 | −6067 | −5109 | 3360 | −5658 | 1823 | −758 | −5806 | −5367 | −4721 | −5322 | −5478 | −3736 | −1069 | −3777 | −3839 | 214 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 214(N) | 163 | −2644 | −1060 | 601 | −2943 | −2203 | −876 | −2672 | 1749 | 818 | −1747 | 2118 | −2306 | −428 | −951 | −94 | −1183 | −2255 | −2843 | −2180 | 215 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 215(M) | 930 | −2497 | −1084 | 530 | −2758 | −478 | 1513 | −2468 | −445 | −431 | 2199 | 1436 | −2265 | −400 | 831 | −1086 | 329 | −2086 | −2717 | −2072 | 216 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |

TABLE 4-continued

| | | | | | | | | | | | | | | | | | | | | | |
|---|---|---|---|---|---|---|---|---|---|---|---|---|---|---|---|---|---|---|---|---|---|
| 216(I) | −2915 | −2559 | −5312 | −4739 | 419 | −4739 | −3640 | 2978 | −4429 | 1485 | −658 | −4398 | −4492 | −3823 | −4183 | −3909 | 1278 | −945 | −3034 | −2864 | 217 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 217(P) | −2026 | −3159 | 379 | 213 | −3504 | −2622 | −1735 | −3127 | −1640 | −3292 | −2523 | −1378 | 3319 | −1389 | −2203 | −1939 | 401 | 1113 | −3628 | −2966 | 218 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 218(G) | −5249 | −4846 | −5805 | −6182 | −6521 | 3848 | −5650 | −7348 | −6455 | −6931 | −6666 | −5891 | −5413 | −6249 | −6011 | −5566 | −5614 | −6629 | −5452 | −6497 | 219 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 219(V) | −3032 | −2527 | −5721 | −5421 | −3204 | −5529 | −5639 | 1784 | −5391 | −1952 | −1897 | −5227 | −5294 | −5354 | −5564 | −4924 | −3030 | 3491 | −4985 | −4454 | 220 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 220(V) | −3030 | −2536 | −5710 | −5416 | −3180 | −5472 | −5582 | 1076 | −5374 | −1935 | −1886 | −5203 | −5268 | −5323 | −5532 | −4869 | −3033 | 3633 | −4937 | −4415 | 221 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 221(E) | −2882 | −4737 | 2030 | 2984 | −4984 | 228 | −2195 | −4903 | −2430 | −4775 | −4093 | −1445 | −3371 | −1861 | −3280 | −2557 | 969 | −4364 | −4971 | −3962 | 222 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 222(H) | −1683 | −2273 | −2111 | −1867 | −2720 | −2639 | 3757 | −2371 | −1792 | −2658 | −1938 | 1501 | −3000 | −1752 | −2087 | −1842 | 2262 | 788 | −3026 | −2524 | 223 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 223(G) | −5249 | −4846 | −5805 | −6182 | −6521 | 3848 | −5650 | −7348 | −6455 | −6931 | −6666 | −5891 | −5413 | −6249 | −6011 | −5566 | −5614 | −6629 | −5452 | −6497 | 224 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 224(L) | −4228 | −3609 | −6619 | −6031 | −1718 | −6422 | −5067 | 1928 | −5834 | 2739 | 2160 | −6148 | −5413 | −4568 | −5301 | −5805 | −4066 | −1850 | −3556 | −3790 | 225 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 225(F) | −5765 | −4802 | −5973 | −6324 | 4566 | −5247 | −3479 | −5215 | −6252 | −4532 | −4649 | −5413 | −5556 | −5531 | −5699 | −5820 | −5855 | −5401 | −2775 | −1729 | 226 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 226(I) | 1157 | −1932 | −4694 | −4157 | −2139 | −4088 | −3174 | 2444 | −3853 | 1087 | −1173 | −3737 | −4056 | −3545 | −3737 | −3239 | 274 | 1490 | −2964 | −2597 | 227 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 227(N) | −2483 | −4204 | 2225 | −949 | −4447 | 1738 | 1247 | −4291 | 368 | −4189 | −3400 | 2585 | −3142 | −1499 | −2517 | −2222 | −2498 | −3801 | −4368 | −3498 | 228 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 228(M) | −1382 | 1927 | −3453 | −2835 | −1221 | −2902 | −1767 | 605 | −2456 | −1083 | 4041 | 563 | −2955 | −2160 | 886 | −1979 | −1325 | 534 | −1727 | −1378 | 229 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −110 | −8606 | −3817 | −894 | −1115 | −701 | −1378 | * | * | | | | | | | | | | | | |
| 229(A) | 2906 | −2083 | −4487 | −4519 | −4043 | 938 | −3724 | −3504 | −4244 | −3982 | −3187 | −3127 | −3222 | −3819 | −4050 | −1810 | 662 | 1124 | −4390 | −4200 | 230 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −119 | −8502 | −3713 | −894 | −1115 | −1301 | −751 | * | * | | | | | | | | | | | | |
| 230(T) | 706 | −2744 | 1325 | 778 | −3067 | −2123 | −875 | −2825 | −511 | −2772 | −1862 | 917 | −2277 | −429 | −1037 | 1284 | 1668 | −2373 | −2946 | −2245 | 231 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8390 | −9432 | −894 | −1115 | −303 | −2401 | * | * | | | | | | | | | | | | |
| 231(D) | 167 | −2635 | 1868 | 326 | −2949 | −2152 | −812 | −2695 | 1328 | −2647 | −1726 | −790 | −2246 | −355 | 1297 | −1063 | 667 | 565 | −2821 | −2144 | 232 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 232(V) | 1394 | 1436 | −3993 | −3393 | −1546 | −3328 | −2258 | 780 | 34 | −283 | −724 | −2947 | −3357 | −2697 | −2889 | −2428 | −1644 | 2625 | −2136 | −1782 | 233 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |

TABLE 4-continued

| | | | | | | | | | | | | | | | | | | | | | |
|---|---|---|---|---|---|---|---|---|---|---|---|---|---|---|---|---|---|---|---|---|---|
| 233(I) | −64 | −1380 | −3936 | −3314 | 897 | −3170 | −2054 | 2138 | −2923 | 748 | −513 | −2814 | −3199 | −2543 | −2730 | −2264 | −1521 | 1564 | −1889 | 2035 | 234 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 234(I) | −3298 | −2830 | −5797 | −5296 | 2411 | −5417 | −4467 | 2599 | −5083 | 1361 | −849 | −5082 | −4994 | −4412 | −4856 | −4676 | −3229 | 1167 | −3586 | −3484 | 235 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 235(A) | 2357 | −1657 | −3565 | −3090 | −2055 | 1061 | −2318 | 320 | −2816 | −1937 | −1269 | −2605 | −3060 | −2533 | −2815 | 181 | 162 | 1115 | −2519 | −2176 | 236 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 236(G) | −1411 | −2759 | 621 | −646 | −3014 | 2511 | −1040 | −2740 | 599 | −2751 | 1397 | 824 | −2446 | −612 | −1184 | −1304 | −1359 | −2353 | −2972 | 957 | 237 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 237(T) | −165 | −2638 | −1015 | 1030 | −2958 | −2143 | 1459 | −2707 | 910 | −2654 | −1728 | −779 | 232 | 1044 | −889 | 939 | 1752 | −2260 | −2822 | −2141 | 238 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 238(D) | 479 | −2473 | 2115 | −550 | 1083 | −2181 | −848 | −2428 | 582 | −917 | −1581 | −847 | 430 | −414 | 489 | −1095 | 719 | −2058 | −2700 | −2062 | 239 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 239(G) | −2879 | −4746 | 721 | 1167 | −4951 | 2971 | −2158 | −4854 | 1286 | −4718 | −4028 | −1440 | −3363 | −1819 | −3088 | −2550 | −2935 | −4334 | −4900 | −3920 | 240 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −473 | −8606 | −1853 | −894 | −1115 | −701 | −1378 | * | * | | | | | | | | | | | | |
| 240(G) | −1227 | −1852 | −3756 | −3959 | −4398 | 2730 | −3546 | −4201 | −3968 | −4445 | −3506 | −2737 | −2897 | −3530 | −3833 | 2223 | 1011 | −2989 | −4607 | −4484 | 241 |
| — | −149 | −500 | 233 | 43 | −381 | 399 | 106 | −626 | 210 | −466 | −720 | 275 | 394 | 45 | 96 | 359 | 117 | −367 | −294 | −249 | |
| — | −3305 | −3226 | −336 | −186 | −3046 | −522 | −1719 | * | * | | | | | | | | | | | | |
| 241(V) | −1770 | −1399 | −4112 | −3687 | −1148 | −3723 | −3023 | 861 | −3415 | 1359 | −31 | −3414 | −3586 | −3084 | −3351 | −2991 | −1753 | 2970 | −2514 | −2209 | 243 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7111 | −8154 | −894 | −1115 | −3231 | −162 | * | * | | | | | | | | | | | | |
| 242(T) | −557 | −1464 | −843 | −435 | −2244 | −1466 | −609 | −1894 | 1229 | −2001 | −1185 | −581 | −1777 | −240 | −466 | 926 | 2568 | −1473 | −2261 | −1748 | 244 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7111 | −8154 | −894 | −1115 | −99 | −3908 | * | * | | | | | | | | | | | | |
| 243(V) | −408 | −2431 | −5505 | −5112 | −2823 | −5182 | −4753 | 815 | −4976 | 778 | −1612 | −4848 | −4983 | −4770 | −5004 | −4472 | −2871 | 3288 | −4262 | −3865 | 245 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 244(K) | −1565 | −2981 | −1249 | 1228 | −3334 | −2441 | −1073 | 161 | 2733 | −2970 | −2082 | 1556 | −2556 | 666 | −900 | −1437 | −1493 | −2624 | −3105 | −2480 | 246 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 245(E) | −1173 | −2544 | 125 | 1854 | −2824 | −2162 | −826 | −333 | 1224 | −2542 | 1322 | 360 | −2255 | −380 | −923 | −1073 | 1352 | 44 | −2752 | −2095 | 247 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −6 | −8606 | −9649 | −894 | −1115 | −701 | −1378 | * | * | | | | | | | | | | | | |
| 246(R) | −1290 | −1660 | −1984 | −32 | 727 | −2538 | −1272 | 1093 | 1325 | 948 | −835 | −1531 | −2610 | −1123 | 1480 | −1524 | 488 | −1115 | −2049 | −1618 | 248 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −208 | −8606 | −2925 | −894 | −1115 | −701 | −1378 | * | * | | | | | | | | | | | | |
| 247(E) | −1098 | −1699 | −1503 | 1952 | 268 | −2269 | 1109 | −1360 | 530 | −133 | −863 | −1141 | −24 | −732 | −1212 | −1227 | −1038 | 1039 | −2055 | 1060 | 249 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −191 | −8405 | −3045 | −894 | −1115 | −1676 | −541 | * | * | | | | | | | | | | | | |
| 248(K) | −1097 | −2546 | −884 | 806 | −2885 | −253 | −671 | −2620 | 2294 | −2551 | −1640 | 1584 | 527 | −216 | 815 | −973 | −1030 | −2180 | −2700 | −2045 | 250 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −1438 | −8221 | −672 | −894 | −1115 | −2153 | −367 | * | * | | | | | | | | | | | | |
| 249(P) | −253 | −917 | −1409 | −1421 | −2656 | −1084 | −1555 | −2458 | −1537 | −2662 | −1851 | −1108 | 2981 | −1371 | −1743 | 1948 | −614 | −1671 | −2835 | −2454 | 251 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −19 | −6802 | −7844 | −894 | −1115 | −3353 | −149 | * | * | | | | | | | | | | | | |

TABLE 4-continued

| | | | | | | | | | | | | | | | | | | | | | |
|---|---|---|---|---|---|---|---|---|---|---|---|---|---|---|---|---|---|---|---|---|---|
| 250(K) | −1150 | −1622 | −1430 | −946 | 2379 | −2053 | −469 | −1244 | 2591 | −1236 | −778 | −999 | −2179 | −474 | −282 | −1235 | −1092 | −1159 | −986 | −123 | 252 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −19 | −6802 | −7844 | −894 | −1115 | −3353 | −149 | * | * | | | | | | | | | | | | |
| 251(C) | −933 | 3622 | −1652 | −1088 | −2158 | −1769 | −787 | −1664 | 2742 | −1895 | −1231 | −1066 | −2061 | −487 | −80 | −1053 | −994 | −1392 | −2119 | −1779 | 253 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −490 | −6802 | −1841 | −894 | −1115 | −3353 | −149 | * | * | | | | | | | | | | | | |
| 252(H) | −1687 | −1933 | −1269 | −1292 | −876 | −1925 | 4894 | −2432 | −968 | −2285 | −1898 | −1353 | −2307 | −1191 | −1079 | −1732 | −1775 | −2223 | −1258 | −443 | 254 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −27 | −6339 | −7381 | −894 | −1115 | −83 | −4158 | * | * | | | | | | | | | | | | |
| 253(W) | −246 | 982 | 39 | 198 | −144 | −596 | 928 | −456 | 289 | −954 | 709 | 281 | −285 | 575 | 131 | −180 | −17 | −477 | 1369 | 255 | 255 |
| — | * | * | * | * | * | * | * | * | * | * | * | * | * | * | * | * | * | * | * | * | |
| — | * | * | * | * | * | * | * | * | 0 | | | | | | | | | | | | |

[1]Program name and version
[2]Name of the input sequence alignment file
[3]Length of the alignment: include indels
[4]Type of residues
[5]Map of the match states to the columns of the alignment
[6]Commands used to generate the file: this one means that hmmbuild (default parameters) was applied to the alignment file
[7]Commands used to generate the file: this one means that hmmcalibrate (default parameters) was pplied to the hmm profile
[8]Number of sequences in the alignment
[9]When the file was generated
[10]The trasition probability distribution for the null model (single G state).
[11]The symbol emission probability distribution for the null model (G tate); consists of K integers. The null probability used to convert these back to model probabilities is 1/K.
[12]The extreme value distribution parameters μ and lambda respectively, both floating point values. Lambda is positive and nonzero. These values are set when the model is calibrated with hmmcalibrate.

TABLE 5

HMMER2.0 [2.2 g][1]
NAME rpiB__exp__ver__seqs[2]
LENG 165[3]
ALPH Amino[4]
MAP yes[5]
COM /app/public/hmmer/current/bin/hmmbuild rpiB__exp__ver__seqs__hmm.txt rpiB__exp__ver__seqs.aln[6]
COM /app/public/hmmer/current/bin/hmmcalibrate rpiB__exp__ver__seqs__hmm.txt[7]
NSEQ 5[8]
DATE Fri Jan 15 15:09:54 2010[9]
XT −8455 −4 −1000 −1000 −8455 −4 −8455 −4
NULT −4 −8455[10]
NULE 595 −1558 85 338 −294 453 −1158 197 249 902 −1085 −142 −21 −313 45 531 201 384 −1998 −644[11]
EVD −148.871582 0.171732[12]

| HMM | A m->m | C m->i | D m->d | E i->m | F i->i | G d->m | H d->d | I b->m | K m->e | L | M | N | P | Q | R | S | T | V | W | Y | |
|---|---|---|---|---|---|---|---|---|---|---|---|---|---|---|---|---|---|---|---|---|---|
| | −419 | * | −1988 | | | | | | | | | | | | | | | | | | |
| 1(M) | −472 | −717 | −1869 | −1452 | −811 | −1641 | −1064 | −19 | −1120 | −236 | 3221 | −1271 | −1953 | −1041 | −1252 | −839 | 2183 | 1 | −1479 | −1107 | 2 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −21 | −6654 | −7696 | −894 | −1115 | −701 | −1378 | −419 | * | | | | | | | | | | | | |
| 2(M) | −2287 | −2928 | −2934 | −1749 | −3481 | −2960 | −972 | −2902 | 1739 | −2718 | 4133 | −1682 | −2923 | −571 | 1989 | −2235 | −2032 | −2713 | −2754 | −2576 | 3 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 3(K) | −2781 | −3365 | −3640 | −2094 | −4305 | −3231 | −1066 | −3573 | 2986 | −3184 | −2538 | −1924 | −3155 | −648 | 2884 | −2655 | −2421 | −3365 | −2984 | −2940 | 4 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 4(I) | −2263 | −1773 | −4916 | −4590 | −2357 | −4691 | −4606 | 3030 | −4519 | −1143 | −1083 | −4377 | −4471 | −4430 | −4645 | −4052 | −2257 | 2655 | −4021 | −3534 | 5 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 5(A) | 2619 | −1481 | −2444 | −2313 | −2177 | 1153 | −2030 | −2304 | −2293 | −2564 | −1847 | −1910 | −2487 | −2076 | −2443 | −1192 | −1254 | −1841 | −2615 | 2482 | 6 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 6(I) | −2774 | −2311 | −5139 | −4595 | 1840 | −4727 | −3407 | 2972 | −4331 | 1551 | 119 | −4360 | −4226 | −3490 | −3999 | −3964 | −2674 | −548 | −2467 | −2263 | 7 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 7(G) | 1350 | −1652 | −3252 | −3534 | −4099 | 3322 | −3254 | −3906 | −3698 | −4170 | −3287 | −2477 | −2669 | −3270 | −3561 | −1294 | −1510 | −2764 | −4228 | −4163 | 8 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 8(C) | 1570 | 3123 | −3455 | −3312 | −3254 | −1715 | −2747 | −2919 | −3065 | −3214 | −2387 | −2245 | −2443 | −2739 | −3031 | 2159 | 1698 | −2142 | −3556 | −3325 | 9 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 9(D) | −3832 | −4189 | 4132 | −2236 | −5073 | −3341 | −3194 | −5633 | −3716 | −5365 | −5035 | −2584 | −3886 | −3102 | −4252 | −3662 | −4000 | −5151 | −4434 | −4544 | 10 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 10(H) | −4406 | −3961 | −3921 | −4171 | −3231 | −3926 | 5401 | −5468 | −3992 | −5013 | −4849 | −4130 | −4378 | −4151 | −3893 | −4548 | −4592 | −5195 | −3383 | −2818 | 11 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 11(A) | 2232 | −1337 | −2891 | −2645 | −2759 | 1179 | −2300 | −2305 | −2493 | −2664 | −1899 | −2011 | 1727 | −2245 | −2597 | −1053 | −1133 | 1237 | −3096 | −2784 | 12 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |

TABLE 5-continued

| | | | | | | | | | | | | | | | | | | | | | |
|---|---|---|---|---|---|---|---|---|---|---|---|---|---|---|---|---|---|---|---|---|---|
| 12(G) | 2269 | −1609 | −3303 | −3564 | −4060 | 2898 | −3234 | −3854 | −3677 | −4122 | −3232 | −2458 | −2636 | −3249 | −3536 | −1251 | −1465 | −2716 | −4208 | −4132 | 13 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 13(F) | −4359 | −3340 | −4801 | −5125 | 3666 | −4673 | −926 | −3244 | −4690 | −2579 | −2662 | −3327 | −4543 | −3457 | −4080 | −3933 | −4223 | −3407 | −176 | 3618 | 14 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 14(E) | 965 | −2018 | −563 | 2095 | −2270 | −1792 | −601 | 929 | −298 | −2028 | −1213 | 1466 | −1964 | −210 | −785 | −835 | −853 | −1562 | −2346 | −1732 | 15 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 15(L) | −3127 | −2591 | −5490 | −4969 | −1050 | −5210 | −4048 | 1779 | −4718 | 2845 | 153 | −4922 | −4503 | −3743 | −4335 | −4557 | −3016 | −680 | −2794 | −2870 | 16 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 16(K) | −2564 | −3293 | −2444 | −1757 | −3636 | −3006 | 2839 | −3540 | 3410 | −3227 | −2573 | −1757 | −3072 | −792 | 63 | −2440 | −2332 | −3283 | −2943 | −2641 | 17 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 17(H) | −1148 | −2512 | −855 | 2058 | −2902 | −1994 | 2342 | −2591 | 128 | −2483 | −1616 | −631 | −2097 | 2016 | 1481 | −1018 | −1059 | −2181 | −2581 | −2010 | 18 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 18(E) | −1214 | −2568 | −920 | 1972 | −2983 | −2045 | −586 | −2657 | 1514 | −2533 | −1673 | 1657 | −2146 | −144 | 1763 | −1082 | −1120 | −2249 | −2617 | −2066 | 19 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 19(I) | −2331 | −1850 | −4929 | −4526 | −1878 | −4657 | −4155 | 3087 | −4395 | 1092 | −653 | −4313 | −4359 | −4061 | −4374 | −3964 | −2301 | 1795 | −3455 | −3176 | 20 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 20(I) | 861 | −1151 | −2952 | −2395 | −1325 | −2834 | −1796 | 2510 | 1055 | −897 | −419 | −2235 | −2881 | −1930 | −2158 | −1929 | −1221 | 1545 | −1966 | −1583 | 21 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 21(N) | 813 | −2381 | 1347 | 1507 | −2662 | −1747 | −535 | −2406 | −208 | 412 | −1497 | 1534 | −1926 | −103 | −741 | −801 | −890 | −1984 | −2583 | −1885 | 22 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 22(H) | −4309 | −3316 | −4750 | −5034 | 2322 | −4652 | 3920 | −3257 | −4598 | −2616 | −2676 | −3292 | −4519 | −3412 | −4025 | −3892 | −4169 | −3395 | −160 | 3563 | 23 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 23(L) | −2786 | −2345 | −5148 | −4683 | −1172 | −4726 | −3816 | −28 | −4406 | 2803 | 4 | −4494 | −4312 | −3662 | −4132 | −4048 | −2728 | 1578 | −2811 | −2770 | 24 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 24(K) | −1571 | −1746 | −2549 | −1867 | −1651 | −2808 | −1423 | −501 | 2816 | 816 | −659 | −1866 | −2843 | −1214 | −884 | −1932 | −1496 | 1278 | −2219 | −1867 | 25 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 25(E) | −1094 | −2562 | −460 | 2079 | −2899 | 820 | −601 | −2638 | 1360 | −2558 | −1677 | −487 | −2036 | 2006 | −576 | −944 | −1037 | −2199 | −2703 | −2035 | 26 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 26(R) | 981 | −2341 | −1267 | −620 | −2805 | −2102 | −629 | −2433 | 1534 | −2379 | −1549 | −826 | −2190 | −201 | 2293 | −1120 | 1445 | −2071 | −2505 | −2019 | 27 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 27(G) | −3681 | −3593 | −4389 | −4747 | −5281 | 3812 | −4419 | −5908 | −5071 | −5671 | −5288 | −4417 | −4223 | −4850 | −4766 | −3952 | −4069 | −5125 | −4424 | −5214 | 28 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 28(H) | −792 | −959 | 1170 | −1245 | −823 | −2121 | 2520 | 1243 | −1075 | −814 | −148 | −1260 | −2191 | −907 | −1300 | −1141 | −732 | 1120 | −1278 | 1776 | 29 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |

TABLE 5-continued

| | | | | | | | | | | | | | | | | | | | | | |
|---|---|---|---|---|---|---|---|---|---|---|---|---|---|---|---|---|---|---|---|---|---|
| 29(E) | −3777 | −4125 | −1925 | 3871 | −4984 | −3355 | −3125 | −5379 | −3371 | −5156 | −4796 | −2611 | −3875 | −3007 | −3762 | −3630 | −3916 | −4960 | −4357 | −4463 | 30 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 30(V) | −1398 | −1296 | −3505 | −3062 | 1915 | −2838 | −1891 | −110 | −2753 | −806 | −463 | −2576 | 1648 | −2415 | −2655 | −2024 | −1427 | 2666 | −1672 | −1059 | 31 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 31(I) | −1903 | −1575 | −3829 | 1002 | −1980 | −3856 | −3129 | 3048 | −3318 | −1074 | −865 | −3323 | −3801 | −3173 | −3427 | −3072 | −1882 | 1884 | −3087 | −2660 | 32 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 32(D) | −2621 | −3795 | 3681 | −1030 | −4598 | −2524 | −2159 | −4724 | −2532 | −4603 | −4039 | −1389 | 1844 | −1902 | −3313 | −2398 | −2792 | −4123 | −4387 | −3801 | 33 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 33(C) | −773 | 2902 | −2248 | −1657 | 1518 | −2191 | 2246 | −300 | 952 | −640 | 16 | −1516 | −2253 | −1171 | −1445 | −1236 | −714 | 1306 | −1177 | −767 | 34 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −955 | −7714 | −1061 | −894 | −1115 | −701 | −1378 | * | * | | | | | | | | | | | | |
| 34(Y) | −1203 | −1551 | −1601 | −1557 | −258 | 2328 | −891 | −1846 | −1574 | −1893 | −1401 | −1430 | −2354 | −1422 | −1739 | −1353 | −1362 | −1612 | −847 | 3352 | 35 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −730 | −6778 | −1366 | −894 | −1115 | −2238 | −344 | * | * | | | | | | | | | | | | |
| 35(C) | −663 | 5232 | −2426 | −2431 | −1699 | −1297 | −1762 | −1061 | −2104 | −1610 | −1264 | −1804 | −1878 | −2021 | −1984 | −989 | −985 | −841 | −1907 | −1755 | 36 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −32 | −6081 | −7123 | −894 | −1115 | −158 | −3266 | * | * | | | | | | | | | | | | |
| 36(G) | 1599 | −1639 | −3268 | −3545 | −4089 | 3241 | −3249 | −3891 | −3693 | −4156 | −3271 | −2471 | −2659 | −3265 | −3555 | −1280 | −1496 | −2750 | −4224 | −4155 | 37 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 37(T) | −1019 | −1350 | −2595 | −2259 | −1755 | −2104 | −1851 | −1170 | −1982 | 1053 | −902 | −1947 | 1595 | −1859 | −2088 | −1345 | 2793 | −1049 | −2315 | −1957 | 38 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 38(W) | −1523 | −2432 | −1718 | −981 | −1961 | −2421 | 2452 | −2353 | 1666 | −2305 | −1571 | −1119 | −2450 | −391 | 1874 | −1468 | −1390 | −2096 | 3160 | 1968 | 39 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 39(Y) | −801 | −1431 | −1812 | −1432 | −2222 | 1018 | −1440 | −1940 | −1356 | −2172 | −1405 | −1370 | −2236 | −1227 | −1679 | 1947 | 1518 | −1551 | −2514 | 2318 | 40 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 40(D) | 993 | −2671 | 1719 | 1380 | −2973 | −1806 | −685 | −2750 | −415 | −2688 | −1805 | 1577 | −2046 | −259 | −980 | 940 | −1098 | −2291 | −2865 | −2121 | 41 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 41(E) | 1369 | −2816 | −578 | 3247 | −3818 | −2111 | −1670 | −3542 | −1674 | −3640 | −2924 | −1089 | −2643 | −1355 | −2219 | −1656 | −1910 | −2993 | −3818 | −3150 | 42 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 42(S) | −1288 | −2617 | 1789 | −359 | −3169 | −1909 | −949 | −2942 | −644 | −2904 | −2059 | −665 | −2229 | −549 | 1402 | 2434 | −1313 | −2461 | −3069 | −2377 | 43 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 43(V) | −1245 | −1672 | 1692 | −1380 | −2213 | −2223 | −1686 | −699 | −1737 | −1812 | −1281 | −1489 | −2602 | −1501 | −2109 | −1506 | 1297 | 2691 | −2717 | −2237 | 44 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 44(D) | −3832 | −4189 | 4132 | −2236 | −5073 | −3341 | −3194 | −5633 | −3716 | −5365 | −5035 | −2584 | −3886 | −3102 | −4252 | −3662 | −4000 | −5151 | −4434 | −4544 | 45 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 45(Y) | −4444 | −3646 | −4593 | −4892 | −509 | −4268 | −1873 | −3993 | −4663 | −3407 | −3460 | −3884 | −4503 | −3998 | −4255 | −4336 | −4491 | −4072 | −1177 | 4829 | 46 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |

TABLE 5-continued

| | | | | | | | | | | | | | | | | | | | | | |
|---|---|---|---|---|---|---|---|---|---|---|---|---|---|---|---|---|---|---|---|---|---|
| 46(P) | −4077 | −3791 | −4518 | −4858 | −5206 | −3818 | −4460 | −5898 | −5053 | −5602 | −5343 | −4628 | 4289 | −4938 | −4749 | −4364 | −4429 | −5313 | −4385 | −5119 | 47 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 47(D) | 1266 | −3140 | 3058 | −355 | −3519 | −2003 | 2575 | −3420 | −1274 | −3394 | −2630 | −706 | −2453 | −912 | −1929 | −1507 | −1766 | −2938 | −3557 | −2729 | 48 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 48(F) | −4356 | −3339 | −4801 | −5124 | 3760 | −4672 | −927 | −3241 | −4689 | −2576 | −2659 | −3327 | −4542 | −3456 | −4079 | −3933 | −4221 | −3405 | −176 | 3484 | 49 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 49(C) | 2748 | 3507 | −3864 | −4003 | −3721 | 1287 | −3190 | −3417 | −3713 | −3737 | −2859 | −2448 | −2504 | −3263 | −3472 | −1075 | −1267 | −2408 | −3992 | −3869 | 50 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 50(W) | −116 | 672 | 45 | 325 | −317 | −673 | 804 | −480 | 420 | −880 | 565 | 301 | −446 | 634 | 168 | −75 | 58 | −423 | 1003 | 81 | 51 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 51(S) | −865 | −1103 | −1784 | −1210 | −1118 | −2152 | −924 | 1475 | 1128 | 625 | −272 | −1256 | −2231 | −842 | −1085 | 1689 | −810 | −433 | −1540 | −1136 | 52 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 52(K) | 1123 | −2712 | −1604 | −858 | −3236 | −2371 | −691 | −2811 | 2311 | −2638 | −1829 | −1024 | −2404 | 1824 | 1815 | −1432 | −1402 | −2458 | −2653 | −2252 | 53 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 53(V) | 1377 | −1553 | −3986 | −3894 | −2567 | −2622 | −3338 | −77 | −3677 | −1766 | −1504 | −3013 | −3181 | −3423 | −3600 | −1969 | −1667 | 3237 | −3528 | −3166 | 54 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 54(A) | 3105 | −1485 | −3693 | −3696 | −2904 | −2074 | −3074 | −1142 | −3456 | −2386 | −1967 | −2606 | −2765 | −3150 | −3339 | −1426 | −1440 | 1452 | −3559 | −3269 | 55 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 55(E) | −824 | −2036 | −605 | 1957 | −2266 | −1768 | −476 | −1940 | −86 | 258 | −1161 | −452 | −1892 | 1690 | −545 | −750 | 1349 | −1608 | −2277 | −1663 | 56 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 56(M) | 1690 | −1463 | −1381 | −838 | −1839 | −1862 | −861 | −1440 | −562 | −1654 | 2427 | −963 | −2080 | −577 | 1591 | 974 | −820 | −1184 | −2068 | −1599 | 57 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 57(V) | −1994 | −1601 | −4529 | −4123 | −2121 | −4107 | −3665 | 1934 | −3944 | −1135 | −958 | −3809 | −4035 | −3771 | −3974 | −3368 | 1529 | 2897 | −3369 | −2935 | 58 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 58(A) | 1714 | −1019 | −2134 | −1563 | −1061 | −2272 | −1130 | −270 | 1039 | 717 | −221 | −1520 | −2360 | −1150 | −1407 | −1324 | −868 | 1473 | −1543 | −1159 | 59 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 59(S) | 1392 | −1641 | −1697 | −1273 | −3013 | 1054 | −1423 | −2728 | −1098 | −2828 | −1952 | −1262 | −2199 | −1068 | 1609 | 1984 | −1021 | −2082 | −3055 | −2568 | 60 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 60(D) | −1533 | −3153 | 1888 | −194 | −3445 | 1862 | −995 | −3255 | 1471 | −3173 | −2345 | 1731 | −2295 | −601 | −1467 | −1314 | −1531 | −2779 | −3350 | −2542 | 61 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 61(E) | −2454 | −3598 | −734 | 3350 | −4338 | −2504 | −1993 | −4322 | −2069 | −4232 | −3599 | −1369 | 1974 | −1704 | −2642 | −2264 | −2578 | −3797 | −4115 | −3566 | 62 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 62(C) | 1242 | 3033 | −3522 | −3271 | −2183 | 1444 | −2376 | −1404 | −2957 | −2030 | −1366 | −2284 | −2493 | −2598 | −2827 | −1179 | −1123 | 2256 | −2651 | −2354 | 63 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |

TABLE 5-continued

| | | | | | | | | | | | | | | | | | | | | | |
|---|---|---|---|---|---|---|---|---|---|---|---|---|---|---|---|---|---|---|---|---|---|
| 63(D) | −2066 | −3898 | 3072 | 1659 | −4131 | −2061 | −1387 | −4037 | −1584 | −3919 | −3220 | −662 | −2576 | −1047 | −2405 | 1367 | −2129 | −3512 | −4113 | −3127 | 64 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 64(F) | −1017 | −1052 | −2417 | −1841 | 2592 | 743 | −1090 | −537 | −1386 | 992 | −179 | −1687 | −2451 | −1311 | 1219 | −1447 | −968 | −481 | −1233 | −685 | 65 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 65(G) | −3681 | −3593 | −4389 | −4747 | −5281 | 3812 | −4419 | −5908 | −5071 | −5671 | −5288 | −4417 | −4223 | −4850 | −4766 | −3952 | −4069 | −5125 | −4424 | −5214 | 66 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 66(I) | −2267 | −1785 | −4907 | −4580 | −2305 | −4659 | −4548 | 3441 | −4497 | −1089 | −1042 | −4359 | −4451 | −4385 | −4606 | −4018 | −2264 | 1962 | −3955 | −3488 | 67 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 67(V) | −2579 | −2147 | −4998 | −4555 | −1338 | −4582 | −3788 | 186 | −4301 | 2387 | −167 | −4328 | −4258 | −3700 | −4104 | −3890 | −2537 | 2418 | −2919 | −2797 | 68 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 68(I) | 1028 | −1653 | −4289 | −3763 | −1242 | −3743 | −2838 | 2403 | −3462 | 1925 | −162 | −3419 | −3636 | −3025 | −3318 | −2924 | −1918 | 123 | −2418 | −2191 | 69 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 69(C) | −1722 | 5327 | −4261 | −4539 | −4366 | 1681 | −3791 | −4282 | −4361 | −4535 | −3781 | −3241 | −3196 | −4008 | −4052 | −1988 | −2176 | −3300 | −4234 | −4436 | 70 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 70(G) | −3681 | −3593 | −4389 | −4747 | −5281 | 3812 | −4419 | −5908 | −5071 | −5671 | −5288 | −4417 | −4223 | −4850 | −4766 | −3952 | −4069 | −5125 | −4424 | −5214 | 71 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 71(T) | −867 | −1487 | −3134 | −3249 | −3763 | −1745 | −2940 | −3511 | −3192 | −3793 | −2921 | −2264 | −2510 | −2890 | −3152 | 2412 | 3012 | −2488 | −3991 | −3778 | 72 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 72(G) | −3681 | −3593 | −4389 | −4747 | −5281 | 3812 | −4419 | −5908 | −5071 | −5671 | −5288 | −4417 | −4223 | −4850 | −4766 | −3952 | −4069 | −5125 | −4424 | −5214 | 73 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 73(I) | −1456 | −1212 | −3647 | −3087 | −1191 | −3172 | −2148 | 1791 | −2778 | 1612 | −249 | 1689 | −3151 | −2463 | −2697 | −2294 | −1408 | 1572 | −1993 | −1654 | 74 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 74(G) | −3681 | −3593 | −4389 | −4747 | −5281 | 3812 | −4419 | −5908 | −5071 | −5671 | −5288 | −4417 | −4223 | −4850 | −4766 | −3952 | −4069 | −5125 | −4424 | −5214 | 75 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 75(M) | −1505 | −1439 | −2739 | 1280 | −1204 | −2988 | −1884 | 2281 | −2088 | −440 | 3464 | −2268 | −3005 | −1923 | −2202 | −2107 | −1456 | −33 | −2043 | −1709 | 76 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 76(S) | −1333 | −2135 | −1372 | −1436 | −3459 | −2013 | −1821 | −3425 | −1475 | −3465 | −2693 | −1479 | −2581 | 2219 | −1727 | 3042 | −1599 | −2724 | −3495 | −2963 | 77 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 77(I) | −2873 | −2478 | −4720 | −4678 | −2491 | −4148 | −4128 | 3883 | −4491 | −1465 | −1516 | −4385 | −4341 | −4341 | −4380 | −4023 | −2944 | −274 | −3641 | −3325 | 78 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 78(A) | 3577 | −2213 | −3823 | −4109 | −4242 | −2448 | −3656 | −3995 | −4111 | −4316 | −3680 | −3108 | −3185 | −3808 | −3906 | −1985 | −2175 | −3167 | −4199 | −4290 | 79 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 79(A) | 3577 | −2213 | −3823 | −4109 | −4242 | −2448 | −3656 | −3995 | −4111 | −4316 | −3680 | −3108 | −3185 | −3808 | −3906 | −1985 | −2175 | −3167 | −4199 | −4290 | 80 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |

TABLE 5-continued

| | | | | | | | | | | | | | | | | | | | | | |
|---|---|---|---|---|---|---|---|---|---|---|---|---|---|---|---|---|---|---|---|---|---|
| 80(N) | −3232 | −3514 | −2565 | −2905 | −4358 | −3267 | −3364 | −5192 | −3627 | −5059 | −4632 | 4348 | −3843 | −3410 | −3792 | −3319 | −3533 | −4568 | −4087 | −3976 | 81 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 81(K) | −2769 | −3360 | −3563 | −2082 | −4290 | −3219 | −1077 | −3575 | 3452 | −3190 | −2544 | −1922 | −3154 | −661 | 1962 | −2645 | −2419 | −3363 | −2992 | −2942 | 82 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 82(V) | −2562 | −2155 | −4248 | −4013 | 2138 | −3815 | −1138 | −1239 | −3626 | −1489 | −1249 | −2992 | −3772 | −2916 | −3308 | −2976 | −2495 | 2869 | −487 | 2531 | 83 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 83(P) | 1138 | −1825 | −2169 | −1812 | −3266 | −1977 | −1695 | −2922 | −1049 | −3027 | −2235 | −1654 | 3217 | −1386 | 1621 | −1263 | −1362 | −2321 | −3212 | −2864 | 84 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 84(G) | −3681 | −3593 | −4389 | −4747 | −5281 | 3812 | −4419 | −5908 | −5071 | −5671 | −5288 | −4417 | −4223 | −4850 | −4766 | −3952 | −4069 | −5125 | −4424 | −5214 | 85 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 85(I) | 1178 | −1604 | −4535 | −4139 | −2133 | −4064 | −3684 | 2994 | −3965 | −1141 | −968 | −3805 | −4021 | −3786 | −3992 | −3332 | −1991 | 1929 | −3389 | −2957 | 86 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 86(R) | −4070 | −3868 | −4406 | −3890 | −4820 | −3837 | −3026 | −5122 | −1946 | −4739 | −4314 | −3731 | −4155 | −2844 | 4177 | −4178 | −4041 | −4836 | −3949 | −4248 | 87 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 87(C) | 3127 | 3526 | −4003 | −4188 | −3706 | −1841 | −3306 | −3157 | −3846 | −3666 | −2895 | −2592 | −2621 | −3421 | −3568 | −1217 | −1400 | −2337 | −3995 | −3877 | 88 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 88(A) | 3118 | −1485 | −3690 | −3696 | −2915 | −2067 | −3074 | −1169 | −3456 | −2402 | −1981 | −2601 | −2760 | −3150 | −3338 | −1419 | −1438 | 1408 | −3566 | −3277 | 89 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 89(L) | −2621 | −2188 | −5029 | −4579 | −1297 | −4611 | −3789 | 140 | −4321 | 2497 | −125 | −4360 | −4267 | −3687 | −4107 | −3921 | −2576 | 2256 | −2890 | −2788 | 90 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 90(C) | 1598 | 5216 | −4037 | −4247 | −3738 | −1886 | −3358 | −3145 | −3899 | −3690 | −2948 | −2646 | −2666 | −3485 | −3609 | −1272 | −1455 | −2354 | −4021 | −3911 | 91 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 91(W) | −847 | −784 | −2568 | −1982 | −511 | −2297 | −1037 | −302 | −1685 | 769 | 14 | −1718 | −2357 | −1413 | −1689 | 774 | 1162 | −215 | 3352 | 2036 | 92 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 92(D) | −1013 | −2495 | 1532 | 1311 | 1377 | −1771 | −593 | −2538 | −288 | −2499 | −1615 | 1531 | −1973 | −164 | −834 | 1173 | −971 | −2102 | −2688 | −1972 | 93 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 93(H) | −817 | −1384 | −1507 | −1084 | −1784 | −1873 | 2564 | −1410 | −956 | −1673 | −941 | −1146 | 2214 | −877 | −1282 | 988 | −894 | 1344 | −2095 | −1624 | 94 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 94(Y) | −1842 | −3126 | 1667 | −511 | −1838 | −2196 | −1098 | −3110 | −1200 | −3017 | −2371 | −838 | −2565 | 2147 | −1749 | −1638 | −1843 | −2778 | −2296 | 3645 | 95 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 95(M) | −833 | −1274 | −2650 | −2318 | −2137 | −1862 | −1931 | −1658 | −2079 | −1974 | 3504 | −1882 | −2399 | −1915 | −2195 | 1148 | 2537 | −1344 | −2548 | −2193 | 96 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 96(A) | 3577 | −2213 | −3823 | −4109 | −4242 | −2448 | −3656 | −3995 | −4111 | −4316 | −3680 | −3108 | −3185 | −3808 | −3906 | −1985 | −2175 | −3167 | −4199 | −4290 | 97 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |

TABLE 5-continued

| | | | | | | | | | | | | | | | | | | | | | |
|---|---|---|---|---|---|---|---|---|---|---|---|---|---|---|---|---|---|---|---|---|---|
| 97(R) | 1999 | −2479 | −1633 | −1012 | −3127 | −2309 | −867 | −2719 | 83 | −2636 | −1854 | −1142 | −2449 | 1831 | 2446 | −1447 | −1431 | −2360 | −2716 | −2321 | 98 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 98(M) | −3154 | −2620 | −5525 | −4938 | −957 | −5202 | −3935 | 1746 | −4695 | 2559 | 2719 | −4894 | −4446 | −3636 | −4262 | −4494 | −3018 | −926 | −2688 | −2829 | 99 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 99(S) | 2331 | −1459 | −3358 | −3521 | −3885 | −1723 | −3093 | −3652 | −3467 | −3930 | −3025 | −2336 | −2506 | −3077 | −3353 | 2771 | −1296 | −2534 | −4111 | −3952 | 100 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 100(R) | −4070 | −3868 | −4406 | −3890 | −4820 | −3837 | −3026 | −5122 | −1946 | −4739 | −4314 | −3731 | −4155 | −2844 | 4177 | −4178 | −4041 | −4836 | −3949 | −4248 | 101 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 101(W) | −116 | 672 | 45 | 325 | −317 | −673 | 804 | −480 | 420 | −880 | 565 | 301 | −446 | 634 | 168 | −75 | 58 | −423 | 1003 | 81 | 102 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 102(E) | −836 | −2091 | −540 | 2043 | −2343 | −1754 | −487 | 1015 | −118 | −2081 | −1230 | −432 | −1892 | 1663 | −598 | 904 | −784 | −1672 | −2338 | −1704 | 103 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 103(H) | −4406 | −3961 | −3921 | −4171 | −3231 | −3926 | 5401 | −5468 | −3992 | −5013 | −4849 | −4130 | −4378 | −4151 | −3893 | −4548 | −4592 | −5195 | −3383 | −2818 | 104 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 104(N) | −3232 | −3514 | −2565 | −2905 | −4358 | −3267 | −3364 | −5192 | −3627 | −5059 | −4632 | 4348 | −3843 | −3410 | −3792 | −3319 | −3533 | −4568 | −4087 | −3976 | 105 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 105(D) | −2358 | −4145 | 3182 | −424 | −4431 | −2177 | −1648 | −4495 | −2025 | −4352 | −3768 | 2917 | −2760 | −1348 | −2952 | −2013 | −2474 | −3924 | −4442 | −3425 | 106 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 106(A) | 3194 | −1459 | −3484 | −3625 | −3734 | −1755 | −3095 | −3265 | −3460 | −3690 | −2869 | −2384 | −2530 | −3106 | −3321 | −1118 | 1557 | −2359 | −4008 | −3849 | 107 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 107(N) | −2080 | −3282 | −571 | −790 | −3700 | −2288 | −1530 | −3842 | −1203 | −3719 | −3049 | 3691 | −2763 | 2236 | −1546 | −1908 | −2165 | −3350 | −3610 | −2909 | 108 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 108(I) | −2342 | −1862 | −4934 | −4526 | −1839 | −4657 | −4129 | 3048 | −4390 | 1219 | −617 | −4313 | −4352 | −4035 | −4357 | −3961 | −2310 | 1756 | −3416 | −3152 | 109 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 109(L) | −2474 | −2000 | −5009 | −4549 | −1506 | −4685 | −3925 | 2021 | −4370 | 2279 | −300 | −4348 | −4307 | −3824 | −4225 | −3966 | −2422 | 1754 | −3091 | −2958 | 110 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 110(C) | 2049 | 3245 | −3519 | −3308 | −2421 | 1482 | −2476 | −1789 | −3007 | −2304 | −1604 | −2272 | −2469 | −2649 | −2890 | −1125 | −1135 | 1329 | −2854 | −2572 | 111 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 111(I) | −2258 | −1872 | −4687 | −4134 | 1767 | −4166 | −3117 | 1920 | −3850 | 1870 | −15 | −3821 | −3889 | −3252 | −3621 | −3354 | −2187 | 1613 | −2474 | −2317 | 112 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 112(G) | −2025 | −2501 | −3252 | −3562 | −4636 | 3423 | −3593 | −4733 | −3987 | −4806 | −4072 | −3048 | 1823 | −3657 | −3934 | −2250 | −2455 | −3689 | −4320 | −4566 | 113 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 113(E) | −1494 | −2693 | −395 | 2314 | −3675 | 2184 | −1408 | −3492 | −1389 | −3481 | −2679 | −859 | −2439 | −1060 | −1986 | 1095 | −1645 | −2877 | −3669 | −2925 | 114 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |

TABLE 5-continued

| | | | | | | | | | | | | | | | | | | | | | |
|---|---|---|---|---|---|---|---|---|---|---|---|---|---|---|---|---|---|---|---|---|---|
| 114(R) | −4070 | −3868 | −4406 | −3890 | −4820 | −3837 | −3026 | −5122 | −1946 | −4739 | −4314 | −3731 | −4155 | −2844 | 4177 | −4178 | −4041 | −4836 | −3949 | −4248 | 115 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 115(M) | −1427 | −1193 | −3701 | −3112 | −983 | −3093 | −2034 | 180 | −2770 | 1017 | 2778 | −2712 | −3065 | −2386 | −2624 | −2210 | 1347 | 2148 | −1810 | −1513 | 116 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 116(H) | −1008 | −888 | −2923 | −2346 | −929 | −2548 | 2597 | 1535 | −2026 | −676 | −116 | −2056 | −2607 | −1772 | −2006 | −1637 | 1320 | 2074 | −1492 | −1124 | 117 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 117(G) | −1110 | −1709 | −3106 | −3357 | −4046 | 3242 | −3166 | −3842 | −3502 | −4106 | −3252 | −2451 | −2702 | −3156 | −3425 | −1349 | 1883 | −2772 | −4162 | −4067 | 118 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 118(V) | 929 | −1443 | −4036 | −3547 | −1453 | −3385 | −2674 | 364 | −3251 | 1653 | −427 | −3137 | −3432 | −2922 | −3158 | −2578 | −1681 | 2482 | −2440 | −2125 | 119 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 119(E) | 1257 | −3590 | 1744 | 2835 | −3875 | −2022 | −1272 | −3730 | −1355 | −3645 | −2894 | −639 | −2490 | −916 | −2095 | −1605 | −1921 | −3229 | −3840 | −2931 | 120 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 120(L) | −1618 | −1542 | −2809 | 1300 | −1194 | −3091 | −2015 | −38 | −2244 | 2157 | −192 | −2386 | −3103 | −2043 | −2351 | −2230 | −1572 | 1529 | −2118 | −1807 | 121 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 121(A) | 2991 | −1555 | −3668 | −3533 | −2323 | −2475 | −2954 | 1759 | −3277 | −1606 | −1355 | −2778 | −3028 | −3047 | −3226 | −1812 | −1600 | −325 | −3174 | −2823 | 122 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 122(F) | −1286 | −1561 | −2176 | −1442 | 1607 | −2460 | −947 | −1068 | 1345 | 1590 | −603 | −1448 | −2487 | −784 | 1605 | −1533 | −1185 | −1008 | −1748 | −1316 | 123 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 123(W) | 1015 | −1816 | 1148 | 1268 | −1999 | −1728 | −432 | −1665 | −102 | −1774 | 2024 | −436 | −1835 | −38 | −580 | −680 | −661 | −1365 | 2839 | −1494 | 124 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 124(I) | −2873 | −2478 | −4720 | −4678 | −2491 | −4148 | −4128 | 3883 | −4491 | −1465 | −1516 | −4385 | −4341 | −4341 | −4380 | −4023 | −2944 | −274 | −3641 | −3325 | 125 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 125(V) | −2255 | −1772 | −4901 | −4575 | −2348 | −4657 | −4567 | 2056 | −4497 | −1141 | −1081 | −4354 | −4453 | −4405 | −4618 | −4017 | −2252 | 3294 | −3996 | −3509 | 126 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 126(D) | −2267 | −2933 | 3576 | −1195 | −3049 | −2596 | −2082 | 1629 | −2341 | −2627 | −2373 | −1509 | −3085 | −1871 | −2936 | −2291 | −2378 | −1639 | −3578 | −2919 | 127 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 127(T) | 2302 | −1457 | −3444 | −3557 | −3687 | −1757 | −3050 | −3212 | −3391 | −3635 | −2820 | −2365 | −2526 | −3052 | −3274 | −1117 | 3078 | −2331 | −3963 | −3792 | 128 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 128(W) | −4265 | −3318 | −4806 | −5090 | 3775 | −4602 | −1029 | −3119 | −4653 | −2459 | −2540 | −3390 | −4514 | −3496 | −4074 | −3946 | −4152 | −3319 | 4590 | 900 | 129 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 129(L) | −2756 | −2316 | −5126 | −4663 | −1192 | −4704 | −3809 | 2 | −4390 | 2758 | −16 | −4468 | −4303 | −3665 | −4126 | −4024 | −2700 | 1709 | −2823 | −2772 | 130 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 130(Q) | −734 | −2114 | −590 | −69 | −2474 | 628 | −384 | −2203 | 1300 | −2173 | −1269 | −365 | −1805 | 1784 | −417 | 893 | 1322 | −1774 | −2356 | −1702 | 131 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |

TABLE 5-continued

| | | | | | | | | | | | | | | | | | | | | | |
|---|---|---|---|---|---|---|---|---|---|---|---|---|---|---|---|---|---|---|---|---|---|
| 131(T) | 2138 | −1458 | −3440 | −3556 | −3688 | −1758 | −3051 | −3210 | −3392 | −3636 | −2822 | −2366 | −2528 | −3053 | −3274 | −1119 | 3193 | −2331 | −3964 | −3794 | 132 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 132(P) | −1757 | −3237 | −258 | 1435 | −3607 | −2077 | −1164 | −3400 | −916 | −3319 | −2549 | −731 | 3132 | 1857 | −1396 | −1544 | −1767 | −2952 | −3466 | −2728 | 133 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 133(W) | −4382 | −3341 | −4820 | −5151 | 3666 | −4691 | −907 | −3282 | −4707 | −2619 | −2695 | −3319 | −4550 | −3452 | −4084 | −3936 | −4237 | −3432 | 3961 | 2712 | 134 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 134(S) | −1405 | −3017 | 1625 | 1413 | −3291 | −1894 | −892 | −3094 | −722 | −3018 | −2168 | −505 | −2213 | 1798 | −1331 | 2056 | −1390 | −2623 | −3196 | −2403 | 135 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 135(G) | −2298 | −2923 | −2103 | −2123 | −4319 | 3238 | −2236 | −4181 | 1859 | −4078 | −3400 | −2169 | −3219 | −1952 | −1577 | −2354 | −2488 | −3582 | −3805 | −3682 | 136 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 136(G) | 1377 | −2300 | −719 | 1534 | −3577 | 2593 | −1598 | −3339 | −1577 | −3413 | −2605 | −1073 | −2447 | −1275 | −2099 | −1324 | −1539 | −2684 | −3628 | −2995 | 137 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −955 | −7714 | −1061 | −894 | −1115 | −701 | −1378 | * | * | | | | | | | | | | | | |
| 137(Q) | −1004 | −2435 | 277 | 2184 | −2728 | −1440 | −405 | −2509 | −53 | −2439 | −1658 | −87 | −1766 | 2784 | −483 | −813 | −984 | −2099 | −2581 | −1891 | 138 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −20 | −6778 | −7821 | −894 | −1115 | −205 | −2915 | * | * | | | | | | | | | | | | |
| 138(R) | −4070 | −3868 | −4406 | −3890 | −4820 | −3837 | −3026 | −5122 | −1946 | −4739 | −4314 | −3731 | −4155 | −2844 | 4177 | −4178 | −4041 | −4836 | −3949 | −4248 | 139 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 139(H) | −4406 | −3961 | −3921 | −4171 | −3231 | −3926 | 5401 | −5468 | −3992 | −5013 | −4849 | −4130 | −4378 | −4151 | −3893 | −4548 | −4592 | −5195 | −3383 | −2818 | 140 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 140(Q) | 1807 | −2632 | −381 | 1381 | −3040 | −1903 | −848 | −2779 | −523 | −2755 | −1915 | −597 | −2182 | 2784 | −1005 | −1124 | −1254 | −2346 | −2947 | −2259 | 141 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 141(R) | −1893 | −2803 | −2103 | −1310 | −3474 | −2617 | −907 | −2983 | 247 | −2805 | −2065 | −1373 | −2680 | 1875 | 3184 | −1815 | 1244 | −2674 | −2793 | −2506 | 142 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 142(R) | −4070 | −3868 | −4406 | −3890 | −4820 | −3837 | −3026 | −5122 | −1946 | −4739 | −4314 | −3731 | −4155 | −2844 | 4177 | −4178 | −4041 | −4836 | −3949 | −4248 | 143 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 143(I) | −2264 | −1775 | −4915 | −4588 | −2348 | −4686 | −4596 | 3178 | −4516 | −1133 | −1075 | −4374 | −4468 | −4422 | −4639 | −4047 | −2259 | 2464 | −4009 | −3526 | 144 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 144(E) | −1362 | −2952 | 1820 | 2207 | −3237 | 905 | −855 | −3031 | −644 | −2955 | −2100 | −503 | −2190 | −446 | 1395 | −1165 | −1342 | −2565 | −3129 | −2354 | 145 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 145(K) | 908 | −1736 | −1815 | −1248 | −2070 | −2279 | −1093 | 1542 | 2712 | −1686 | −1079 | −1330 | −2446 | −804 | −667 | −1390 | −1204 | −917 | −2305 | −1891 | 146 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 146(I) | −2723 | −2229 | −5174 | −4732 | −1356 | −4887 | −4035 | 3364 | −4508 | 1438 | −167 | −4582 | −4423 | −3856 | −4303 | −4226 | −2664 | 18 | −3022 | −2924 | 147 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 147(R) | 1056 | −2064 | 1249 | −109 | −2476 | 670 | −454 | −2205 | −68 | −2198 | −1301 | −400 | −1828 | −15 | 1385 | −649 | 1095 | −1771 | −2401 | −1745 | 148 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |

TABLE 5-continued

| | | | | | | | | | | | | | | | | | | | | | |
|---|---|---|---|---|---|---|---|---|---|---|---|---|---|---|---|---|---|---|---|---|---|
| 148(E) | 2045 | −2691 | −641 | 2925 | −3737 | −2085 | −1663 | −3447 | −1644 | −3560 | −2829 | −1109 | −2614 | −1347 | −2170 | −1596 | −1833 | −2895 | −3749 | −3104 | 149 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −10 | −7714 | −8756 | −894 | −1115 | −701 | −1378 | * | * | | | | | | | | | | | | |
| 149(I) | −1835 | −1485 | −4226 | −3745 | −1377 | −3738 | −2668 | 2965 | −3461 | −847 | −625 | −3338 | −3665 | −3150 | −3370 | −2919 | −1800 | 1729 | −2313 | 2304 | 150 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −268 | −7714 | −2600 | −894 | −1115 | −701 | −1378 | * | * | | | | | | | | | | | | |
| 150(E) | −3293 | −3786 | −1473 | 3826 | −4560 | −2970 | −2663 | −4846 | −2841 | −4681 | −4279 | −2142 | −3486 | −2508 | −3255 | −3136 | −3421 | −4441 | −4028 | −4008 | 151 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −12 | −7457 | −8500 | −894 | −1115 | −1422 | −674 | * | * | | | | | | | | | | | | |
| 151(R) | 1141 | −2442 | −1246 | −549 | −2918 | −2090 | −473 | −2524 | 1742 | −2382 | −1557 | −744 | −2136 | 1966 | 2040 | −1122 | −1108 | −2160 | −2431 | −1985 | 152 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −12 | −7457 | −8500 | −894 | −1115 | −383 | −2099 | * | * | | | | | | | | | | | | |
| 152(W) | −116 | 672 | 45 | 325 | −317 | −673 | 804 | −480 | 420 | −880 | 565 | 301 | −446 | 634 | 168 | −75 | 58 | −423 | 1003 | 81 | 153 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −268 | −7714 | −2600 | −894 | −1115 | −701 | −1378 | * | * | | | | | | | | | | | | |
| 153(R) | −892 | −2132 | −875 | −271 | −2550 | −1817 | −388 | −2214 | 1600 | −2162 | −1306 | −513 | −1909 | 48 | 1621 | 1177 | 1556 | −1830 | −2302 | −1759 | 154 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −12 | −7457 | −8500 | −894 | −1115 | −1422 | −674 | * | * | | | | | | | | | | | | |
| 154(H) | −2093 | −2537 | −2330 | −1682 | −355 | −2870 | 4028 | −2443 | −365 | −2250 | −1763 | −1614 | −2893 | −919 | 1830 | −2037 | −1948 | −2306 | −903 | 2497 | 155 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −12 | −7457 | −8500 | −894 | −1115 | −1422 | −674 | * | * | | | | | | | | | | | | |
| 155(N) | 1159 | −2195 | −259 | 1687 | −2630 | −1609 | −505 | −2379 | −193 | −2358 | −1475 | 1694 | −1837 | −80 | −721 | 1098 | −811 | −1925 | −2555 | −1863 | 156 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −315 | −7457 | −2393 | −894 | −1115 | −1422 | −674 | * | * | | | | | | | | | | | | |
| 156(K) | 1690 | −1521 | −865 | −530 | −2502 | 1533 | −757 | −2176 | 1750 | −2258 | −1424 | −660 | −1836 | −385 | −644 | −643 | −725 | −1677 | −2484 | −1967 | 157 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −399 | −7158 | −2093 | −894 | −1115 | −1887 | −455 | * | * | | | | | | | | | | | | |
| 157(N) | −790 | −1650 | −328 | −436 | −2633 | −1372 | −1008 | −2562 | −866 | −2649 | −1902 | 2721 | 2673 | −726 | −1253 | −817 | −995 | −2001 | −2694 | −2132 | 158 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −20 | −6778 | −7821 | −894 | −1115 | −2238 | −344 | * | * | | | | | | | | | | | | |
| 158(P) | −1088 | −1976 | −873 | −547 | −2653 | −1746 | −572 | −2325 | 2405 | −2286 | −1551 | −699 | 2531 | −199 | 98 | −1053 | −1080 | −1961 | −2327 | −1945 | 159 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −20 | −6778 | −7821 | −894 | −1115 | −2238 | −344 | * | * | | | | | | | | | | | | |
| 159(V) | −426 | −819 | −2080 | −1971 | −1792 | 2096 | −1692 | −548 | −1871 | −1495 | −974 | −1512 | −1984 | −1695 | −1954 | −748 | −707 | 2424 | −2283 | −1922 | 160 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −20 | −6778 | −7821 | −894 | −1115 | −2238 | −344 | * | * | | | | | | | | | | | | |
| 160(P) | −582 | −884 | −2096 | −1889 | −1505 | −1633 | −1594 | −145 | −1691 | −1065 | −663 | −1563 | 2575 | −1584 | −1800 | −950 | −795 | 2279 | −2100 | −1706 | 161 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −20 | −6778 | −7821 | −894 | −1115 | −2238 | −344 | * | * | | | | | | | | | | | | |
| 161(K) | −1017 | −1896 | −750 | −549 | −2759 | 2163 | −702 | −2465 | 2406 | −2443 | −1689 | −704 | −1983 | −342 | −168 | −1002 | −1075 | −2029 | −2466 | −2077 | 162 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −636 | −6778 | −1526 | −894 | −1115 | −2238 | −344 | * | * | | | | | | | | | | | | |
| 162(A) | 2922 | −540 | −1434 | −1448 | −1894 | −835 | −1345 | −1218 | −1400 | −1722 | −1180 | −1009 | −1484 | −1278 | −1495 | −255 | −368 | −799 | −2185 | −1887 | 163 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −30 | −6173 | −7215 | −894 | −1115 | −2556 | −269 | * | * | | | | | | | | | | | | |
| 163(P) | −1156 | −1409 | −1589 | −1713 | −2421 | −1496 | −1697 | −2442 | −1763 | −2529 | −2100 | −1603 | 3866 | −1742 | −1822 | −1358 | −1449 | −2044 | −2236 | −2262 | 164 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −30 | −6173 | −7215 | −894 | −1115 | −2556 | −269 | * | * | | | | | | | | | | | | |
| 164(A) | 2922 | −540 | −1434 | −1448 | −1894 | −835 | −1345 | −1218 | −1400 | −1722 | −1180 | −1009 | −1484 | −1278 | −1495 | −255 | −368 | −799 | −2185 | −1887 | 165 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −30 | −6173 | −7215 | −894 | −1115 | −162 | −3233 | * | * | | | | | | | | | | | | |

TABLE 5-continued

| | | | | | | | | | | | | | | | | | | | | | |
|---|---|---|---|---|---|---|---|---|---|---|---|---|---|---|---|---|---|---|---|---|---|
| 165(W) | −116 | 672 | 45 | 325 | −317 | −673 | 804 | −480 | 420 | −880 | 565 | 301 | −446 | 634 | 168 | −75 | 58 | −423 | 1003 | 81 | 166 |
| — | * | * | * | * | * | * | * | * | * | * | * | * | * | * | * | * | * | * | * | * | |
| — | * | * | * | * | * | * | * | * | 0 | | | | | | | | | | | | |

[1]Program name and version
[2]Name of the input sequence alignment file
[3]Length of the alignment: include indels
[4]Type of residues
[5]Map of the match states to the columns of the alignment
[6]Commands used to generate the file: this one means that hmmbuild (default parameters) was applied to the alignment file
[7]Commands used to generate the file: this one means that hmmcalibrate (default parameters) was pplied to the hmm profile
[8]Number of sequences in the alignment
[9]When the file was generated
[10]The trasition probability distribution for the null model (single G state).
[11]The symbol emission probability distribution for the null model (G tate); consists of K integers. The null probability used to convert these back to model probabilities is 1/K.
[12]The extreme value distribution parameters μ and lambda respectively, both floating point values. Lambda is positive and nonzero. These values are set when the model is calibrated with hmmcalibrate.

SEQUENCE LISTING (4132 sequences)

SEQ ID NO: 1 - DNA, 38 bp, artificial sequence
  primer
ttcccggaggtaaccgtgacctctgctgtgccatcaaa

SEQ ID NO: 2 - DNA, 35 bp, artificial sequence
  primer
ccgctcgagctagatattgaactgaggattcgaaa

SEQ ID NO: 3 - DNA, 39 bp, artificial sequence
  primer
catgccatgggagctcactagtcgatctgtgctgtttgc

SEQ ID NO: 4 - DNA, 36 bp, artificial sequence
  primer
cacagcagaggtcacggttacctccgggaaacgcgg

SEQ ID NO: 5 - DNA, 40 bp, artificial sequence
  primer
catgccatgggagctcgttcgatcaacaacccgaatccta

SEQ ID NO: 6 - DNA, 42 bp, artificial sequence
  primer
ttcatcctgcgtcatgtttattctcctaacttattaagtagc

SEQ ID NO: 7 - DNA, 41 bp, artificial sequence
  primer
gttaggagaataaacatgacgcaggatgaattgaaaaaagc

SEQ ID NO: 8 - DNA, 34 bp, artificial sequence
  primer
ccgctcgagtcatttcacaatggttttgacaccg

SEQ ID NO: 9 - DNA, 42 bp, artificial sequence
  primer
cacagcagaggtcatgtttattctcctaacttattaagtagc

SEQ ID NO: 10 - DNA, 38 bp, artificial sequence
  primer
gttaggagaataaacatgacctctgctgtgccatcaaa

SEQ ID NO: 11 - DNA, 35 bp, artificial sequence; identical to SEQ ID NO: 2
  primer

SEQ ID NO: 12 - DNA, 42 bp, artificial sequence
  primer
cacagcagaggtcacgtttattctcctaacttattaagtagc

SEQ ID NO: 13 - DNA, 38 bp, artificial sequence
  primer
gttaggagaataaacgtgacctctgctgtgccatcaaa

SEQ ID NO: 14 - DNA, 186 bp, Actinoplanes missouriensis
ctagtcgatctgtgctgtttgccacggtatgcagcaccagcgcgagattatgggctcgcacgctcgactgtcggacgggggcactggaacgagaagtcaggcgagccgtcacgcccttgacaatgccacatcctgagcaaataattcaaccactaaacaaatcaaccgcgtttcccggaggtaacc

SEQ ID NO: 15 - DNA, 6461 bp, artificial sequence
  constructed plasmid for replication in E. coli and Zymomonas with tetracycline resistance marker
ggccgctaattccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtatttattcggcgcaaagtgcgtcgggtgatgctgccaacttactgatttagtgtatgatggtgtttttgaggtgctccagtggcttctgtttctatcagctgtccctcctgttcagctactgacggggtggtgcgtaacggcaaaagcaccgccggacatcagcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttccccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccggtaactatcgtcttgagtccaacccggaaagacatgcaaaagcaccactggcagcagccactggtaattgatttagaggagttagtcttgaagtcatgcgccggttaaggctaaactgaaaggacaagttttggtgactgcgctcctccaagccagttacctcggttcaaagagttggtagctcagagaaccttcgaaaaaccgccctgcaaggcggttttttcgttttcagagcaagagattacgcgcagaccaaaacgatctcaagaagatcatcttattaatcagataaaatatttctagatttcagtgcaatttatctcttcaaatgtagcacctgaagtcagccccatacgatataagttgtaattctcatgtttgacagcttatcatcgatggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgactgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagagagctggggaagactatgcgcgatctgttgaaggtggttctaagcctcgtacttgcgatggcatcggggcaggcacttgctgacctgccaacgcgcctttgtagtcttggcctgttgtgtgcatgagcaaatcaatggcaccaccccctcctttttgagctgaatggtcataaaatttataattatctatcgtaattcggaatctatgttcagggtctcgccattgctttttgtctgctgggtcaagttccatgcctaaggtttttaagacatcagaaagaggtattgcacgcatgctatcagcttttcttctagctaatgacagggcttcctctgctctatctgctcgttttttttcttccacatatctcgccgctttgtcagccagcggctgtattacggaaagtgccgatttttgggcttttaggcgttctttttctgcccattcttccttatttgtaaaaattgagggtgggatgggtgcctgaatcttgggatctagctgtaaagttttgttgatatttccgtaatgtctttggactctttgatgcgttgcttttgaaccttttacgcctctggccagccctagaggctccatagaagccgcataatccgtctggagggcagaaagggcttttcgaccatcaaaccatctcgatgcgtttaaacggcctgtatcggggtctctaggcaccataaagccggttaagtggggtgttgtttcatcagcatgtagctgaagagatacaaggttgttttctccaaaggtttgttccgcccattgctgggtgattgttttccagtgttcgagtttttcaggagtggcctgttttgaccattctggagacataccaaagaacagttctatggcctgcacaccgttttttctaagaggctttcccgtttctttctgaattttattcagcatagatttaacatctgctgatgggtcagtagagcctttgagtatttcgtttagttcttttctatctgggtcagcgttttgtgtttcgcggcctcgcgtcatatgcaggctcgcggctttaatcgtgccaactgttttatgtttttcaaacctaaagattgcatagttcggcatgttttaactgctttaatttgagaaaagaccagaggaaataatccagcctatatttctttccctagtagcgaactggaattgtttttccgaaggaaaaaagcaattccgtagtgagtactgaatttattctgattcgtcttgcttttggagcgtctttttgcgttctataactgttgtgaaagctacgcggtcgccattgaaaacgaaattaggattaataaaataccatccttggcgaacatgctttgcaatgattttagctttttctaattcggctagacctcttgcaaaggtagcttgagatagtgccagttttttttcttgtgcgttaagaaagtcctctaaaacgaatttgtctaaagggacgaggtctttgctgatgcctttgtcttgaagtatccaaaccagaacgctgaaagcttttattccagcggctcctagttcaaaagttagcgcgatattggtgctaaataattttacaaattcttcactatcaacacgtctgtaagtcgtcacatgagtgccttgcatctcaccagtggcttgattgaccagaatgttatcatctcgtcctaatcgagataactgaaccctctgacttttaactggcacaaccataccttcgatgaaaggattctcgtcatatctgattggctgctttctcaattttgtcgccatatttgataaacctttaatcaaaaaaaccacattttttgattatacctattcatcgaatgaggcaaggtctatcaattttacccctttttttgatagacggtttaatcaatattgatagaccccttcacagattctgaaaatcgacttccctattttagggatattttcacgattccctttcttagttcttcctagtggggaaattcgttgaatcctgcctcggaaaaaccatgagaaagctgttggttatatacacgggcaaagccaccctatttttagctactggggaaagagataaggcagggtatttgtaaaattaaaaccggatttttcgctttacggtttgtttaggcgcaactgtctttttaagaccgcgtttaaccatcaaaagatcgttccaatcttttccgtgtatcatctgttctttaggtgggagccagttttcaactttttttgttggaaacgcggctttaatcgctccgactaatagcgatgctgctctttgtcctacagcatcccaatcataggcaatatggacagaagatgccttttcaacgatttttcggagagttttagtaagagacgttcttacgccgctggtgcttaataattttacgccagctttaattttttctgggcttaaaaagccgactactgaaatcgcgtctatcgcactttcagcgatataaagatcatacttttcgtcattttttacattgatgctgccagtaaaatgggcttcgcgactgcttcccaaggctaaccctttaaaaccactgcttgttccgcgtaattctgcgccctgaagtgtatctttatcgtcatacatcaagaaggctacattaccgcgatcatctgttcggatagagtcaggaatattgttaaatgatattcctcgggcagcgttgggtcctggccacgggtgcgcatgatcgtgctcctgtcgttgaggacccggctaggctggcggggttgccttactggttagcagaatgaatcaccgatacgcgagcgaacgtgaagcgactgctgctgcaaaacgtctgcgacctgagcaacaacatgaatggtcttcggtttccgtgtttcgtaaagtctggaaacgcggaagtcccctacgtgctgctgaagttgcccgcaacagagagtggaaccaaccggtgataccacgatactatgactgagagtcaacgccatgagcggcctcatttcttattctgagttacaacagtccgcaccgctgtccggtagctccttccggtgggcgcggggcatgactatcgtcgccgcacttatgactgtcttctttatcatgcaactcgtaggacaggtgccggcagcgcccaacagtcccccggccacggggcctgccaccatacccacgccgaaacaagcgccctgcaccattatgttccggatctgcatcgcaggatgctgctggctaccctgtggaacacctacatctgtattaacgaagcgctaaccgtttttatcaggctctgggaggcagaataaatgatcatatcgtcaattattacctccacggggagagcctgagcaaactggcctcaggcatttgagaagcacacggtcacactgcttccggtagtcaataaaccggtaaaccagcaatagacataagcggctatttaacgaccctgccctgaaccgacgaccgggtcgaatttgctttcgaatttctgccattcatccgcttattatcacttattcaggcgtagcaccaggcgtttaagggcaccaataactgccttaaaaaaattacgccccgccctgccactcatcgcagtactgttgtaattcattaagcattctgccgacatggaagccatcacagacggcatgatgaacctgaatcgccagcggcatcagcaccttgtcgccttgcgtataatatttgcccatggtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaattagc

SEQ ID NO: 16 - DNA, 6933 bp, artificial sequence
  constructed plasmid: pZB188/aadA vector containing a chimeric gene with the A. missourinesis GI promoter and Z. mobilis RPI-A coding region
catgggagctcactagtcgatctgtgctgtttgccacggtatgcagcaccagcgcgagattatgggctcgcacgctcgactgtcggacgggggcactggaacgagaagtcaggcgagccgtcacgcccttgacaatgccacatcctgagcaaataattcaaccactaaacaaatcaaccgcgtttcccggaggtaaccgtgacctctgctgtgccatcaaatacgaaaaaaaagctggtgattgcttccgatcacgcagcatttgagttgaaatcaaccttgattacttggctgaaagagcttggtcatgaggtcgaagaccttggccctcatgaaaaccattcagtcgattatcccgattacggttataagctggctgtcgctatcgcagaaaaaaccgctgatttcggtattgctttatgtggctcgggaatcggtatctcgatcgctgtcaatcgccatccggctgcccgttgcgctttgattacggataaccttaccgcccgtttggcaagagaacataacaatgccaatgttatcgctatgggtgcgagattgatcggcattgaaaccgctaaggattgtatttcagctttccttgcaacgccgtttggaggtgaacgtcatgttcgccgtatcgataaactttcgaatcctcagttcaatatctagtgactcgaggcggcctgaacgtactgcaagtcctgacgtcactgtgcagtccgttggcccggttatcggtagcgataccgggcatttttttaaggaacgatcgatagcggccgctaattccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtatttattcggcgcaaagtgcgtcgggtgatgctgccaacttactgatttagtgtatgatggtgtttttgaggtgctccagtggcttctgtttctatcagctgtccctcctgttcagctactgacggggtggtgcgtaacggcaaaagcaccgccggacatcagcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttccccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccggtaactatcgtcttgagtccaacccggaaagacatgcaaaagcaccactggcagcagccactggtaattgatttagaggagttagtcttgaagtcatgcgccggttaaggctaaactgaaaggacaagttttggtgactgcgctcctccaagccagttacctcggttcaaagagttggtagctcagagaaccttcgaaaaaccgccctgcaaggcggttttttcgttttcagagcaagagattacgcgcagaccaaaacgatctcaagaagatcatcttattaatcagataaaatatttctagatttcagtgcaatttatctcttcaaatgtagcacctgaagtcagccccatacgatataagttgtaattctcatgtttgacagcttatcatcgatggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgactgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagagagctggggaagactatgcgcgatctgttgaaggtggttctaagcctcgtacttgcgatggcatcggggcaggcacttgctgacctgccaacgcgcctttgtagtcttggcctgttgtgtgcatgagcaaatcaatggcaccaccccctcctttttgagctgaatggtcataaaatttataattatctatcgtaattcggaatctatgttcagggtctcgccattgctttttgtctgctgggtcaagttccatgcctaaggtttttaagacatcagaaagaggtattgcacgcatgctatcagcttttcttctagctaatgacagggcttcctctgctctatctgctcgttttttttcttccacatatctcgccgctttgtcagccagcggctgtattacggaaagtgccgatttttgggcttttaggcgttctttttctgcccattcttccttatttgtaaaaattgagggtgggatgggtgcctgaatcttgggatctagctgtaaagttttgttgatatttccgtaatgtctttggactctttgatgcgttgcttttgaaccttttacgcctctggccagccctagaggctccatagaagccgcataatccgtctggagggcagaaagggcttttcgaccatcaaaccatctcgatgcgtttaaacggcctgtatcggggtctctaggcaccataaagccggttaagtggggtgttgtttcatcagcatgtagctgaagagatacaaggttgttttctccaaaggtttgttccgcccattgctgggtgattgttttccagtgttcgagtttttcaggagtggcctgttttgaccattctggagacataccaaagaacagttctatggcctgcacaccgttttttctaagaggctttcccgtttctttctgaattttattcagcatagatttaacatctgctgatgggtcagtagagcctttgagtatttcgtttagttcttttctatctgggtcagcgttttgtgtttcgcggcctcgcgtcatatgcaggctcgcggctttaatcgtgccaactgttttatgtttttcaaacctaaagattgcatagttcggcatgttttaactgctttaatttgagaaaagaccagaggaaataatccagcctatatttctttccctagtagcgaactggaattgtttttccgaaggaaaaaagcaattccgtagtgagtactgaatttattctgattcgtcttgcttttggagcgtctttttgcgttctataactgttgtgaaagctacgcggtcgccattgaaaacgaaattaggattaataaaataccatccttggcgaacatgctttgcaatgattttagctttttctaattcggctagacctcttgcaaaggtagcttgagatagtgccagttttttttcttgtgcgttaagaaagtcctctaaaacgaatttgtctaaagggacgaggtctttgctgatgcctttgtcttgaagtatccaaaccagaacgctgaaagcttttattccagcggctcctagttcaaaagttagcgcgatattggtgctaaataattttacaaattcttcactatcaacacgtctgtaagtcgtcacatgagtgccttgcatctcaccagtggcttgattgaccagaatgttatcatctcgtcctaatcgagataactgaaccctctgacttttaactggcacaaccataccttcgatgaaaggattctcgtcatatctgattggctgctttctcaattttgtcgccatatttgataaacctttaatcaaaaaaaccacattttttgattatacctattcatcgaatgaggcaaggtctatcaattttacccctttttttgatagacggtttaatcaatattgatagaccccttcacagattctgaaaatcgacttccctattttagggatattttcacgattccctttcttagttcttcctagtggggaaattcgttgaatcctgcctcggaaaaaccatgagaaagctgttggttatatacacgggcaaagccaccctatttttagctactggggaaagagataaggcagggtatttgtaaaattaaaaccggatttttcgctttacggtttgtttaggcgcaactgtctttttaagaccgcgtttaaccatcaaaagatcgttccaatcttttccgtgtatcatctgttctttaggtgggagccagttttcaactttttttgttggaaacgcggctttaatcgctccgactaatagcgatgctgctctttgtcctacagcatcccaatcataggcaatatggacagaagatgccttttcaacgatttttcggagagttttagtaagagacgttcttacgccgctggtgcttaataattttacgccagctttaattttttctgggcttaaaaagccgactactgaaatcgcgtctatcgcactttcagcgatataaagatcatacttttcgtcattttttacattgatgctgccagtaaaatgggcttcgcgactgcttcccaaggctaaccctttaaaaccactgcttgttccgcgtaattctgcgccctgaagtgtatctttatcgtcatacatcaagaaggctacattaccgcgatcatctgttcggatagagtcaggaatattgttaaatgatattcctcgggcagcgttgggtcctggccacgggtgcgcatgatcgtgctcctgtcgttgaggacccggctaggctggcggggttgccttactggttagcagaatgaatcaccgatacgcgagcgaacgtgaagcgactgctgctgcaaaacgtctgcgacctgagcaacaacatgaatggtcttcggtttccgtgtttcgtaaagtctggaaacgcggaagtcccctacgtgctgctgaagttgcccgcaacagagagtggaaccaaccggtgataccacgatactatgactgagagtcaacgccatgagcggcctcatttcttattctgagttacaacagtccgcaccgctgtccggtagctccttccggtgggcgcggggcatgactatcgtcgccgcacttatgactgtcttctttatcatgcaactcgtaggacaggtgccggcagcgcccaacagtcccccggccacggggcctgccaccatacccacgccgaaacaagcgccctgcaccattatgttccggatctgcatcgcaggatgctgctggctaccctgtggaacacctacatctgtattaacgaagcgctaaccgtttttatcaggctctgggaggcagaataaatgatcatatcgtcaattattacctccacggggagagcctgagcaaactggcctcaggcatttgagaagcacacggtcacactgcttccggtagtcaataaaccggtaaaccagcaatagacataagcggctatttaacgaccctgccctgaaccgacgaccgggtcgaatttgctttcgaatttctgccattcatccgcttattatcacttattcaggcgtagcaccaggcgtttaagggcaccaataactgccttaaaaaaattacgccccgccctgccactcatcgcagtactgttgtaattcattaagcattctgccgacatggaagccatcacagacggcatgatgaacctgaatcgccagcggcatcagcaccttgtcgccttgcgtataatatttgcc

SEQ ID NO: 17 - DNA, 305 bp, Zymomonas mobilis
gttcgatcaacaacccgaatcctatcgtaatgatgttttgcccgatcagcctcaatcgacaattttacgcgtttcgatcgaagcagggacgacaattggctgggaacggtatactggaataaatggtcttcgttatggtattgatgtttttggtgcatcggccccggcgaatgatctatatgctcatttcggcttgaccgcagtcggcatcacgaacaaggtgttggccgcgatcgccggtaagtcggcacgttaaaaaatagctatggaatatagtagctacttaataagttaggagaataaac

SEQ ID NO: 18 - DNA, 2013 bp, artificial sequence
  expression cassette with GAP promoter from ZW641 and E. coli xylose isomerase coding region
ccatggtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaattagcggccgcgttcgatcaacaacccgaatcctatcgtaatgatgttttgcccgatcagcctcaatcgacaattttacgcgtttcgatcgaagcagggacgacaattggctgggaacggtatactggaataaatggtcttcgttatggtattgatgtttttggtgcatcggccccggcgaatgatctatatgctcatttcggcttgaccgcagtcggcatcacgaacaaggtgttggccgcgatcgccggtaagtcggcacgttaaaaaatagctatggaatataatagctactaataagttaggagaataaacatgcaagcctattttgaccagctcgatcgcgttcgttatgaaggctcaaaatcctcaaacccgttagcattccgtcactacaatcccgacgaactggtgttgggtaagcgtatggaagagcacttgcgttttgccgcctgctactggcacaccttctgctggaacggggcggatatgtttggtgtgggggcgtttaatcgtccgtggcagcagcctggtgaggcactggcgttggcgaagcgtaaagcagatgtcgcatttgagtttttccacaagttacatgtgccattttattgcttccacgatgtggatgtttcccctgagggcgcgtcgttaaaagagtacatcaataattttgcgcaaatggttgatgtcctggcaggcaagcaagaagagagcggcgtgaagctgctgtggggaacggccaactgctttacaaaccctcgctacggcgcgggtgcggcgacgaacccagatcctgaagtcttcagctgggcggcaacgcaagttgttacagcgatggaagcaacccataaattgggcggtgaaaactatgtcctgtggggcggtcgtgaaggttacgaaacgctgttaaataccgacttgcgtcaggagcgtgaacaactgggccgctttatgcagatggtggttgagcataaacataaaatcggtttccagggcacgttgcttatcgaaccgaaaccgcaagaaccgaccaaacatcaatatgattacgatgccgcgacggtctatggcttcctgaaacagtttggtctggaaaaagagattaaactgaacattgaagctaaccacgcgacgctggcaggtcactctttccatcatgaaatagccaccgccattgcgcttggcctgttcggttctgtcgacgccaaccgtggcgatgcgcaactgggctgggacaccgaccagttcccgaacagtgtggaagagaatgcgctggtgatgtatgaaattctcaaagcaggcggtttcaccaccggtggtctgaacttcgatgccaaagtacgtcgtcaaagtactgataaatatgatctgttttacggtcatatcggcgcgatggatacgatggcactggcgctgaaaattgcagcgcgcatgattgaagatggcgagctggataaacgcatcgcgcagcgttattccggctggaatagcgaattgggccagcaaatcctgaaaggccaaatgtcactggcagatttagccaaatatgctcaggaacatcatttgtctccggtgcatcagagtggtcgccaggaacaactggaaaatctggtaaaccattatctgttcgacaaataacggctaactgtgcagtccgttggcccggttatcggtagcgataccgggcatttttttaaggaacgatcgat

SEQ ID NO: 19 - protein, 440 aa, Escherichia coli
MQAYFDQLDRVRYEGSKSSNPLAFRHYNPDELVLGKRMEEHLRFAACYWHTFCWNGADMFGVGAFNRPWQQPGEALALAKRKADVAFEFFHKLHVPFYCFHDVDVSPEGASLKEYINNFAQMVDVLAGKQEESGVKLLWGTANCFTNPRYGAGAATNPDPEVFSWAATQVVTAMEATHKLGGENYVLWGGREGYETLLNTDLRQEREQLGRFMQMVVEHKHKIGFQGTLLIEPKPQEPTKHQYDYDAATVYGFLKQFGLEKEIKLNIEANHATLAGHSFHHEIATAIALGLFGSVDANRGDAQLGWDTDQFPNSVEENALVMYEILKAGGFTTGGLNFDAKVRRQSTDKYDLFYGHIGAMDTMALALKIAARMIEDGELDKRIAQRYSGWNSELGQQILKGQMSLADLAKYAQEHHLSPVHQSGRQEQLENLVNHYLFDK

SEQ ID NO: 20 - DNA, 1323 bp, Escherichia coli
atgcaagcctattttgaccagctcgatcgcgttcgttatgaaggctcaaaatcctcaaacccgttagcattccgtcactacaatcccgacgaactggtgttgggtaagcgtatggaagagcacttgcgttttgccgcctgctactggcacaccttctgctggaacggggcggatatgtttggtgtgggggcgtttaatcgtccgtggcagcagcctggtgaggcactggcgttggcgaagcgtaaagcagatgtcgcatttgagtttttccacaagttacatgtgccattttattgcttccacgatgtggatgtttcccctgagggcgcgtcgttaaaagagtacatcaataattttgcgcaaatggttgatgtcctggcaggcaagcaagaagagagcggcgtgaagctgctgtggggaacggccaactgctttacaaaccctcgctacggcgcgggtgcggcgacgaacccagatcctgaagtcttcagctgggcggcaacgcaagttgttacagcgatggaagcaacccataaattgggcggtgaaaactatgtcctgtggggcggtcgtgaaggttacgaaacgctgttaaataccgacttgcgtcaggagcgtgaacaactgggccgctttatgcagatggtggttgagcataaacataaaatcggtttccagggcacgttgcttatcgaaccgaaaccgcaagaaccgaccaaacatcaatatgattacgatgccgcgacggtctatggcttcctgaaacagtttggtctggaaaaagagattaaactgaacattgaagctaaccacgcgacgctggcaggtcactctttccatcatgaaatagccaccgccattgcgcttggcctgttcggttctgtcgacgccaaccgtggcgatgcgcaactgggctgggacaccgaccagttcccgaacagtgtggaagagaatgcgctggtgatgtatgaaattctcaaagcaggcggtttcaccaccggtggtctgaacttcgatgccaaagtacgtcgtcaaagtactgataaatatgatctgttttacggtcatatcggcgcgatggatacgatggcactggcgctgaaaattgcagcgcgcatgattgaagatggcgagctggataaacgcatcgcgcagcgttattccggctggaatagcgaattgggccagcaaatcctgaaaggccaaatgtcactggcagatttagccaaatatgctcaggaacatcatttgtctccggtgcatcagagtggtcgccaggaacaactggaaaatctggtaaaccattatctgttcgacaaataa

SEQ ID NO: 21 - protein, 449 aa, Lactobacillus brevis
MTEEYWKGVDKIQYVGHQDKKSGLGFQYYNPEEEIMGKKMKDWLRFAVAYWHTFDQRLVDPFGDGTAQRPYDKYTDPMDLALAKVDAAFEFYQKLGVDYLCFHDRDLAPEGDTLRETNANLDKVVDKIVEYQKTSGMKVLWNTSNMFTNPRFVEGAATSPYADVFAYSAAQLKHSLEIGKRVGSENYVFWGGREGYESLWNTNMKQEQEHAAKIFHMAKDYANEIGFDAQMLLEPKPKEPTTHQYDFDAATTIAFMKEYDLDKDFKLNLEGNHANLAGHTYQHEIRVAREAGLLGSLDANQGDKLIGWDIDEYPSNLYETTAAMYEVVENGSIGPRGGLNFDAKPRRSSFAPEDLFLGHIVGMDSFAAGLRVAAAMKQDGFLDSLKADRYSSYKSGVGADIESGKADLKSLEAYAIDKPQSELIAATHSDHLEEIKDTINHYIIDTLSK

SEQ ID NO: 22 - DNA, 1350 bp, Lactobacillus brevis
atgactgaagaatactggaaaggcgtcgacaagattcaatacgtcggccatcaagataagaaatctggtttaggattccaatactacaacccagaagaagagattatgggtaagaaaatgaaggattggttacggtttgccgttgcttactggcacacctttgaccaacgcctagttgacccattcggtgacgggaccgcgcaacgtccttatgacaagtacaccgacccaatggacttggctttagccaaggttgatgctgcctttgaattttatcaaaaattaggggtagattacctttgcttccacgatcgtgacttagctccagaaggtgatacgttacgcgaaacgaacgccaacttggacaaagttgttgacaagatcgttgaataccaaaagacttctggtatgaaggttctttggaacacgtcaaacatgttcactaaccctcggttcgttgaaggggctgcaacctcaccatacgccgatgtctttgcttacagtgccgcacaattgaagcacagtttggaaattggtaagcgggttggctctgaaaactatgtcttctggggtggccgtgaaggttacgaatcactctggaacaccaacatgaagcaagaacaagaacacgcagctaagattttccatatggctaaggactacgctaacgaaatcggcttcgatgctcaaatgttgctggaaccaaagcctaaggaaccaacgactcaccaatatgactttgatgccgctacgacgattgccttcatgaaagaatacgacttggataaagacttcaaattgaacttggaaggtaaccacgctaacttggcaggtcacacttaccaacacgaaatccgggttgctcgtgaagctggtttgttaggttcattggatgctaaccaaggtgataagttaattggctgggatatcgatgaatacccatcaaacttatacgaaacgaccgctgcaatgtacgaagttgtcgaaaacggcagcattggccctcgcggtgggttgaactttgatgctaagcctcgtcgctcctcatttgccccagaagacctcttcttaggccacattgttgggatggatagctttgctgctggactccgggttgctgctgcaatgaagcaagatggcttcttagatagcttgaaggccgaccgttacagctcatacaagtctggtgttggtgctgatatcgaaagtggcaaggctgacttgaagtcccttgaagcttacgctatcgacaagccacaatcagaattgatcgcggcaacgcattctgatcacttagaagaaattaaggatacgatcaaccattacatcatcgatacgttgagcaagtaa

SEQ ID NO: 23 - protein, 439 aa, Thermoanaerobacterium
MNKYFENVSKIKYEGPKSNNPYSFKFYNPEEVIDAKTMEEHLRFSIAYWHTFTADGTDQFGKATMQRPWNHYTDPMDIAKARVEAAFEFFDKINAPFFCFHDRDIAPEGDTLRKTNKNLDTIVAMIKDYLKTSKTKVLWGTANLFSNPRFVHGASTSCNADVFAYSAAQVKKALEITKELGGENYVFWGGREGYETLLNTDMEFELKNFARFLHMAADYAKEIGFEGQFLIEPKPKEPTKHQYDFDVANVLAFLRKYDLDKYFKVNIEANHATLAFHDFQHELRYARINGVLGSIDANTGDMLLGWDTDQFPTDIRMTTLAMYEVIKMGGFDKGGLNFDAKVRRASFEPEDLPLGHIAGMDSLAKGFKVAYKLVKDRVFDKFIEERYASYKDGIGADIVSGKADFKSLEKYALEHSQIVNKSGRQELLESILNQYLFAE

SEQ ID NO: 24 - DNA, 1320 bp, Thermoanaerobacterium
atgaataaatattttgagaatgtatctaaaataaaatatgaagggccaaaatcaaacaatccctattcttttaaattttacaatcctgaggaagtaatcgatgccaagacgatggaagagcatctccgcttttctatagcttattggcatacttttactgctgatggaacagatcaatttggcaaagctaccatgcaaagaccatggaaccactatacagatcctatggatatagcaaaggcaagggtagaagcagcatttgaattttttgataagataaatgcacctttcttctgcttccatgacagggatattgcacctgaaggagacacccttagaaaaacgaacaaaaacttagatacaatagttgccatgataaaggactacttgaagaccagcaagacgaaagttttgtggggtactgcaaatcttttctcaaatccgagatttgtgcatggtgcatcaacatcgtgcaatgctgatgttttcgcatattccgcagcgcaagtcaaaaaagccctcgagattactaaggagcttggcggcgaaaactacgtattctggggtggaagagaaggatatgaaacacttctcaatacagacatggagtttgagcttaaaaactttgcgagatttttgcacatggctgctgactatgcaaaagaaatcggctttgaaggccagttcttgattgagccgaagccaaaggaacctacaaaacaccaatacgactttgatgtggcaaatgtattggcattcttgagaaaatacgatcttgacaaatatttcaaagtgaatatagaggcaaaccatgcaacattggcattccacgacttccaacatgagctaagatacgccagaataaacggcgtattaggatcaattgacgcaaatacaggtgatatgcttttaggatgggatacagaccagttccctacagatatacgcatgaccacacttgccatgtatgaagtcataaagatggggggatttgacaaaggcggccttaacttcgatgcaaaagtaagacgtgcttcatttgagccagaagatcttcccttaggtcacatagctggaatggattctcttgcaaaaggcttcaaggttgcttacaagcttgtgaaagatcgcgttttcgacaagtttatcgaggaaagatacgcaagctacaaagatggcattggcgctgatattgtaagtggaaaggctgacttcaagagccttgagaagtatgcattagagcacagccagattgtcaacaaatcaggaagacaagagctattggagtcaatcctaaatcagtatttgtttgcagaatga

SEQ ID NO: 25 - protein, 439 aa, Clostridium thermosulfurogenes
MNKYFENVSKIKYEGPKSNNPYSFKFYNPEEVIDGKTMEEHLRFSIAYWHTFTADGTDQFGKATMQRPWNHYTDPMDIAKARVEAAFEFFDKINAPYFCFHDRDIAPEGDTLRETNKNLDTIVAMIKDYLKTSKTKVLWGTANLFSNPRFVHGASTSCNADVFAYSAAQVKKALEITKELGGENYVFWGGREGYETLLNTDMEFELDNFARFLHMAVDYAKEIGFEGQFLIEPKPKEPTKHQYDFDVANVLAFLRKYDLDKYFKVNIEANHATLAFHDFQHELRYARINGVLGSIDANTGDMLLGWDTDQFPTDIRMTTLAMYEVIKMGGFDKGGLNFDAKVRRASFEPEDLFLGHIAGMDAFAKGFKVAYKLVKDRVFDKFIEERYASYKDGIGADIVSGKADFRSLEKYALERSQIVNKSGRQELLESILNQYLFAE

SEQ ID NO: 26 - DNA, 1320 bp, Clostridium thermosulfurogenes
atgaataaatattttgagaacgtatctaaaataaaatatgaaggaccaaaatcaaacaatccttattcttttaaattttacaatcctgaggaagtaatcgatggtaagacgatggaggagcatcttcgcttttctatagcttattggcacacttttactgctgatggaacagatcaatttggcaaagctaccatgcaaaggccatggaatcactatacagatcctatggacatagctaaagcaagggtagaggcagcatttgagttttttgataagataaatgcaccgtatttctgcttccatgatagagatattgcccctgaaggagacactcttagagagacgaacaaaaatttagatacaatagttgctatgataaaggattacttgaagaccagcaagacgaaagttttgtggggtactgcgaatcttttctccaatccaagatttgtgcatggtgcatcaacgtcttgcaatgccgatgttttcgcatattctgcagcgcaagtcaaaaaagcacttgagattactaaggagcttggtggcgaaaactacgtattctggggtggaagagaaggatatgagacacttctcaatacagatatggagtttgagcttgataattttgcaagatttttgcacatggctgttgattatgcaaaggaaatcggctttgaaggccagttcttgattgagccgaagccaaaggagcctacaaagcatcaatacgactttgacgtggcaaatgtattggcattcttgagaaaatacgatcttgacaaatatttcaaagttaatatcgaagcaaatcatgcaacattagcattccatgatttccagcatgagctaagatacgccagaataaacggtgtattaggatcgattgacgcaaatacgggtgatatgctattaggatgggatacagatcagttccctacagatatacgcatgacaacacttgctatgtatgaagttataaagatgggtggatttgacaaaggcggactcaacttcgatgcgaaagtaagacgtgcttcatttgagccagaagatcttttcttgggtcacatagcaggaatggatgcttttgcaaaaggcttcaaagtggcttacaagcttgtaaaagatagggtatttgacaagttcatcgaagaaagatatgcaagctacaaagatggcataggtgcagatattgtaagtgggaaagctgattttagaagtcttgaaaagtatgcattagagcgcagccagattgtcaacaaatcaggaagacaagagctattagagtcaatcctaaatcagtatttgtttgcagaataa

SEQ ID NO: 27 - protein, 394 aa, Actinoplanes missouriensis
MSVQATREDKFSFGLWTVGWQARDAFGDATRTALDPVEAVHKLAEIGAYGITFHDDDLVPFGSDAQTRDGIIAGFKKALDETGLIVPMVTTNLFTHPVFKDGGFTSNDRSVRRYAIRKVLRQMDLGAELGAKTLVLWGGREGAEYDSAKDVSAALDRYREALNLLAQYSEDRGYGLRFAIEPKPNEPRGDILLPTAGHAIAFVQELERPELFGINPETGHEQMSNLNFTQGIAQALWHKKLFHIDLNGQHGPKFDQDLVFGHGDLLNAFSLVDLLENGPDGAPAYDGPRNFDYKPSRTEDYDGVWESAKANIRMYLLLKERAKAFRADPEVQEALAASKVAELKTPTLNPGEGYAELLADRSAFEDYDADAVGAKGFGFVKLNQLAIEHLLGAR

SEQ ID NO: 28 - DNA, 1185 bp, Actinoplanes missouriensis
gtgtctgtccaggccacacgcgaagacaagttctccttcggtctctggaccgttggatggcaggctcgtgacgcgttcggtgacgccacgcgtacggcactcgacccggtcgaggccgtgcacaagctcgctgagatcggcgcctacggcatcacgttccacgacgacgacctggtgcccttcggctcggacgcccagacccgcgacggcatcatcgcgggcttcaagaaggcgctcgacgagaccggcctgatcgtcccgatggtgaccaccaacctcttcacccacccggtgttcaaggacggcggcttcaccagcaacgaccgttccgtgcggcgctacgcgatccgcaaggtgctgcgccagatggacctcggcgccgagctgggcgcgaagacgctcgtcctctggggcggccgcgagggcgccgagtacgactcggccaaggacgtcagcgccgccctcgaccgctaccgcgaggcgctcaacctgctcgcgcagtactccgaggaccgcggttacggcctgcgcttcgccatcgagccgaagccgaacgagccccgcggcgacatcctgctcccgaccgccggccacgccatcgcgttcgtgcaggagctggagcgtcccgagctcttcggcatcaacccggagaccgggcacgagcagatgtcgaacctcaacttcacccagggcatcgcccaggcgctgtggcacaagaagctgttccacatcgacctgaacggtcagcacggcccgaagttcgaccaggacctggtcttcggccacggtgacctgctcaacgcgttctcgctggtcgacctcctggagaacggtccggacggcgccccggcgtacgacggaccccgtcacttcgactacaagccgtcccgtaccgaggactacgacggcgtctgggagtcggcgaaggccaacatccggatgtacctgctgctcaaggagcgggccaaggcgttccgcgccgaccccgaggtgcaggaggcgctcgccgccagcaaggtcgcggagctgaagaccccgaccctgaacccgggcgagggatacgccgagctgctcgccgaccgcagcgcgttcgaggactacgacgccgacgccgtgggcgccaagggcttcggcttcgtcaagctgaaccagctcgcgatcgagcacctgctcggagcccgctga

SEQ ID NO: 29 - protein, 395 aa, Arthrobacter strain B3728
MSVQPTPADHFTFGLWTVGWTGADPFGVATRANLDPVEAVHKLAELGAYGITFHDNDLIPFDATAAEREKILGDFNQALADTGLKVPMVTTNLFSHPVFKDGGFTSNDRSIRRFALAKVLHNIDLAAEMGAETFVMWGGREGSEYDGSKDLAAALDRMREGVDTAAGYIKDKGYNLRIALEPKPNEPRGDIFLPTVGHGLAFIEQLEHGDIVGLNPETGHEQMAGLNFTHGIAQALWAEKLFHIDLNGQRGIKYDQDLVFGHGDLTSAFFTVDLLENGFPNGGPKYTGPRHFDYKPSRTDGYDGVWDSAKANMSMYLLLKERALAFRADPEVQEAMKTSGVFELGETTLNAGESAADLMNDSASFAGFDAEAAAERNFAFIRLNQLAIEHLLGSR

SEQ ID NO: 30 - DNA, 1188 bp, Arthrobacter strain B3728
atgagcgttcagccgacccctgcagaccacttcacctttggcctctggaccgtaggatggaccggcgccgacccattcggtgtcgccacccgcaagaacctggacccggtagaagccgtccacaagctggccgagctcggcgcctacggcatcaccttccacgacaatgacctgattccttttgacgccaccgaggcagagcgcgaaaagatccttggtgacttcaaccaggcgctgaaggacaccggcctgaaggtcccaatggtgaccaccaacctgttcagccacccggtcttcaaggacggcggcttcacctctaacgaccgctcgatccgtcgttttgcactggctaaggtcctgcacaacatcgacttggcagccgagatgggcgccgaaaccttcgtcatgtggggcgggcgcgaaggcagcgaatacgacggttccaaggacctggccgcagcacttgatcgcatgcgcgaaggcgtggacacggcagctggctacatcaaggacaagggttacaacctgcgcatcgcgctggagccaaagccaaatgaaccacgcggcgacatcttcctgcctaccgtcggccacggcctggccttcatcgagcagctggagcacggcgacatcgtcggcctgaacccagaaaccggccacgagcagatggccggcctgaacttcacccacggcatcgctcaggcactgtgggccgagaagctgttccacattgacctcaacggccagcgcggcatcaagtacgaccaggacctggtcttcggccacggcgatctgaccagcgcgttcttcaccgtagacctgctggaaaacggcttccctaacggcggaccaaagtacaccggcccacgccacttcgactacaagccatcgcgcaccgacggctacgacggcgtgtgggactcggccaaggccaacatgtccatgtacctgctgctcaaggaacgtgccctggccttccgtgcggatccagaggtacaggaagccatgaagacctcgggcgtcttcgaactgggcgaaaccaccctgaacgccggggaaagcgcagcggatctgatgaatgattccgcgagcttcgcaggctttgacgccgaggccgccgcagagcgcaacttcgcgttcatccgcctgaaccagctggccatcgagcacctgctcggctcccgctaa

SEQ ID NO: 31 - protein, 448 aa, Bacillus licheniformis
MFFRNIGMIEYEGADSENPYAFKYYNPDEFVGGKTMKEHLRFAVAYWHTFDADGKDPFGDGTMFRAWNRLTHPLDKAKARAEAAFEFFEKLGVPYFCFHDVDIVDEGATLRETFTYLDQMSSFLKEMMETSHVQLLWNTANMFTHPRYVHGAATSCNADVYAYAAAKVKKGLDIAKELGAENYVFWGGREGYETLLNTDMKLELENLSSFYRMAVEYAREIGFDGQFLIEPKPKEPTKHQYDFDAATTIAFLETYGLKDHFKLNLEANHATLAGHTFEHELRVAALHDMLGSIDANQGDLLLGWDTDEFPTDLYSAVLAMYEILKAGGFKTGGINFDAKVRRPSFADEDLFHAHIAGMDTYAVGLKVASRLLEDKALDQVIEERYESYTKGIGLEIKEGRTDLKKLAAYALENDHIENQSGRQERLKATVNRYLLNALREAPAGKETH

SEQ ID NO: 32 - DNA, 1347 bp, Bacillus licheniformis
atgttttttagaaatatcggaatgattgagtatgaaggggccgattcggaaaatccttacgcatttaaatattacaaccctgatgaatttgtcggcggcaaaacgatgaaggaacaccttcgcttcgctgttgcgtattggcatacctttgatgcggacgggaaagaccctttcggcgacgggacgatgttccgggcgtggaaccggctgacacatcctttggataaagcgaaagccagggcggaagcggcttttgaattttttgaaaagctcggcgtgccctatttctgttttcatgatgttgatattgtcgatgaaggagcaacattgcgtgaaactttcacgtatttggatcaaatgtcgtcttttctcaaagaaatgatggagacaagccatgttcagctgctttggaatacagccaatatgtttacgcatccgagatatgtccacggggccgcaacttcttgcaatgcagacgtctatgcctatgcagctgcaaaagtgaaaaaaggcctggacatcgccaaagagcttggagcggaaaactatgtgttctggggcggaagagaaggttatgaaacattgctgaatacagatatgaagcttgagctcgaaaacttgtcttcattttatagaatggcagttgagtatgcgcgtgaaatcggttttgacggccaatttttaatcgagccgaagccgaaggagccgacgaagcaccaatacgattttgatgcagccacaacgatcgcttttttagaaacttacggtttaaaagaccattttaaacttaatcttgaggcgaaccatgcgacattggccgggcatacatttgagcatgaactaagggtggctgccttgcacgatatgctgggttccattgatgccaaccagggcgatttgctcttgggctgggataccgatgagtttccgaccgatctgtattctgcggttctggcgatgtatgaaattttgaaagcaggcgggtttaaaaccggcggcatcaacttcgatgctaaagtaaggcgcccgtcatttgccgatgaggacttgtttcacgctcatatcgcaggaatggatacgtatgcagtcggcttgaaagtcgcctcccgtctgcttgaagataaagcgctcgatcaggttatcgaagaacgttatgagagctatacgaaaggcatcgggcttgaaatcaaagaaggccgcaccgatctgaaaaagctcgccgcttacgctcttgaaaacgaccatattgaaaatcagtcaggccgccaagaacggctgaaggcgaccgttaaccgttacttattgaacgctttgcgcgaagcgccggcaggaaaggagacacactag

SEQ ID NO: 33 - protein, 441 aa, Geobacillus sterothermophilus
MPYFDNISTIAYEGPASKNPLAFKFYNPEEKVGDKTMEEHLRFSVAYWHTFTGDGSDPFGAGNMIRPWNKYSGMDLAKARVEAAFEFFEKLNIPFFCFHDVDIAPEGETLKETYKNLDIIVDMIEEYMKTSKTKLLWNTANLFTHPRFVHGAATSCNADVFAYAAAKVKKGLEIAKRLGAENYVFWGGREGYETLLNTDMKLELDNLARFLHMAVDYAKEIGFDGQFLIEPKPKEPTKHQYDFDVATRLAFLQTYGLKDYFKFNIEANHATLAGHTFEHELRVARIHGMLGSVDANQGDMLLGWDTDEFPTDLYSTTLAMYEILKNGGLGRGGLNFDAKVRRGSFEPEDLFYAHIAGMDSFAVGLKVAHRLIEDRVFDEFIEERYKSYTEGIGREIVEGTADFHKLEAHALQLGEIQNQSGRQERLKTLLNQYLLEVCAAR

SEQ ID NO: 34 - DNA, 1326 bp, Geobacillus stearothermophilus
atgccttattttgacaacatcagcaccatcgcctatgaaggaccggcgtctaaaaatccgcttgcgtttaagttttacaatccggaagaaaaagtcggcgataaaacaatggaagagcatttgcgtttttcggttgcgtattggcatacgtttacaggagatggatcagatccgtttggggctggcaatatgatccgtccatggaacaaatacagcggaatggatttggccaaagcgcgtgttgaagctgcttttgagttttttgaaaaattaaatattccatttttctgtttccatgatgtggatattgccccagaaggagaaacattaaaagaaacatataaaaatttagatattatcgtagacatgattgaggaatatatgaaaacaagcaaaacgaagctgctttggaatacggcgaacttatttacccatcctcgctttgtccatggcgccgccacttcttgcaacgccgatgtttttgcctatgcagcggccaaagtaaaaaaagggttggaaattgcgaagcggctaggagcggaaaactacgtattttggggcggacgagaagggtatgaaacactattaaataccgatatgaaacttgagctggacaacttggcccgcttcttgcatatggcggtggattatgcgaaagaaatcgggtttgacgggcaatttttaattgagccgaagccgaaagagccgacgaaacaccaatatgactttgatgttgcgacacgattggcatttttgcaaacatacggactgaaagattactttaagttcaatattgaagcgaaccatgcaacgctggcgggacatacgtttgaacatgaattgcgggtagcgcgcattcatggcatgttaggctctgttgacgcaaaccaaggagatatgttgttaggatgggatacggacgaattcccgacagacttatattctacgactttggcaatgtatgaaattttgaaaaacggcggccttggccgtggcggtttgaattttgatgcgaaagtaagaagaggatcgtttgagccggaagatttgttctatgcccatatcgccggaatggacagttttgcggttggattaaaagtagcccatcggttaatagaagaccgcgtttttgatgagtttattgaagaacggtacaaaagttatacagaaggaattggccgggaaatcgtcgaaggaacggcagatttccacaaattagaagcacatgctttacaactaggggaaatccaaaatcaatcgggcagacaagaacggctgaaaacattgcttaaccaatatttgcttgaagtttgcgcagcccgttaa

SEQ ID NO: 35 - protein, 445 aa, Bacillus coagulans
MMAYFPNVSKITYSGKQLKSGLSFNHYNPKELVGGKTMEEQLRFSVAFWHTFTESGTDPFGAGSKIRPWDRFTGMDLAKARVEAAFEFFEKLGNPYFCFHDRDIAPEGDTLRETNKNLDVIVAMIKDYMKTSKVKLLWNTANMFTNPRFVHGAASSCNADVFAYAAAQVKKGLEVGKELGAENYVFWGGREGYETLLNTDLKLEQDNLARFFHMAVDYAKEIGFDAQFLLEPKPKEPTKHQYDFDAATTIAFLKTYDLDQHFKLNLEANHATLAGHTFEHEIRVARTHGLLGSLDANQGDPLLGWDTDEFPTDLYSTTLAMYEVLKNGGLGRGGLNFDAKTRRASFTDEDLFYAHIAGMDSFALGLKVANRLIEDRVFDAFIEERYSSYKEGIGADIVSGKADFKSLENYILDKKEIINQSGRLEQLKNTLNHYIVQEAYQSVNA

SEQ ID NO: 36 - DNA, 1338 bp, Bacillus coagulans
atgatggcatattttccaaatgtcagcaaaatcacttattctggcaaacaattgaaaagcggtctttcatttaatcattacaatccgaaagaactcgttggtggaaaaacgatggaagaacagcttcgattctcagtcgcattctggcacacctttactgaaagcggtaccgatccgtttggcgcaggctccaagatccgcccgtgggatcgcttcacaggcatggatcttgccaaagcaagagtagaagcagcatttgaattttttgaaaaactaggtaacccttatttctgctttcatgaccgcgatattgctcctgaaggcgatacattaagggaaacaaataaaaatctggacgtcatcgttgccatgattaaagattatatgaaaacaagcaaagtaaaactcttatggaatacagccaatatgttcacaaatccacgttttgtccacggtgcagctagctcttgcaacgcagatgttttcgcgtacgcagccgcccaagtgaaaaaagggcttgaagtcgggaaagaactgggcgctgaaaactatgtattttggggcggccgggaaggctatgaaactttgttaaatacagatttgaagctggaacaggacaacctggcacggttcttccatatggccgttgattacgcgaaagaaatcggatttgatgctcagttcttgcttgagccgaaaccgaaagaaccgacaaaacatcaatatgattttgatgctgctacgactattgcattcttaaaaacttacgatttggatcaacacttcaagctgaatcttgaagcaaatcatgccactttggccggccatacgtttgaacatgaaatccgggttgcgcgtacccacggcttgcttggctctttggatgcgaaccagggtgatccgctgctcggctgggatacagatgaattcccgacagatctctattccaccacgcttgcgatgtatgaagtattgaaaaacggcggccttggcaggggcggattgaactttgatgcgaaaacacgccgcgcctcgttcacagatgaagatctgttttatgcccatattgccggtatggacagctttgcccttggattaaaagtagcgaaccggctgattgaagaccgggtatttgatgcctttatcgaagaacggtacagcagttataaagaaggcatcggcgccgatatcgtttccggcaaagctgattttaaatcacttgaaaattatattcttgataaaaaagaaattataaaccaatctggccgcctggaacaactgaaaaatacgctgaaccattatattgtgcaagaagcctatcaaagtgtaaatgcataa

SEQ ID NO: 37 - protein, 445 aa, Bacillus subtilis
MAQSHSSSINYFGSANKVVYEGKDSTNPLAFKYYNPQEVIGGKTLKEHLRFSIAYWHTFTADGTDVFGAATMQRPWDHYKGMDLAKMRVEAAFEMFEKLDAPFFAFHDRDIAPEGSTLKETNQNLDMIMGMIKDYMRNSGVKLLWNTANMFTNPRFVHGAATSCNADVFAYAAAQVKKGLETAKELGAENYVFWGGREGYETLLNTDLKFELDDLARFMHMAVDYAKEIGYTGQFLIEPKPKEPTAHQYDTDAATTIAFLKQYGLDNHFKLNLEANHATLAGHTFEHELRMARVHGLLGSVDANQGHPLLGWDTDEFPTDLYSTTLAMYEILQNGGLGSGGLNFDAKVRRSSFEPDDLIYAHIAGMDAFARGLKVAHKLIEDRVFEDVIQHRYRSFTEGIGLEIIEGRANFHTLEQYALNHKSIKNESGRQEKLKAILNQYILEV

SEQ ID NO: 38 - DNA, 1338 bp, Bacillus subtilis
atggctcaatctcattccagttcaatcaactattttggaagcgcaaacaaagtggtttacgaagggaaagattcgactaatcctttagcatttaaatattataatcctcaagaagtaatcggcggaaaaacgctgaaagagcatttgcgattttctattgcctattggcatacatttactgctgatggtacagacgtttttggagcagctacgatgcaaagaccatgggatcactataaaggcatggatctagcgaagatgagagtagaagcagcatttgagatgtttgaaaaactagatgcaccattctttgcttttcatgaccgggatattgcaccagaaggcagtacgctaaaagagacaaaccaaaatttagatatgatcatgggcatgattaaagattacatgagaaatagcggcgttaagctattatggaatacagcaaacatgtttacgaatccccgtttcgtccatggtgccgcgacttcttgcaatgcagatgtgtttgcgtatgctgcagcacaagtgaaaaaagggttagaaacagcaaaagagcttggcgctgagaactatgtattttggggcggccgtgaaggatatgaaacattgttaaataccgatttaaaatttgagcttgatgatttggctagatttatgcatatggcagtggattatgcgaaggaaatcgggtacacagggcagtttttgattgagccaaaaccaaaagagccgaccgcccatcaatacgatacagatgcagcaacaaccattgcctttttgaagcaatatggcttagacaatcattttaaattaaatcttgaagccaatcatgccacattagccgggcatacattcgaacatgaattacgcatggcaagagtacatggtctgcttggctctgttgacgcaaaccagggtcatcctcttttaggctgggacacggatgaatttccgacggatttatattctacgacattagcaatgtacgaaatcctgcaaaatggcggccttggaagcggcggattaaactttgacgcgaaggtcagaagatcttctttcgagcctgatgatctaatatatgcccatattgcagggatggatgcatttgcaagaggattgaaagttgcccacaaattaatcgaagatcgtgtgtttgaagatgtgattcaacatcgttaccgcagctttactgaagggattggtcttgaaattatagaaggaagagctaatttccacacacttgagcaatatgcgctaaatcataaatcaattaaaaacgaatctggaagacaggagaaattaaaagcgatattgaaccaatacattttagaagtataa

SEQ ID NO: 39 - protein, 438 aa, Bacteroides vulgatus
MATKEYFPGIGKIKFEGKESKNPMAFRYYDAEKVINGKKMKDWLKFAMAWWHTLCAEGGDQFGGGTKKFPWNGDADKVQAAKNKMDAGFEFMQKMGIEYYCFHDVDLCEEADTIEEYEANLKEIVAYAKQKQAETGIKLLWGTANVFGHARYMNGAATNPEFDVVARAAVQIKNAIDATIELGGSNYVFWGGREGYMSLLNTDQKREKEHLAQMLTIARDYARSKGFTGTFLIEPKPMEPTKHQYDVDTETVVGFLKTHGLDKDFKVNIEVNHATLAGHTFEHELAVAVDNGMLGSIDANRGDYQNGWDTDQFPIDNYELTQAMMQIIRNGGLGNGGTNFDAKTRRNSTDLEDIFIAHIAGMDAMARALESAAALLNESPYCKMLSDRYASFDSGKGKEFEEGKLTLEDVVAYAKQNGEPKQVSGKQELYEAIVNMYC

SEQ ID NO: 40 - DNA, 1317 bp, Bacteroides vulgatus
atggctacaaaagagtattttcccggtataggaaagattaaatttgaaggtaaggaaagtaagaacccgatggcgttccgttattatgatgctgaaaaggtaattaacggcaagaagatgaaagactggttgaagtttgctatggcatggtggcatacgttgtgtgccgagggcggtgaccagtttggcggcggaacaaagaaattcccttggaacggtgatgccgataaggtgcaggctgccaagaataagatggatgccggctttgaattcatgcagaaaatgggaatcgaatattattgtttccatgatgtggacttgtgtgaggaagccgatacaatcgaggaatatgaagcgaatctgaaagagatagttgcttatgccaaacagaaacaggctgaaaccggaatcaaattgttatggggtacggcaaatgtttttggtcatgcacgctatatgaacggggctgctacaaaccccgaatttgatgtggttgcccgcgctgctgtccagataaagaacgctattgacgctaccatcgaactgggtggctccaattacgtgttctggggtggacgtgaagggtatatgtctttattgaatacagatcagaagcgtgagaaagaacatctggctcagatgttgaccattgcccgcgattatgcccggagcaaagggtttacaggtactttcctgattgaacccaaaccgatggagccgactaagcatcaatatgatgtggataccgaaactgtggtagggttcttgaaaactcacggactggacaaggatttcaaggtgaacattgaagtgaatcatgctacgttggctggtcatacatttgaacatgaactggctgttgcggtagataacggaatgttgggatctattgacgctaaccgtggcgattatcagaacggatgggatacagaccagttccctatcgacaattacgaactgacccaggccatgatgcagattatccgcaatggcggtttgggtaatggcggtaccaactttgatgccaagacacgtcgtaactctactgatctggaagatatctttatcgcccatattgcaggtatggacgctatggcgcgtgcattggaaagtgctgctgctttgcttaatgaatctccttactgcaagatgttgtcagaccgctatgcttcattcgacagtggcaaaggcaaagaatttgaagaaggcaagctgacactggaagacgtagtggcttatgctaagcagaatggtgagcccaagcaagtaagcggtaagcaggaattgtacgaagccatcgtaaatatgtattgctga

SEQ ID NO: 41 - protein, 449 aa, Bifidobacterium adolescentis
MGLWDIDKIPYVGREKGPQEGLAFHYYDADKVVAGKKMKDWLRFGVAWWHTFDQQLVDPFGTGTAQRPWYGKYSDPEDEALAKVDYAFEFFQKLGVEYFCFHDRDIAPEGDTLRETDKNLDKVVDKIEENMKSTGIKLLWNTSSLFTNPRFVSGASTSPFADIYAYAGGQLKHSLEIAKRLGAENYVFWGGREGYENLWNTQMKREQEHMAKFFHMCHDYAKEIGLDAQFLIEPKAKEPTMFQYDFDAATAINFLRTYDLMDVFKLNLEGNHANLAGHTYQHEIRTAREAGVLGSLDANQGDKLIGWDMDEFPTDLYETSTVMWEVLAEGQIGPHGGLNFDAKPRRTSFTAEDLFRSHIAGMDSFAAGLLVAAKMHEDKVIENLQAERYSSFDSGIGATVENGTASLASLEEYALDIPQSKLIEATKSDHLESVKATINNYMIDALAEA

SEQ ID NO: 42 - DNA, 1350 bp, Bifidobacterium adolescentis
atgggtctgtgggatatcgataagattccgtacgtcggtcgcgaaaaggggccgcaggagggtcttgctttccattactacgatgccgacaaggtcgttgccggcaagaagatgaaggactggctgcgtttcggcgtcgcatggtggcacaccttcgaccagcagctcgtcgatccgttcggcaccggcaccgcccagcgtccgtggtacggcaagtattccgatccggaggacgaggccctggccaaggtcgactacgccttcgagttcttccagaagctcggcgtcgagtacttctgcttccatgatcgcgacatcgctccggaaggcgacaccctgcgcgagaccgacaagaacctggacaaggtcgtcgacaagatcgaagagaacatgaagtccaccggcatcaagctgctgtggaacacctcctccctgttcaccaacccgcgcttcgtctccggcgcctccacctccccgttcgccgacatctacgcgtacgccggcggccagctgaagcactccctggagatcgccaagcgccttggtgccgagaactacgtgttctggggcggccgtgaaggctacgagaacctgtggaacacccagatgaagcgcgagcaggagcacatggccaagttcttccacatgtgccatgactacgcgaaggaaatcggcctggacgcccagttcctgatcgagccgaaggccaaggaaccgacgatgttccagtacgacttcgatgccgccaccgccatcaacttcctgcgcacctatgatctgatggacgtcttcaagctgaacctggaaggcaaccacgccaacctggccggccacacctaccagcacgagatccgcaccgcccgcgaggccggcgtgctcggctccttggacgccaaccagggcgacaagctcatcggctgggatatggatgagttcccgaccgacctgtacgagacctccaccgttatgtgggaagtcctcgccgaaggccagatcggccctcacggtggtctgaacttcgacgccaagccgcgtcgtacctccttcaccgccgaggatctgttccgttcccacatcgcaggcatggattccttcgcagcaggcctcctggtcgccgccaagatgcacgaggacaaggtcatcgagaacctgcaggccgagcgctacagctccttcgattccggcatcggcgcaaccgtcgagaacggcaccgcctccctggcttccctcgaggagtacgctctggatatcccgcagtccaagctcatcgaagccaccaagtccgatcacctcgagtccgtcaaggccacgatcaacaactacatgatcgacgccctggccgaggcgtga

SEQ ID NO: 43 - protein, 439 aa, Erwinia carotovora
MQAYFEQIEKVRYEGSQSSNPFAFRHYNPDQEILGKRMADHLRFAVAYWHTFCWNGSDMFGVGSFARPWQQSGDALELAKRKADIAFEFFQKLSVPYYCFHDVDVAPEGNSLKEYLHNIAVITDVLAEKQQDSGVKLLWGTANCFTNPRYGAGAATNPDPDVFAWAATQVFTAMNATKTLGGENYVLWGGREGYETLLNTDLRQEREQIGRFMQMVVEHKHKIGFQGTLLIEPKPQEPTKHQYDYDVATVYGFLKQFGLEKEIKVNVEANHATLAGHSFHHEIATAVALGVFGSVDANRGDPQLGWDTDQFPNSVEENTLIMYEILKAGGFTTGGLNFDAKVRRQSTDRYDLFHAHIGAMDTMALALKAAARMIEDDKLNQLVAKRYAGWNGELGQQILQGNASLESLAQYAESHQLAPQHQSGQQELLENLVNRHLFG

SEQ ID NO: 44 - DNA, 1320 bp, Erwinia carotovora
atgcaagcctattttgaacagatcgaaaaagttcgttatgaaggtagccaaagcagtaatcccttcgcctttcgtcactacaatcccgatcaggaaattctcggtaaacgtatggcggaccatttgcgttttgccgtcgcttattggcacacgttctgctggaacggctcggatatgttcggcgtcggatcctttgcccggccgtggcagcagtcgggcgatgcgctggaactggcgaagcgcaaagcggatatcgcattcgaattctttcaaaaactaagcgtgccttactactgctttcatgacgtcgatgtcgcgccggaagggaactcgctgaaagaatatctgcataacattgcggtgatcaccgatgtgctggcggaaaagcagcaggatagcggcgtgaagctgctgtggggcaccgctaactgcttcaccaatccccgctatggcgcaggcgcggccaccaatcctgatccagatgtgtttgcctgggctgctacgcaggtgttcacggcaatgaacgcgaccaaaacactgggcggtgaaaactatgtgctgtggggcgggcgcgaagggtatgaaactctgctcaataccgacctgcgtcaggagcgtgagcaaattggccgctttatgcaaatggttgtcgagcataaacacaaaatcggttttcagggcacactgctcattgaaccgaaaccgcaggaaccgactaaacatcagtacgattacgatgtcgccactgtttatggcttcctgaaacagtttgggctggaaaaagagattaaagtcaacgtggaagccaaccacgcgacgcttgctgggcattcattccaccatgagatcgccaccgctgtcgcgctgggcgttttcggatcggtcgatgccaatcgcggcgaccctcagcttggctgggacaccgatcagttccctaacagcgtggaagaaaacacgctgatcatgtatgaaattctcaaggcaggcggcttcacgacaggtgggctgaactttgatgccaaagttcgtcgccagagcaccgatcgctatgaccttttccatgcgcatatcggcgcgatggatacaatggcactggcgctcaaggctgctgccagaatgattgaagatgataagctcaatcaattggtcgccaagcgctatgcgggctggaacggtgaactaggtcagcaaattctgcaaggcaacgcgtcgctggaatcgctggctcagtatgcggaaagccatcaactggcaccacagcaccagagcggccagcaggaactgctggaaaatctggttaaccgccatctatttggctag

SEQ ID NO: 45 - protein, 479 aa, Hordeum vulgare
MKGGELLVLLLASSLCLSAAVAAQETCPADIGAKCTDAASDDWEGEFFPGIDKINYEGPTSKKPLSYKWYNAEEVILGKKMKDWFRFSVAFWHTFRGTGGDPFGAPTKNWPWEDGTNSLAMAKRRMKAHFEFMEKLGVERWCFHDRDIAPDGKTLAETNANLDEIVELAKQLQSETNIKPLWGTAQLFMHPRYMHGAATSPEVKVYAYAAAQVKKALEVTHYLGGENYVFWGGREGYQTLLNTDMKRELEHLANFLQAAVNHKKKIGFNGTLLIEPKPQEPTKHQYDWDVATTFSFLQKFGLTGEFKINVECNHATLSGHSCHHELETARINDILGNIDANTGDPQVGWDTDEFLTDISEATLIMSSVVKNDGLAPGGFNFYAKLRRESTDVEDLFIAHISGMDTMARGRRNVVKLIEDGSLDELVRKRYQSFDTEIGAMIEGSSSFTAQCKYISAPMIVPYDLLLPAELAEMLFQSAL

SEQ ID NO: 46 - DNA, 1440 bp, Hordeum vulgare
atgaagggcggggagctcctggtcctgctgctggcctcgtccctctgcctgtccgccgcggttgccgcgcaggaaacctgcccggccgacatcggcgccaagtgcaccgatgccgcctccgatgattgggagggcgagttcttccccggcattgacaagatcaactatgagggtcctaccagcaagaagccgctttcttacaagtggtataacgcggaggaagtgatcctcggaaagaaaatgaaggattggtttcggttcagcgtggcgttttggcatacgttccggggtactggaggagatccctttggtgcacctacgaagaactggccttgggaggatggcaccaattccttggccatggctaagagaagaatgaaagctcacttcgagttcatggagaagcttggagttgaaaggtggtgcttccatgacagggacatcgcccctgatggcaaaacactcgcggaaacaaatgctaacttggatgagatagttgagctggcaaagcaactccagagtgagaccaatataaagccattatggggaactgcacaacttttcatgcatccacgttacatgcacggagctgctactagcccagaggtcaaggtgtatgcttatgctgctgctcaagtgaagaaagctttggaggttactcactacctaggcggtgagaactacgtattctggggtggaagagagggttaccaaactcttctcaataccgatatgaagagggaacttgaacatttggctaactttcttcaagctgctgttaaccacaagaagaagatcggctttaacggaacattgttgatagagcctaagccacaagaaccaacaaagcatcagtatgactgggatgttgcaactacattctctttcctacagaagtttggtcttacaggggaattcaagataaatgttgagtgcaaccatgctactctctctggacatagctgccatcacgagcttgagactgcacgcattaatgacattcttggaaacattgatgcaaacactggtgatccacaggttggttgggacacggatgagttccttacagacatttcagaagctaccttgattatgtcaagtgtagttaagaatgatggacttgcgcctggtggcttcaacttttacgccaaattgcggagggagagtactgatgttgaggacctgtttattgcccatatctctgggatggacaccatggcccgcggccgccgcaatgttgtcaagctgattgaggatggttccctggacgagcttgtacgcaaacgctaccagagctttgacactgagattggtgccatgatcgagggcagctcgtctttcacagcacaatgcaaatatatttctgcgccgatgattgttccttacgaccttttgttgcccgctgaattggctgagatgctgttccaatccgctctgtag

SEQ ID NO: 47 - protein, 444 aa, Klebsiella pneumoniae
MEFSMQTYFDQLDRVRYEGPKSTNPLAFRHYNPDELVLGKRMEDHLRFAACYWHTFCWNGADMFGVGSFDRPWQQPGDALEMAKRKADVAFEFFHKLNVPYYCFHDVDVSPEGASLKEYSNNFARMVEVLAEKQQQSGVKLLWGTANCFTNPRYGAGAATNPDPEVFSWAATQVVTAMNATHQLGGENYVLWGGREGYETLLNTDLRQEREQIGRFMQLVVEHKHKIGFKGTLLIEPKPQEPTKHQYDYDASTVYGFLKQFGLEKEIKLNIEANHATLAGHSFHHEIATAIALGLFGSVDANRGDPQLGWDTDQFPNSVEENALVMYEILKAGGFTTGGLNFDAKVRRQSTDKYDLFYGHIGAMDTMALSLKVAARMIEDGELDKRVARRYAGWNGELGQQILNGQMTLSDIAQYAAQHQLAPQHRSGQQEQLENLVNHYLFDK

SEQ ID NO: 48 - DNA, 1335 bp, Klebsiella pneumoniae
atggagttctctatgcagacctatttcgatcaactcgatcgcgttcgttacgaaggcccgaaatccactaacccgctggctttccgtcattacaacccggatgaactggtgctgggcaaacggatggaagatcatctgcgttttgcggcctgttactggcacaccttctgctggaatggcgccgatatgtttggcgtgggctcctttgatcgtccctggcagcagcctggcgacgccctggagatggccaaacgcaaagccgatgtggcgttcgaattcttccataaactcaacgtgccttactactgcttccacgacgttgacgtctcgccggaaggcgcttcgctcaaggagtacagcaataacttcgcccggatggtcgaggtgctggctgagaaacagcagcagagcggcgtgaagcttctgtgggggaccgcaaactgctttaccaacccgcgctacggcgccggcgcggccaccaacccggatccggaagtatttagctgggcggccacccaggtggtcaccgccatgaatgccacccatcaactgggcggtgaaaactatgtgctgtggggcggtcgcgagggctatgaaaccctgctgaataccgacctgcgccaggagcgtgagcagattggccgctttatgcagctggtggtggagcataagcataaaatcggctttaaaggcacgctgctgattgagcccaaaccgcaggagccgaccaagcatcagtatgactatgatgcctctaccgtttacggcttcctcaaacagtttggtctggaaaaagagattaaactgaatattgaagctaaccatgccacgctcgccggccattcgttccatcatgaaattgcgacggccattgcgctggggctgttcggctccgttgacgccaaccgcggcgatccgcagctgggctgggataccgaccagttcccgaacagcgtcgaagagaacgcgctggtgatgtatgaaatcctcaaagcgggcggcttcaccaccggcgggctcaactttgatgcgaaagtgcgccggcagagcaccgacaaatacgatctgttctatggtcatattggcgcgatggataccatggcgctgtcgctgaaggtcgcggcgcggatgatcgaggacggcgaactggataagcgcgtggccagacgctacgccggctggaacggtgagctggggcagcagatccttaacgggcagatgaccctgagcgatattgcccagtatgccgctcagcatcagctggcgccgcagcatcgcagcggccagcaggaacaactggaaaacctggtcaaccattatctgtttgacaagtaa

SEQ ID NO: 49 - protein, 439 aa, Lactococcus lactis
MAYFNDIAPIKYEGTKTKNMFAFRHYNPEEVVAGKTMEEQLHFALAFWHTITMDGSDPFGGATMERPWDLEGGSELDRAHRRVDAFFEIAEKLGVKYYCFHDIDIAPTGNSLKEFYANLDEITDHLLEKQKATGIKLLWNTANMFSNPRYMNGVSTSNRAEVFAYGAAQVKKGLELSKKLGGENYVFWGGREGYESLLNTDMGLEMDHMAKFFHLAIDYAKSINHLPIFLIEPKPKEPMTHQYDFDSATALAFLQKYDLDKYFKLNLETNHAWLAGHTFEHELNTARTFNALGSIDANQGNYLLGWDTDEFPTLVIDITLAMHQILLNGGLGKGGINFDAKVRRTSFKAEDLILAHIAGMDTYARALKGAAAIIEDKFLSDIVDERYSSYKNTEVGQSIENGTATFESLAAFALEHGDDIELDSNHLEYIKSVLNDYLV

SEQ ID NO: 50 - DNA, 1320 bp, Lactococcus lactis
atggcttactttaacgacatcgcacctatcaaatacgaaggtacaaaaactaaaaatatgtttgcctttcgtcattataatccagaagaagtagttgctggtaaaacaatggaagaacaacttcattttgcccttgcattttggcatacaattacgatggatgggtcagatccctttgggggagcaacaatggaacgtccttgggatttggaaggtggttctgaacttgaccgtgctcaccgtcgagtagatgctttctttgaaattgctgaaaaattaggtgttaaatattattgtttccatgatattgatattgcacctactggaaattctttgaaagaattttatgctaatttggacgaaattactgaccaccttcttgaaaaacaaaaagcaacaggcattaaattactttggaatacagcaaacatgttttcaaatccccgctatatgaatggtgtttcaacttctaatcgtgctgaagtctttgcttatggtgctgcacaagttaaaaaaggtcttgaactttctaaaaaactcggtggtgaaaattatgtcttctggggtggtcgtgaaggttatgaatcacttttgaatacagatatgggtcttgaaatggatcatatggcaaaattcttccatttggcaattgattatgcaaaatcaatcaaccacttgcctattttcttgattgaaccaaaaccaaaagaaccaatgactcaccaatatgattttgactcagcaacagctcttgctttcttgcaaaaatatgacttggacaaatacttcaaactcaatcttgaaacaaatcatgcttggttggctgggcacacttttgaacacgaattaaatactgcacgtactttcaatgctttgggttctattgatgccaatcaaggaaattacttgcttggttgggatacagatgaattcccaacacttgttattgatatcacacttgcgatgcaccaaattcttttgaacggtggacttggcaaaggtggaattaactttgatgcgaaagtacgtcgtacaagtttcaaagcagaagatttaattcttgctcatattgcagggatggatacttatgcgcgtgctttgaaaggtgcagcagcaatcattgaagataaattcttgtctgatattgttgacgaacgttatagttcatacaaaaatacagaagttggtcaatccattgaaaatggaacagcaacttttgaaagtcttgctgcatttgcacttgaacatggtgacgatattgaacttgattctaatcacttggaatacatcaaatcagtattgaatgactatcttgtttaa

SEQ ID NO: 51 - protein, 449 aa, Lactobacillus reuteri
MADLWNNIDKIEYEGPHKSIKSGLFYQYYNPDEVILGKKMKDWLRFSVAYWHTFDQRLVDPFGDGTAQRPYDKYSDPMDCALAKVDYAFEFYNKLGVDFLCFHDRDLAPEGDTLRETNKNLDRVVDKIVEYQKATGMKVLWNTSNLFTNPRFLEGAGTAPSAEIYAYAAAQLKHSLEVGKRVGSENYVFWGGREGYESLWNTDMKREQSHIAKFFHMAKDYANEIGFDAQMLLEPKPKEPTTHQYDFDAATTINFMCEYGLDKDFKLNLEGNHANLAGHTYQHEIRVAREAGLLGSLDANQGDKLIGWDIDEYPSNLYETTAAMWEVIQNGSIGPRGGLNFDAKPRRTSFKPVDLFYGHIVGMDSFAAGLRVAAAMKEDGFLDDIIKERYSTWDEGLGKSIEDGNENFASLEEKVIDTPQSELLAATHSDHLEEIKDTINHYMIETLAK

SEQ ID NO: 52 - DNA, 1350 bp, Lactobacillus reuteri
atggctgatttatggaataatattgataaaattgaatacgagggaccacataaaagtattaagtctggtttgttctaccaatactacaacccggatgaagtaattttaggtaagaaaatgaaggattggcttcgtttctcagttgcatattggcacacattcgatcaacggttagttgacccattcggtgatggaactgctcaacgtccatatgataaatacagtgacccaatggattgcgctttagcaaaggttgattatgcattcgaattttataacaaattaggtgttgatttcctttgtttccacgatcgtgatttagctccagaaggtgacacacttcgcgaaacaaacaagaatttggatcgagtagttgataagattgttgaatatcaaaaagctaccggcatgaaagttctttggaatacttcaaacctctttacaaatccacgattcttagaaggtgctggtactgctccttcagcagaaatttacgcttatgctgctgctcaattaaagcacagtcttgaagttggtaagcgcgttggttcagagaactatgtcttctggggtggacgtgaaggatatgaatcactttggaacacagatatgaagcgtgaacaatctcatattgctaagttcttccacatggctaaagattacgctaatgaaattggttttgacgctcaaatgcttcttgaaccaaagccaaaggaaccaactactcaccaatatgactttgatgctgcaacaacaatcaacttcatgtgtgaatatggtcttgataaggactttaagcttaaccttgaaggtaaccatgctaatttagctggtcacacgtaccaacatgaaattcgggttgctcgtgaagccggattacttggttctcttgatgctaaccaaggtgataagttaattggttgggatattgatgaatatccatctaacctttatgaaactactgctgctatgtgggaagttattcaaaacggtagcatcggacctcgtggtggattaaactttgatgcaaaaccacgtcggacatcgtttaagcctgtagatcttttctatggtcacattgttgggatggatagctttgctgctggcttacgggttgctgctgctatgaaggaagacggtttcttagatgatattattaaagaacgttactccacatgggatgaaggcttaggtaagagtattgaagacggtaatgaaaactttgctagtcttgaagaaaaagtaattgatactccacaaagcgaattgttagcagccacacattcagaccatcttgaagaaattaaggacacaattaaccactacatgattgaaacgcttgctaagtaa

SEQ ID NO: 53 - protein, 448 aa, Leuconostoc mesenteroides
MAELFDFPQVTFVGIQSLQAGDGFHYYNPDEIVKGKKMSDWLKFSVTYWHTMDQRLVDPFGEGTAVRPWDNQGKPDSMEQALAKVDYLFEFLEKTDVNYFAFHDRDLAPEGHTLAETNKNLDQVIDKIEQKIHETGKKLLWNTSSLFTNKRFLAGGATTPFAEVFAYAAGQIKHSLDIAKRLGSESYVFWGGREGYDFLLNTDTKRELDHIAAFFKLAKDYANEIGYQGQFLIEPKPKEPTQHQYDFDVQTTIAFLKTYGLEDTFKLNLEGNHAYLAGHTYEHEVRFAREAGLLGSLDANMGDKLTGWDIDEFPNDVYEATLVMYEFLKNGGLPTGGLNFDSKARRQSFQADDLFYAHIAGMDTYAAGLKVAAKLIDDQVIENVLKERYASFDSGIGADFEAGKVTLKELATYIENKTDEEINATLKSGRQERIKQTLNNYIFSVLGS

SEQ ID NO: 54 - DNA, 1347 bp, Leuconostoc mesenteroides
atggcagaactttttgattttccccaagtaacatttgtaggaatacaatcattacaagcgggtgatggatttcattattataatccagatgaaatagttaaaggtaagaaaatgagtgactggctaaagttttcagtgacttattggcatacaatggaccaacgcttagtagacccatttggtgaaggaacagcagtccggccgtgggacaatcaaggtaaaccagattcaatggagcaagcattagcgaaggttgattatttgtttgagtttttggaaaaaactgacgttaattactttgcctttcatgatcgtgatcttgcacctgaaggtcatacacttgccgaaacaaataaaaatttagatcaagttattgacaaaattgaacaaaaaatacatgaaacaggtaaaaaacttttatggaatacttcatcactatttacgaataaacgttttttggctggtggcgcaactacaccatttgctgaggtatttgcttatgcagctggacaaattaagcattcattagatattgccaagcgcttaggatcagaatcatatgttttctggggcggacgagaaggctacgactttctattaaatactgacaccaaacgtgaattagaccatattgcagcattctttaagctagctaaggattatgcaaatgaaattggttatcagggacaattcttgattgaacccaagcccaaagaaccaacacagcatcaatatgattttgatgtgcaaacaacaattgctttcttgaaaacttatggattagaggatacattcaagttgaacttggaaggcaatcacgcctacttagctggtcacacgtatgagcatgaagtgagatttgcgcgagaggctggtttgttagggtcattagatgctaacatgggtgataagctcactggttgggacattgatgaatttccaaatgatgtttatgaggcgaccttagtaatgtatgaattcttgaaaaacgggggtctaccaactggtggtttgaattttgattcgaaagcacgccgtcaaagtttccaagctgacgatttgttctacgcgcatattgctggtatggatacttatgctgctggcttgaaagttgctgctaagctaattgatgaccaagtgattgaaaatgttctgaaagagcggtatgcttcatttgattcgggtattggcgctgattttgaagctgggaaagttaccttaaaagaattggccacctatattgaaaataaaacagatgaagaaatcaacgcaaccctcaagtcaggtcgccaagaacgaatcaaacaaacattgaataattacattttttctgtacttggatcttaa

SEQ ID NO: 55 - protein, 439 aa, Thermoanaerobacterium thermosulfurigenes
MNKYFENVSKIKYEGPKSNNPYSFKFYNPEEVIDGKTMEEHLRFSIAYWHTFTADGTDQFGKATMQRPWNHYTDPMDIAKRRVEAAFEFFDKINAPFFCFHDRDIAPEGDTLRETNKNLDTIVAMIKDYLKTSKTKVLWGTANLFSNPRFVHGASTSCNADVFAYSAAQVKKALEITKELGRENYVFWGGREGYETLLNTDMELELDNFARFLHMAVDYAKEIGFEGQFLIEPKPKEPTKHQYDFDVANVLAFLRKYDLDKYFKVNIEANHATLAFHDFQHELRYARINGVLGSIDANTGDMLLGWDTDQFPTDIRMTTLAMYEVIKMGGFDKGGLNFDAKVRRASFEPEDLFLGHIAGMDAFAKGFKVAYKLVKDGVFDKFIEERYASYKEGIGADIVSGKADFKSLEKYALEHSQIVNKSGRQELLESILNQYLFAE

SEQ ID NO: 56 - DNA, 1320 bp, Thermoanaerobacterium Thermosulfurigenes; identical to SEQ ID NO: 26

SEQ ID NO: 57 - protein, 444 aa, Thermotoga neapolitana
MAEFFPEIPKVQFEGKESTNPLAFKFYDPEEIIDGKPLKDHLKFSVAFWHTFVNEGRDPFGDPTADRPWNRYTDPMDKAFARVDALFEFCEKLNIEYFCFHDRDIAPEGKTLRETNKILDKVVERIKERMKDSNVKLLWGTANLFSHPRYMHGAATTCSADVFAYAAAQVKKALEITKELGGEGYVFWGGREGYETLLNTDLGFELENLARFLRMAVDYAKRIGFTGQFLIEPKPKEPTKHQYDFDVATAYAFLKSHGLDEYFKFNIEANHATLAGHTFQHELRMARILGKLGSIDANQGDLLLGWDTDQFPTNVYDTTLAMYEVIKAGGFTKGGLNFDAKVRRASYKVEDLFIGHIAGMDTFALGFKVAYKLVKDGVLDKFIEEKYRSFREGIGRDIVEGKVDFEKLEEYIIDKETIELPSGKQEYLESLINSYIVKTILELR

SEQ ID NO: 58 - DNA, 1335 bp, Thermotoga neapolitana
atggctgaattctttccagaaatcccgaaagtgcagttcgaaggcaaagaaagcacaaatccacttgcgttcaagttctacgatccagaagagatcatcgacggcaaacccctcaaggaccatctgaagttctccgttgccttctggcacaccttcgtgaacgagggaagggatcccttcggagacccaacggccgatcgtccctggaacaggtacaccgatcccatggacaaggcttttgcaagggtggacgccctttttgaattctgcgaaaaactcaacatcgagtacttctgcttccacgacagagacatcgctcccgagggaaaaacgctgagggagacaaacaaaattttggacaaagtagtggagagaatcaaagagagaatgaaagacagcaacgtgaagctcctctggggtactgcaaacctcttttcccacccaaggtacatgcatggtgcagcgacaacctgcagtgctgatgtttttgcgtacgcggccgcccaggtgaaaaaagcccttgagatcaccaaagaacttggaggagaagggtacgtcttctggggtggaagagaaggatacgaaacactcctcaacacggaccttggattcgaacttgaaaacctcgcccgcttcctcagaatggctgtggattatgcaaaaaggatcggtttcaccggacagttcctcatcgaaccaaaaccgaaagaacccaccaaacaccagtacgacttcgacgttgcaaccgcctatgccttcctgaagagccacggtctcgatgaatacttcaaattcaacatcgaggcaaaccacgccacactcgccggtcacaccttccagcacgaactgagaatggcaaggatccttggaaaactcggaagcatcgatgcaaaccagggagaccttcttcttggatgggacaccgatcagttcccaacaaacgtctacgatacaacccttgcaatgtacgaagtgataaaagcgggaggcttcacaaaaggtgggctcaacttcgatgcgaaggtgaggagggcttcttacaaagtggaggacctcttcatagggcacatagcgggaatggacacctttgcactcggtttcaaggtggcatacaaactcgtgaaggatggtgttctggacaaattcatcgaagaaaagtacagaagtttcagggagggcattggaagggacatcgtcgaaggtaaagtggattttgaaaaacttgaagagtatataatagacaaagaaacgatagaacttccatctggaaagcaagaatacctggaaagcctcatcaacagttacatagtgaagaccattctggaactgaggtga

SEQ ID NO: 59 - protein, 388 aa, Streptomyces rubiginosus
MNYQPTPEDRFTFGLWTVGWEGRDPFGDATRRALDPVESVRRLAELGAHGVTFHDDDLIPFGSSDSEREEHVKRFRQALDDTGMKVPMATTNLFTHPVFKDGGFTANDRDVRRYALRKTIRNIDLAVELGAETYVAWGGREGAESGGAKDVRDALDRMKEAFDLLGEYVTSQGYDIRFAIEPKPNEPRGDILLPTVGHALAFIERLERPELYGVNPEVGHEQMAGLNFPHGIAQALWAGKLFHIDLNGQNGIKYDQDLRFGAGDLRAAFWLVDLLESAGYSGPRHFDFKPPRTEDFDGVWASAAGCMRNYLILKERAAAFRADPEVQEALRASRLDELARPTAADGLQALLDDRSAFEEFDVDAAAARGMAFERLDQLAMDHLLGARG

SEQ ID NO: 60 - DNA, 1167 bp, Streptomyces rubiginosus
atgaactaccagcccacccccgaggacaggttcaccttcggactgtggaccgtcggctggcagggacgggaccccttcggtgacgccacgcggcgcgccctcgacccggtcgagtcggtgcggcggctggccgagctgggcgcccacggcgtcacgttccacgacgacgacctcatccccttcggctccagcgacagcgagcgcgaggagcacgtcaagcggttccggcaggcgctggacgacaccggcatgaaggtgccgatggccaccaccaacctgttcacccacccggtgttcaaggacggcggcttcaccgccaacgaccgcgacgtgcgccgctacgccctgcgcaagaccatccgcaacatcgacctcgcggtcgagctcggcgccgagacctatgtggcctggggcggccgcgagggtgccgagtcgggtggcgccaaggacgtgcgggacgccctcgaccgcatgaaggaggccttcgacctgctcggcgagtacgtcacctcccagggctacgacatccgcttcgccatcgagcccaagccgaacgagccgcgcggcgacatcctgctccccaccgtcggccacgccctggcgttcatcgagcgcctggagcgaccggagctgtacggcgtgaaccccgaggtcggccacgagcagatggccgggctgaacttcccgcacggcatcgcgcaggcgctgtgggcgggcaagctgttccacatcgacctcaacggccagaacggcatcaagtacgaccaggacctccgcttcggcgcgggcgacctgcgggccgcgttctggctggtggacctgctggagtcggccggctacagcggcccgcggcacttcgacttcaagccgccgcggaccgaggacttcgacggggtgtgggcctcggcggccggctgcatgcgcaactacctgatcctcaaggagcgtgcggcggccttccgcgccgaccccgaggtgcaggaggcgctgcgcgcgtcccgtctggacgagctggcccggcccacggcggccgacggtctgcaggccctgctcgacgaccggtccgccttcgaggagttcgacgtcgacgcggcggcggcccgtgggatggccttcgagcgcctggaccagctggcgatggaccacctgctgggcgcccggggctga

SEQ ID NO: 61 - protein, 391 aa, Streptomyces albus
MNYQPTPEDRFTFGLWTVGWEGRDPFGDATRTALDPVESVRRLAELGAHGVTFHDDDLIPFGSSDSERYEHVKRFRQALDDTGMKVPMATTNLFTHPVFKDGGFTANDRDVRRYALRKTIRNIDLAVELGAETYVAWGGREGAESGGAKDVRDALDRMKEAFDLLGEYVTSQGYDIRFAIEPKPNEPRGDILLPTVGHALAFIERLERPELYGVNPEVGHEQMAGLNFPHGIAQALWAGKLFHIDLNGQNGIKYDQDLRFGAGDLRAAFWLVDLLESAGYSGPRHFDFKPPRTEDFDGVWASAAGCMRNYLILKERAAAFRADPEVQEALRASRLDELARPTAADGLQALLDDRSAFEEFDVDAAAARGMAFERLDQLAMDHLLGARGAAA

SEQ ID NO: 62 - DNA, 1167 bp, artificial sequence
  designed coding sequence
atgaactaccagcccacccccgaggacaggttcaccttcggactgtggaccgtcggctgggagggacgggaccccttcggtgacgccacgcggagcgccctcgacccggtcgagtcggtgcggcggctggccgagctgggcgcccacggcgtcacgttccacgacgacgacctcatccccttcggctccagcgacagcgagcgctacgagcacgtcaagcggttccggcaggcgctggacgacaccggcatgaaggtgccgatggccaccaccaacctgttcacccacccggtgttcaaggacggcggcttcaccgccaacgaccgcgacgtgcgccgctacgccctgcgcaagaccatccgcaacatcgacctcgcggtcgagctcggcgccgagacctatgtggcctggggcggccgcgagggtgccgagtcgggtggcgccaaggacgtgcgggacgccctcgaccgcatgaaggaggccttcgacctgctcggcgagtacgtcacctcccagggctacgacatccgcttcgccatcgagcccaagccgaacgagccgcgcggcgacatcctgctccccaccgtcggccacgccctggcgttcatcgagcgcctggagcgaccggagctgtacggcgtgaaccccgaggtcggccacgagcagatggccgggctgaacttcccgcacggcatcgcgcaggcgctgtgggcgggcaagctgttccacatcgacctcaacggccagaacggcatcaagtacgaccaggacctccgcttcggcgcgggcgacctgcgggccgcgttctggctggtggacctgctggagtcggccggctacagcggcccgcggcacttcgacttcaagccgccgcggaccgaggacttcgacggggtgtgggcctcggcggccggctgcatgcgcaactacctgatcctcaaggagcgtgcggcggccttccgcgccgaccccgaggtgcaggaggcgctgcgcgcgtcccgtctggacgagctggcccggcccacggcggccgacggtctgcaggccctgctcgacgaccggtccgccttcgaggagttcgacgtcgacgcggcggcggcccgtgggatggccttcgagcgcctggaccagctggcgatggaccacctgctgggcgcccggggctga

SEQ ID NO: 63 - protein, 387 aa, Thermus thermophilus
MYEPKPEHRFTFGLWTVGNVGRDPFGDAVRERLDPVYVVHKLAELGAYGVNLHDEDLIPRGTPPQERDQIVRRFKKALDETGLKVPMVTANLFSDPAFKDGAFTSPDPWVRAYALRKSLETMDLGAELGAEIYVVWPGREGAEVEATGKARKVWDWVREALNFMAAYAEDQGYGYRFALEPKPNEPRGDIYFATVGSMLAFIHTLDRPERFGLNPEFAHETMAGLNFVHAVAQALDAGKLFHIDLNDQRMSRFDQDLRFGSENLKAAFFLVDLLESSGYQGPRHFDAHALRTEDEEGVWAFARGCMRTYLILKERAEAFREDPEVKELLAAYYQEDPAALALLGPYSREKAEALKRAELPLEAKRRRGYALERLDQLAVEYLLGVRG

SEQ ID NO: 64 - DNA, 1164 bp, Thermus thermophilus
gtgtacgagcccaaaccggagcacaggtttacctttggcctttggactgtgggcaatgtgggccgtgatcccttcggggacgcggttcgggagaggctggacccggtttacgtggttcataagctggcggagcttggggcctacggggtaaaccttcacgacgaggacctgatcccgcggggcacgcctcctcaggagcgggaccagatcgtgaggcgcttcaagaaggctctcgatgaaaccggcctcaaggtccccatggtcaccgccaacctcttctccgaccctgctttcaaggacggggccttcacgagcccggacccttgggttcgggcctatgccttgcggaagagcctggagaccatggacctgggggcagagcttggggccgagatctacgtggtctggccgggccgggagggagctgaggtggaggccacgggcaaggcccggaaggtctgggactgggtgcgggaggcgctgaacttcatggccgcctacgccgaggaccagggatacgggtaccggtttgccctcgagcccaagcctaacgagccccggggggacatttacttcgccaccgtggggagcatgctcgcctttattcataccctggaccggcccgagcgcttcggcctgaaccccgagttcgcccacgagaccatggccgggcttaactttgtccacgccgtggcccaggctctcgacgccgggaagcttttccacattgacctcaacgaccaacggatgagccggtttgaccaggacctccgcttcggctcggagaacctcaaggcggcctttttcctggtggacctcctggaaagctccggctaccagggcccccgccactttgacgcccacgccctgcgtaccgaggacgaagaaggggtttgggccttcgcccgaggctgcatgcgtacctacctgatcttaaaggaaagggctgaagccttccgcgaggatcccgaggtcaaggagcttcttgccgcttactatcaagaagatcctgcggccttggcccttttgggcccctactcccgcgagaaggccgaagccctcaagcgggcggagcttcccctcgaggccaagcggcgccggggttatgccctggaacgcctggaccagctggcggtggagtacctcctgggggtgcgggggtga

SEQ ID NO: 65 - protein, 388 aa, Streptomyces diastaticus
MSYQPTPEDKFTFGLWTVGWQGRDPFGDATRGALDPAESVRRLAELGAHGVTFHDDDLIPFGATDSERAEHIKRFRQGLDETGMKVPMATTNLFTHPVFKDGGFTANDRDVRRYAVRKTIRNIDLAVELGAQTYVAWGGREGAESGAAKDVRVALDRMKEAFDLLGEYVTSQGYDTPFAIEPKPNEPRGDILLPTIGHALAFIDGLERPELYGVNPEVGHEQMAGLNFPHGIAQALWAGKLFHIDLNGQSGIKYDQDLRFGPGDLAAAFWLVDLLESAGYEGPRHFDFKPPRTEDFDGVWASAAGCMRNYLILKERAAAFRADPEVQEALRAARLDELAQPTAGDGLQALLPDRSAFEDFDPDAAAARGMAFERLDQLAMDHLLGARG

SEQ ID NO: 66 - DNA, 1167 bp, Streptomyces diastaticus
atgagctaccagcccacccccgaggacaagttcacgttcggcctgtggaccgtcggctggcagggacgggaccccttcggcgacgccacccgcggcgccctcgacccggccgagtccgtccgccgcctcgccgagctcggcgcccacggcgtgacgttccacgacgacgacctcatccccttcggcgcgacggacagcgagcgcgccgagcacatcaagcggttccgccaggggctggacgagaccggcatgaaggtcccgatggcgaccaccaacctgttcacccacccggtgtttaaggacggcggcttcaccgcgaacgaccgtgacgtgcgccgttacgccgtgcgcaagaccatccgcaacatcgacctcgcggtcgagctcggcgcgcagacctacgtcgcctggggcggccgcgagggcgccgagtccggcgccgccaaggacgtccgggtcgccctcgaccgcatgaaggaggctttcgacctcctcggcgagtacgtcacctcccagggctacgacactccgttcgccatcgagcccaagccgaacgagccccgcggcgacatcctcctgccgacgatcggccacgccctcgccttcatcgacggcctcgagcgcccggagctgtacggcgtcaacccggaggtcggccacgagcagatggccgggctcaacttcccgcacggcatcgcccaggccctgtgggcgggcaagctgttccacatcgacctcaacggccagtccggcatcaagtacgaccaggacctccgcttcgggccgggcgacctggccgccgcgttctggctggtggacctgctggagtcggccggctacgagggcccgcgccacttcgacttcaagccgccgcggaccgaggacttcgacggcgtctgggcctccgcggccggctgcatgcgcaactacctgatcctcaaggagcgcgcggccgccttccgtgcggacccggaggtgcaggaggcgctgcgcgcggcccggctggacgagctcgcccagccgacggcgggcgacggcctccaggccctgctgcccgaccgctcggcgttcgaggacttcgacccggacgcggcggcggcccgtggcatggccttcgagcggctggaccagctggcgatggaccacctgctgggcgcgcggggctag

SEQ ID NO: 67 - protein, 387 aa, Streptomyces coelicolor
MNYQPTPEDRFTFGLWTVGWQGRDPFGDATRQALDPAESVRRLSELGAYGVTFHDDDLIPFGSSDTERESHIKRFRQALDATGMKVPMATTNLFTHPVFKDGAFTANDRDVRRYALRKTIRNIDLAVELGASVYVAWGGREGAESGAAKDVRDALDRMKEAFDLLGEYVTEQGYDLKFAIEPKPNEPRGDILLPTVGHALAFIERLERPELYGVNPEVGHEQMAGLNFPHGIAQALWAGKLFHIDLNGQSGIKYDQDLRFGAGDLRAAFWLVDLLERAGYAGPRHFDFKPPRTEDFDGVWASAAGCMRNYLILKDRAAAFRADPQVQEALAAARLDELARPTAEDGLAALLADRSAYDTFDVDAAAARGMAFEHLDQLAMDHLLGAR

SEQ ID NO: 68 - DNA, 1164 bp, Streptomyces coelicolor
atgaactaccagcccactcccgaggacaggttcacgttcggtttgtggacggtcggctggcagggccgtgacccgttcggtgacgccaccaggcaggccctggaccccgccgagtcggtacggcgtctgtccgagctgggtgcgtacggcgtcacgttccacgacgacgacctgatccccttcgggtcgagcgacacggagcgggagtcgcacatcaagcggttccggcaggcgctggacgcgaccggcatgaaggtgccgatggcgacgacgaacctgttcacgcacccggtgttcaaagacggcgccttcacggcgaacgaccgggacgtgcggcggtacgcgctgcgcaagacgatccgcaacatcgacctcgcggtcgagctgggcgcgagcgtctacgtggcctggggcggccgggagggtgcggagtccggcgcggccaaggacgtgcgggacgcgctcgaccggatgaaggaggccttcgacctgctgggcgagtacgtcaccgagcagggctacgacctgaagttcgcgatcgagccgaagcccaacgagccgcgcggtgacatcctgctcccgacggtcggccacgccctcgccttcatcgagcgcctcgagcggccggagctgtacggcgtgaacccggaggtcggccacgagcagatggccggcctgaacttcccccacggcatcgcccaggcgctgtgggcgggcaagctcttccacatcgacctcaacggccagtcgggcatcaagtacgaccaggacctgaggttcggcgcgggcgacctgcgggccgcgttctggctcgtcgacctgctggagcgggccgggtacgcgggtccgcggcacttcgacttcaagccgccgcggaccgaggacttcgacggcgtgtgggcgtcggccgccggctgcatgcgcaactacctgatcctcaaggaccgggcggcggcattccgcgccgacccgcaggtgcaggaggcgctggccgcggcccggctggacgaactggcccgcccgaccgccgaggacggtctcgccgccctgctggccgaccggagcgcctacgacaccttcgacgtggacgcggccgccgcgcgaggcatggcgttcgagcacctcgaccagctcgccatggaccacctcctcggcgcccgctga

SEQ ID NO: 69 - protein, 387 aa, Thermus Caldophilus
MYEPKPEHRFTFGLWTVGNVGRDPFGDAVRERLDPVYVGHKLAELGVHGVNLHDEDLIPRGTPPQERDQIVRRFKRALDETGLKVPMVTGNLFSDPGFKDGGFTSRDPWVRAYAFRKSLETMDLGAELGAEIYVVWPGREGAEVEATGKARKVWDWVREPLNFMAAYAEDQGYGYRFALEPKPNEPRGDIYFATVGSMLALIHTLERPERFGLNPEFAHETMAGLNFVHAVAQALDAGKLLHIDLNGQRMNRFDQDLRFGSENLKAAFLLVDLLESSGYQGPRHFDAHALRTEDEEGVWAFARGCMRTYLILKERAEAFREDPEVKELLAAYYQEDPAALPLMDPYSHEKAEALKRAELPLEAKRHRGYALERLDQLAVEYLLGVRG

SEQ ID NO: 70 - DNA, 1164 bp, artificial sequence
  designed coding sequence
atgtacgagcctaaaccggagcacaggtttacctttggcctttggactgtgggcaatgtgggccgtgatcccttcggggacgcggttcgggagaggctggacccggtttacgtggttcataagctggcggagcttggggtccacggggtaaaccttcacgacgaggacctgatcccgcggggcacgcctcctcaggagcgggaccagatcgtgaggcgcttcaagagggctctcgatgaaaccggcctcaaggtccccatggtcaccggcaacctcttctccgaccctggtttcaaggacgggggcttcacgagccgggacccttgggttcgggcctatgcctttcggaagagcctggagaccatggacctgggggcagagcttggggccgagatctacgtggtctggccgggccgggagggagctgaggtggaggccacgggcaaggcccggaaggtctgggactgggtgcgggagccgctgaacttcatggccgcctacgccgaggaccagggatacgggtaccggtttgccctcgagcccaagcctaacgagccccggggggacatttacttcgccaccgtggggagcatgctcgccttaattcataccctggagcggcccgagcgcttcggcctgaaccccgagttcgcccacgagaccatggccgggcttaactttgtccacgccgtggcccaggctctcgacgccgggaagcttttgcacattgacctcaacggccaacggatgaaccggtttgaccaggacctccgcttcggctcggagaacctcaaggcggcctttctcctggtggacctcctggaaagctccggctaccagggcccccgccactttgacgcccacgccctgcgtaccgaggacgaagaaggggtttgggccttcgcccgaggctgcatgcgtacctacctgatcttaaaggaaagggctgaagccttccgcgaggatcccgaggtcaaggagcttcttgccgcttactatcaagaagatcctgcggccttgccccttatggacccctactcccacgagaaggccgaagccctcaagcgggcggagcttcccctcgaggccaagcggcaccggggttatgccctggaacgcctggaccagctggcggtggagtacctcctgggggtgcgggggtga

SEQ ID NO: 71 - protein, 445 aa, Xanthomonas campestris
MSNTVYIGAKEYFPGIGKIGFEGRDSDNPLAFKVYDANKTIGDKTMAEHLRFAVAYWHSFCGNGADPFGPGTRAYPWDAGTTALNRAEAKADAAFEFFTKLGVPYYCFHDIDLAPDADDIGEYEKNLKHMVGIAKQRQADTGIKLLWGTANLFSHPRYMNGASTNPDFNVVARAAVQVKAAIDATVELGGENYVFWGGREGYACLHNTQMKREQDNMARFLTLARDYGRAIGFKGNFLIEPKPMEPMKHQYDFDSATVIGFLRQHGLDQDFKLNIEANHATLSGHSFEHDLQVASDAGLLGSIDANRGNPQNGWDTDQFPTDLYDTVGAMLVVLRQGGLAPGGLNFDAKVRRESSDPQDLFLAHIGGMDAFARGLEVANALLTASPLEQWRAERYASFDSGAGADFAAGKTTLADLAKHAASNAPQQLSGRQEAYENLINQYLTR

SEQ ID NO: 72 - DNA, 1338 bp, Xanthomonas campestris
atgagcaacaccgtgtacatcggcgcgaaagaatatttccccggcatcggcaagatcggcttcgaaggccgcgattcggacaacccgctcgcgttcaaggtctacgacgccaacaaaaccatcggcgacaagaccatggccgagcatctgcgctttgccgtggcctactggcacagcttctgcggcaatggcgccgacccgttcggcccgggcacgcgggcgtatccgtgggatgcgggcactaccgcgttgaaccgtgccgaagccaaggccgatgcggcgttcgagttcttcaccaagctcggcgtgccgtactactgcttccacgatatcgacctggcaccggatgccgacgacatcggcgagtacgaaaagaatctcaaacacatggtgggcatcgccaagcagcgccaggccgacaccggcatcaagctgttgtggggcacggccaacctgttctcgcacccgcgctacatgaatggcgcatcgaccaacccggacttcaatgtcgtggcgcgcgccgccgtgcaggtcaaggccgcgatcgatgccaccgttgaattgggcggcgaaaactacgtgttctggggcggccgcgaaggctacgcctgcctgcacaacacgcagatgaagcgcgagcaggacaacatggcgcgcttcctcaccctggcgcgcgactacggccgcgcgattggcttcaagggcaatttcctgatcgagcccaagcccatggagccgatgaagcaccagtacgatttcgacagcgccacggtgatcggcttcctgcgccagcatggcctggaccaggatttcaagctcaacatcgaggccaatcacgccaccttgtccggccatagcttcgagcatgacctgcaggtggcatccgatgccggcctgctcggcagcatcgatgccaaccgcggcaacccgcagaacggctgggacaccgaccagttcccgaccgacctgtacgacaccgtcggcgccatgctggtggtgctgcggcagggcgggctggcaccgggcggcttgaacttcgatgccaaggtgcgtcgcgaatcgtccgacccgcaggacctgttcctggcccacatcggcggcatggacgcgttcgcacgcgggctggaagtggccaacgcgctgctgaccgcctcgccgctggaacagtggcgcgccgagcgttacgccagcttcgacagcggcgccggcgcggactttgccgcaggcaagaccacgctggccgatctggccaagcacgcggccagcaatgcgccccagcaactcagcggccgccaggaagcgtatgaaaacctgatcaatcagtatctgacgcgttga

SEQ ID NO: 73 - protein, 387 aa, Thermus aquaticus; identical to SEQ ID NO: 63

SEQ ID NO: 74 - DNA, 1164 bp, Thermus thermophilus
atgtacgagcctaaaccggagcacaggtttacctttggcctttggactgtgggcaatgtgggccgtgatcccttcggggacgcggttcgggagaggctggacccggtttacgtggttcataagctggcggagcttggggcctacggggtaaaccttcacgacgaggacctgatcccgcggggcacgcctcctcaggagcgggaccagatcgtgaggcgcttcaagaaggctctcgatgaaaccggcctcaaggtccccatggtcaccgccaacctcttctccgaccctgctttcaaggacggggccttcacgagcccggacccttgggttcgggcctatgccttgcggaagagcctggagaccatggacctgggggcagagcttggggccgagatctacgtggtctggccgggccgggagggagctgaggtggaggccacgggcaaggcccggaaggtctgggactgggtgcgggaggcgctgaacttcatggccgcctacgccgaggaccagggatacgggtaccggtttgccctcgagcccaagcctaacgagccccggggggacatttacttcgccaccgtggggagcatgctcgcctttattcataccctggaccggcccgagcgcttcggcctgaaccccgagttcgcccacgagaccatggccgggcttaactttgtccacgccgtggcccaggctctcgacgccgggaagcttttccacattgacctcaacgaccaacggatgagccggtttgaccaggacctccgcttcggctcggagaacctcaaggcggcctttttcctggtggacctcctggaaagctccggctaccagggcccccgccactttgacgcccacgccctgcgtaccgaggacgaagaaggggtttgggccttcgcccgaggctgcatgcgtacctacctgatcttaaaggaaagggctgaagccttccgcgaggatcccgaggtcaaggagcttcttgccgcttactatcaagaagatcctgcggccttggcccttttgggcccctactcccgcgagaaggccgaagccctcaagcgggcggagcttcccctcgaggccaagcggcgccggggttatgccctggaacgcctggaccagctggcggtggagtacctcctgggggtgcgggggtga

SEQ ID NO: 75 - protein, 435 aa, Tetragenococcus halophilus
MDYFENVPKVQYEGKNAKSKYAFRHYNPEEIIMGKPMKDHLRFSVAFWHTMTEDGSDPFGDGTYQRNWEGSTPMETAKNRVDAFFEILEKLGAEYFCFHDVDIAPQGDSLKEFLENIDVMTDYIKGKMDKTGVKLLWNTANMFTHPTFVNGAATTNNADVYSMAAAQVKKGLDVSKKLNGENYVFWGGREGYENLLNTDMNFELDNLARFYQMVIDYAQKIDYHPQFLIEPKPKEPTKHQYDYDAATAMAFIQKYNLEDSFKLNLEANHATLAGHTFEHELNVAKNYNALGSLDANQGDLLLGWDTDEFPTDIYTATLAMYEVLDFGGIAPGGLNFDAKVRRTSFAMDDLILAHIAGMDTYARGLRAAAKMKDDNFFEQIIANRYESFSSGIGKQIVENKEDLESLTNYALSLNGVENKSGHIEHLKSLLNDYLV

SEQ ID NO: 76 - DNA, 1308 bp, Tetragenococcus halophilus
atggactattttgaaaacgttccaaaagtgcagtatgaagggaagaatgccaaaagtaaatatgcgtttcggcactataaccccgaagaaattatcatggggaagccgatgaaagaccatttacgtttttcagtcgctttttggcatacgatgacagaagatggatccgatccatttggagatgggacttaccaaagaaattgggaaggaagcacaccaatggaaacggctaaaaatcgtgtagatgctttttttgaaatattagaaaaattaggagccgagtatttttgtttccatgatgttgatatagctcctcaaggcgattctttaaaagaatttttggaaaatattgatgttatgacggactatattaaaggaaaaatggataaaacaggagtcaagctgttatggaacacagcaaatatgtttactcatccaacatttgttaatggggccgcaacaacaaataatgcagatgtttattctatggcagcagcccaggttaagaaaggcttagacgttagcaaaaaattaaatggcgaaaattatgttttttggggcggaagagaaggatatgaaaacctgttgaatacagatatgaattttgaacttgacaacttagcccgtttttatcaaatggtgattgactatgctcaaaaaatcgattatcaccctcagtttttaatcgaaccaaaacctaaagaaccaacaaagcaccaatacgattacgacgcagctactgcaatggcatttatccaaaaatataacttagaagatagctttaaattaaatctggaagccaatcatgcaactcttgctggacatacgtttgaacatgagttaaacgttgcaaaaaattataatgctctaggttcactagacgccaatcaaggtgatttacttctgggatgggatactgatgaattccctactgatatatatacggcgacgttagccatgtatgaagtcctagattttggtggcatagcgccaggaggcctcaattttgatgcgaaagttcgaaggacttcatttgcaatggacgatttgattctagcccatattgccggtatggatacgtatgccagaggattacgtgcggcagctaaaatgaaagatgataacttttttgaacaaattattgctaatagatacgaaagcttttcctctggtattggcaaacagattgtggaaaataaggaagatctcgaatccttaacgaactacgcattatcacttaatggagtagaaaataaatcaggacatattgaacatcttaaatcgcttcttaatgactatttggtatag

SEQ ID NO: 77 - protein, 439 aa, Staphylococcus xylosus
MSYFDINKVNYEGPKSNNAFSFKYYNPEEKLGNHSMSELLRFSVAYWHTFTADLSDPFGVGVAERDWDSLDEMEKAKARVEAIFEFMEKTRIDYFCFHDVDISPEGASLKESNENLDIIVELIKEKMDQTGKKLLWNTTNNFTHERFVHGAATSSNAEVFAYAAAKVKKSLEIAKKLGSENFVFWGGREGYESLLNTNMKLELDNLATFFKMAKSYADEIGYTGQFLIEPKPKEPTTHQYDTDVATAHAFLQKYDLDKDFKFNIEANHATLAGHTFQHELRYARDNNMLGSVDANQGHPLLGWDTDESTDVYDTTLAMYEILKNGGLAPGGLNFDAKPRRTSFKQEDLILTHIAGMDTFALGLRVAYKMIEDNFFENIMDEKYKSFNEGIGKKIVEGETSLKELEDYAFNINTINNTSDHLEVIKSQINQYILNINNKD

SEQ ID NO: 78 - DNA, 1320 bp, Staphylococcus xylosus
atgtcttattttgatatcaataaagtaaattacgaaggtcctaagtcaaataacgcttttagttttaagtattacaatcctgaagaaaaacttggtaatcactccatgtcagaacttttaagattcagtgtcgcttattggcacacttttactgctgacctttccgatccattcggtgtgggtgttgcggaacgtgattgggattcattagacgagatggaaaaagcaaaagcaagagtagaagcaatttttgaatttatggaaaaaacacgtattgattacttttgttttcacgatgtagacatttctccagaaggcgcatctttaaaagaatctaatgaaaatttagatatcattgtagaacttattaaagaaaaaatggatcaaactggtaagaaattactttggaatacaaccaacaactttactcacgagcgttttgttcatggtgcagccacgtcttcaaatgctgaagtatttgcatatgcagctgcaaaagtaaaaaaatcattagaaattgctaaaaaacttggttctgaaaactttgttttttggggcggtcgtgaaggctatgaaagtttattaaatactaatatgaaattagagttagataacttagctactttctttaaaatggcaaaaagttacgcagatgaaattggctatacgggtcaatttttaatagaaccaaaacctaaagaacctaccacacatcaatatgatactgatgttgcaactgcacacgctttcttacaaaaatatgatttagataaagactttaaatttaatattgaagctaaccacgcgacgctggctggccacacattccaacatgaattaagatatgcacgtgataacaatatgttgggttcagtagatgctaaccaaggacatccccttttaggatgggatacagatgaatcaactgatgtatacgatactacgttagcaatgtacgaaatacttaaaaatggcgggttggctccagggggattaaactttgatgctaaacctagaagaacatcatttaaacaagaggatttaattttaactcacattgcgggtatggatactttcgcattaggcctacgagttgcttataagatgattgaagataatttctttgaaaatattatggatgaaaaatacaaatcatttaatgaaggcattggtaagaaaatagttgaaggagagacttcattgaaagaattagaagattatgctttcaatattaatacaattaataatacctctgatcatttagaagttattaaatcacaaattaatcaatatatcttaaatattaataataaggattga

SEQ ID NO: 79 - protein, 407 aa, Mycobacterium smegmatis str. MC2 155]
MTVLESNVSTTEPLTPKREDRFSFGLWTIGWNGNDPFGVATRPALDVVEAVEKLAELGAYGLTFHDDDLFAFGSSDTERRRMVDRLTSALSANGMVVPMVTTNLFTQPVFKDGGFTSNDRTVRRFALRKVLRNIDLAIELGAETFVLWGGREGSEYDSAKDVQAALARYREAMDLLCQYVIDQGSGLRFAIEPKPNEPRGDILLPTVGHALAFIDTLARPEMVGVNPETGHEQMSGLNFMHGIAQALYSGKLFHIDLNGQRGIKFDQDLVFGHGDLANAFALVDLLEHGGPDGTPAYEGPRHFDYKPSRTEDIDGVWASAAANMRMYLLLKQRAEAFRADPAVREAMAAAKVAELRQPTLAPGETYHDLLADRSAFEEFDSEAYFGGKGCGFVALQQLAIEHLMGAR

SEQ ID NO: 80 - DNA, 1224 bp, Mycobacterium smegmatis
atgaccgtgttggagtcgaacgtctccacaaccgaaccgctcaccccgaagcgagaggaccgtttctcgttcggcctctggaccatcggctggaacggaaacgatccgttcggcgtcgccacccgcccggcgctcgacgtcgtggaggccgtcgagaaactggccgaactcggcgcgtacgggctgacgttccacgatgacgacctgttcgcgttcggcagttccgacaccgagcggcggcggatggtcgaccggttgacgtcggcgttgtcggccaacggcatggtggtcccgatggtgacgaccaacctgttcacccagcccgtcttcaaggacggcggtttcaccagcaacgaccgcacggtgcggcgtttcgcgctgcgcaaggtgctgcgcaacatcgatttggccatcgaactcggcgccgagaccttcgtgttgtggggcggccgtgagggcagcgaatacgactcggccaaggacgtgcaggccgcgctggcgcgctaccgcgaagcgatggatctgttgtgccagtacgtgatcgaccagggcagcgggttgcgcttcgcgatcgaacccaaacccaacgagccgcgcggcgacatcctgctgcccacggtggggcacgcgctggcattcatcgacaccctggcccgcccggagatggtcggggtgaaccccgagaccggccacgagcagatgtccggcctgaacttcatgcacggcatcgcacaggccctgtacagcggcaagctcttccacatcgacctcaacggtcagcggggcatcaagttcgaccaggacctcgtgttcgggcacggcgacctggccaatgccttcgcgctcgtggatctgctcgaacacggtggtcccgacggcaccccggcgtacgagggtcctcggcacttcgactacaagcccagccgcaccgaggacatcgacggtgtgtgggcctcggcggccgcgaacatgcggatgtacctgctgctcaagcagcgcgccgaggcgttccgcgccgatcccgcggtgcgtgaggcgatggcggcggccaaggtggccgaattgcggcagccgacgctcgcgccgggcgagacgtaccacgacctgttggccgaccgctcggccttcgaggagttcgacagtgaggcctatttcggcggcaagggttgcggtttcgtcgcattgcagcagttggccatcgaacacctgatgggcgcgcgatga

SEQ ID NO: 81 - protein, 437 aa, Piromyces sp. E2
MAKEYFPQIQKIKFEGKDSKNPLAFHYYDAEKEVMGKKMKDWLRFAMAWWHTLCAEGADQFGGGTKSFPWNEGTDAIEIAKQKVDAGFEIMQKLGIPYYCFHDVDLVSEGNSIEEYESNLKAVVAYLKEKQKETGIKLLWSTANVFGHKRYMNGASTNPDFDVVARAIVQIKNAIDAGIELGAENYVFWGGREGYMSLLNTDQKREKEHMATMLTMARDYARSKGFKGTFLIEPKPMEPTKHQYDVDTETAIGFLKAHNLDKDFKVNIEVNHATLAGHTFEHELACAVDAGMLGSIDANRGDYQNGWDTDQFPIDQYELVQAWMEIIRGGGFVTGGTNFDAKTRRNSTDLEDIIIAHVSGMDAMARALENAAKLLQESPYTKMKKERYASFDSGIGKDFEDGKLTLEQVYEYGKKNGEPKQTSGKQELYEAIVAMYQ

SEQ ID NO: 82 - DNA, 1314 bp, Piromyces sp. E2
atggctaaggaatatttcccacaaattcaaaagattaagttcgaaggtaaggattctaagaatccattagccttccactactacgatgctgaaaaggaagtcatgggtaagaaaatgaaggattggttacgtttcgccatggcctggtggcacactctttgcgccgaaggtgctgaccaattcggtggaggtacaaagtctttcccatggaacgaaggtactgatgctattgaaattgccaagcaaaaggttgatgctggtttcgaaatcatgcaaaagcttggtattccatactactgtttccacgatgttgatcttgtttccgaaggtaactctattgaagaatacgaatccaaccttaaggctgtcgttgcttacctcaaggaaaagcaaaaggaaaccggtattaagcttctctggagtactgctaacgtcttcggtcacaagcgttacatgaacggtgcctccactaacccagactttgatgttgtcgcccgtgctattgttcaaattaagaacgccatagacgccggtattgaacttggtgctgaaaactacgtcttctggggtggtcgtgaaggttacatgagtctccttaacactgaccaaaagcgtgaaaaggaacacatggccactatgcttaccatggctcgtgactacgctcgttccaagggattcaagggtactttcctcattgaaccaaagccaatggaaccaaccaagcaccaatacgatgttgacactgaaaccgctattggtttccttaaggcccacaacttagacaaggacttcaaggtcaacattgaagttaaccacgctactcttgctggtcacactttcgaacacgaacttgcctgtgctgttgatgctggtatgctcggttccattgatgctaaccgtggtgactaccaaaacggttgggatactgatcaattcccaattgatcaatacgaactcgtccaagcttggatggaaatcatccgtggtggtggtttcgttactggtggtaccaacttcgatgccaagactcgtcgtaactctactgacctcgaagacatcatcattgcccacgtttctggtatggatgctatggctcgtgctcttgaaaacgctgccaagctcctccaagaatctccatacaccaagatgaagaaggaacgttacgcttccttcgacagtggtattggtaaggactttgaagatggtaagctcaccctcgaacaagtttacgaatacggtaagaagaacggtgaaccaaagcaaacttctggtaagcaagaactctacgaagctattgttgccatgtaccaataa

SEQ ID NO: 83 - protein, 219 aa, Escherichia coli
MTQDELKKAVGWAALQYVQPGTIVGVGTGSTAAHFIDALGTMKGQIEGAVSSSDASTEKLKSLGIHVFDLNEVDSLGIYVDGADEINGHMQMIKGGGAALTREKIIASVAEKFICIADASKQVDILGKFPLPVEVIPMARSAVARQLVKLGGRPEYRQGVVTDNGNVILDVHGMEILDPIAMENAINAIPGVVTVGLFANRGADVALIGTPDGVKTIVK

SEQ ID NO: 84 - protein, 219 aa, Enterobacter cloacae
MTQDELKKAVGWAALQYVQPGTIVGVGTGSTAAHFIDALGTMKGQIEGAVSSSDASTEKLKSLGITVFDLNEVDRLGIYVDGADEINGHMQMIKGGGAALTREKIIASVADKFICIADASKQVDILGNFPLPVEVIPMARSAVARQLVKLGGRPEYRQGVVTDNGNVILDVHGLEILDAIALENAINAIPGVVTVGLFANRGADVALIGTADGVKTIVK

SEQ ID NO: 85 - protein, 218 aa, Vibrio vulnificus
MTQDEMKKAAGWAALKYVEKGSIVGVGTGSTVNHFIDALGTMSEEIKGAVSSSVASTEKLEALGIKIFDCNEVASLDIYVDGADEINADREMIKGGGAALTREKIVAAIADKFICIVDGTKAVDVLGTFPLPVEVIPMARSYVARQLVKLGGDPCYREGVITDNGNVILDVYGMKITNPKQLEDQINAIPGVVTVGLFAHRGADVVITGTPEGAKIEE

SEQ ID NO: 86 - protein, 227 aa, Thermus thermophilus
MERPLESYKKEAAHAAIAYVQDGMVVGLGTGSTARYAVLELARRLREGELKGVVGVPTSRATEELAKREGIPLVDLPPEGVDLAIDGADEIAPGLALIKGMGGALLREKIVERVAKEFIVIADHTKKVPVLGRGPVPVEIVPFGYRATLKAIADLGGEPELRMDGDEFYFTDGGHLIADCRFGPIGDPLGLHRALLEIPGVVETGLFVGMATRALVAGPFGVEELLP

SEQ ID NO: 87 - protein, 269 aa, Chlamydomonas reinhardtii
MMLKASPAARAAARPAARNVRMMAAPVSTQLSQDELKKQAAWKAVEYVKSGMVVGLGTGSTAAFAVDRIGQLLKEGKLQNIVGVPTSIRTYEQALSLGIPLATLDEQPKLDVAIDGADEVDPNLDVVKGRGGALLREKMVEMASAKFVCIVDDSKLVEGLGGSKLAMPVEIVQFCHKYTLQRLANLPEVKGCEAKLRMNGDKPYVTDNSNYIVDLYFQTPIKDSQAASKAILGLDGVVDHGLFLDMVDVCIIAGATGVTVQERPNPKKH

SEQ ID NO: 88 - protein, 289 aa, Spinacia oleracea
MASAAFSLLPSTSSTTFNRHATTKLLNLKFLHNHRNKPFFTTTIKSLSSPSPTPVLTQDDLKKLAAEKAVDSVKSGMVLGLGTGSTAAFAVSRIGELLSAGKLTNIVGIPTSKRTAEQAASLGIPLSVLDDHPRIDLAIDGADEVDPDLNLVKGRGGALLREKMVEAASDKFIVVVDDTKLVDGLGGSRLAMPVEVVQFCWKYNLKRLQEIFKELGCEAKLRMEGDSSPYVTDNSNYIVDLYFPTSIKDAEAAGREISALEGVVEHGLFLGMASEVIIAGKTGVSVKTK

SEQ ID NO: 89 - protein, 265 aa, Arabidopsis thaliana
MALAYDPLFITSDKSLSAFDVASSPPQPMNLTQDELKRIAAYKAVEFVESGMVLGLGTGSTAKHAVDRIGELLRQGKLENIVGIPTSKKTQEQALSLGIPLSDLDAHPVIDLSIDGADEVDPFLNLVKGRGGSLLREKMIEGASKKFVVIVDDSKMVKHIGGSKLALPVEIVPFCWKFTAEKLRSLLEGYGCEANLRLGEKGKAFVTDNGNYIVDMHVEEDMGDLGAVSDAILRLPGVVEHGMFLDMASTVIIAGELGVKIKNKH

SEQ ID NO: 90 - protein, 267 aa, Arabidopsis thaliana
MGSAFDPLVTATEDLAAVNSAPPLSNLTQEELKKIAAYKAVEFVESGMVIGLGTGSTAKHAVARISELLREGKLKDIIGIPTSTTTHEQAVSLGIPLSDLDSHPVVDLSIDGADEVDPALNLVKGRGGSLLREKMIEGASKKFVVIVDESKLVKYIGGSGLAVPVEVVPFCCDFTRGKLEELFRDSGCVAKLRMKIGSNGEEAAPAVTDNRNYVVDLYLERDIGDLEVASEAILRFPGVVEHGMFLGMATTLIVAGKFGVTVKDRFG

SEQ ID NO: 91 - protein, 236 aa, Plasmodium falciparum
MDSLKKIVAYKAVDEYVQSNMTIGLGTGSTVFYVLERIDNLLKSGKLKDVVCIPTSIDTELKARKLGIPLTTLEKHSNIDITIDGTDEIDLNLNLIKGRGGALVREKLVASSSSLFIIIGDESKLCTNGLGMTGAVPIEILTFGYEKIIENLLKIYTLKGCTYKIRKRNGEIFITDNKNYIVDFFFTEPIQDLLETCTRIKMTTGVVDHGIFVNMTNVALISKHDGTVLTLNKKYE

SEQ ID NO: 92 - protein, 229 aa, Pyrococcus horikoshii
MNVEEMKKIAAKEALKFIEDDMVIGLGTGSTTAYFIKLLGEKLKRGEISDIVGVPTSYQAKLLAIEHDIPIASLDQVDAIDVAVDGADEVDPNLNLIKGRGAALTMEKIIEYRAGTFIVLVDERKLVDYLCQKMPVPIEVIPQAWKAIIEELSIFNAKAELRMGVNKDGPVITDNGNFIIDAKFPRIDDPLDMEIELNTIPGVIENGIFADIADIVIVGTREGVKKLER

SEQ ID NO: 93 - protein, 226 aa, Methanocaldococcus jannaschii DSM 2661
MSNEDLKLKVAKEAVKLVKDGMVIGLGTGSTAALFIRELGNRIREEELTVFGIPTSFEAKMLAMQYEIPLVTLDEYDVDIAFDGADEVEETTLFLIKGGGGCHTQEKIVDYNANEFVVLVDESKLVKKLGEKFPIPVEVIPSAYRVVIRALSEMGGEAVIRLGDRKRGPVITDNGNMIIDVFMNIDDAIELEKEINNIPGVVENGIFTKVDKVLVGTKKGVKTLKK

SEQ ID NO: 94 - protein, 229 aa, Fibrobacter succinogenes
MASMDELKKAAGVRAADMIKDGMIVGLGTGSTAAHMVNRLAERIKTEGIHVTGVSTSWSTTLQCRSLGIPLKEMGEVSHLDMVIDGADEIDPNRNLIKGRGAAHLLEKIVASMTDNYVIIADSGKAVQQLGTKFAVPLEIIPGAIAVVTERVKKLGGEVKVRMGAPGKDGPVISDSGNLIADAKFAPIADPDKLARDLEHIVGIVGHGLFINMATKVILADEAKGLIEF

SEQ ID NO: 95 - protein, 272 aa, Homo sapiens
MQRPGPFSTLYGRVLAPLPGRAGGAASGGGGNSWDLPGSHVRLPGRAQSGTRGGAGNTSTSCGDSNSICPAPSTMSKAEEAKKLAGRAAVENHVRARQLILQYGLTLSDLDRHPEIDLAIDGADEVDADLNLIKGGGGCLTQEKIVAGYASRFIVIADFRKDSKNLGDQWHKGIPIEVIPMAYVPVSRAVSQKFGGVVELRMAVNKAGPVVTDNGNFILDWKFDRVHKWSEVNTAIKMIPGVVDTGLFINMAERVYFGMQDGSVNMREKPFC

SEQ ID NO: 96 - protein, 251 aa, Caenorhabditis elegans
MVTSTGPEAELAPIEQAKKRAAFACGEKYVQSGCRLGVGSGSTVKYLVEYLKQGFQNGSLKDIICVPTSFLTKQWLIESGLPVSDLDSHPELDVCIDGADEVDGQFTCIKGGGGCLAQEKIVQTAAKNFYVIADYLKDSKHLGDRYPNVPIEVLPLAAQPLLRSIPRAEGGSCQLRQAVKKCGPIVTDNGNFIIDWQFEKNVSGRDWFAIQQRLANTPGIVETGLFIGCVDAVFFAYSDGSVKEIVNSKKH

SEQ ID NO: 97 - protein, 258 aa, Saccharomyces cerevisiae
MAAGVPKIDALESLGNPLEDAKRAAAYRAVDENLKFDDHKIIGIGSGSTVVYVAERIGQYLHDPKFYEVASKFICIPTGFQSRNLILDNKLQLGSIEQYPRIDIAFDGADEVDENLQLIKGGGACLFQEKLVSTSAKTFIVVADSRKKSPKHLGKNWRQGVPIEIVPSSYVRVKNDLLEQLHAEKVDIRQGGSAKAGPVVTDNNNFIIDADFGEISDPRKLHREIKLLVGVVETGLFIDNASKAYFGNSDGSVEVTEK

SEQ ID NO: 98 - protein, 237 aa, Chromohalobacter salexigens DSM 3043
MGTALRFTRQDGHDMTQDELKRAVAAAAIEEITPLLGRDTIIGVGTGSTANFFVDLLAEHKHDFLGAVASSEATAKRLRDHGIDVYELNHVGTVPVYVDGADEIDAHFNMIKGGGAALTREKIVAACAERFVCIADASKRVDVLGGFPLPIEVIPMARSYVAREMVKLGITPVYRDGVVTDNGNQILDGYECLFEDPRAMEQRLNNIVGVVTNGLFAQRGADVLLLGTEHGVERHTP

SEQ ID NO: 99 - protein, 260 aa, Citreicella sp. SE45
MTGELSPIDKAKFVAAKRAAEFVEDGMRVGLGTGSTAAWLVRCLGEKVREEGLRFRGVPTSTRTAELAREVGIEVITLEEARWLDLTIDGADEFDGELSLIKGGGGALLQEKIVATASDQMVVIADAAKEVGTLGAFPLPVEVIPFGWTASQALIEEALVSMDVMGRQITLRMDGDAAYRTDESNFILDLHLTRIGNPRQLALILNQIPGVVENGLFIDICDQVVIGYGDGRVEVRDINAGTTSEEQIALAENDNLFRDI

SEQ ID NO: 100 - protein, 260 aa, Roseovarius sp. HTCC2601
MSGELSPIDKAKFVAAKRAAEFVQSGMRVGLGTGSTAAWLVRCLGEKVREEGLRFRGVPTSTRTAELAREVGIEVISLDEAGWLDLTIDGADEFDSELNLIKGGGGALLQEKIVATASDEMIVIADAAKHVETLGAFPLPVEVIPFGWTASQALLEEALVTMDVLGRKTTLRMNGERPYITDEGNYILDLHLSRIGNARQLAMLVNQIPGVVENGLFIDICDRVIIGYGDGRVETRDINAGTVSEERVEFVEDDNLFRDI

SEQ ID NO: 101 - protein, 260 aa, Sagittula stellata
MSGELSPIDKAKFVAAKRAAEFVESGMRVGLGTGSTAAWLVRCLGELVREEGLRFKGVPTSTRTAELARDVGIEVISLDEAKWLDLTIDGADEFDEELSLIKGGGGALLQEKIVATASDQMVVIADAAKEVGHLGAFPLPVEVIPFGWQTSLALIEEMLISMDVMGRKATLRMNGDRPYITDEANHILDLHLTRIGNPRQLSMVLNQIPGVVENGLFIDICDKVVIGHGDGRVEVRDINEGTVTETQLDFVEDDNLFRDI

SEQ ID NO: 102 - protein, 262 aa, Roseobacter sp. MED193
MTGELSPIDKAKFVAAKQASGLVEDGMRVGLGTGSTAAWLVRCLGEMVREEGLKFTAVPTSTRTAELAREVGIPVTSLDEAKWLDLTIDGADEFDRDLNLIKGGGGALLQEKIVATASDQMVVIADAGKEVENLGAFPLPVEIIPFGWQTSQALIEETLVSMDVLGRSATLRMNGDRAFMTDEGNHILDLHLNRIGNARQLALVINQIPGVVENGLFIDICDTVIIGYGDGNVEVRDINEGTVEREKLDFVESDNLFSDLSD

SEQ ID NO: 103 - protein, 262 aa, Roseobacter sp. SK209-2-6
MSGELSPIDKAKFVAAKQAAGLVESGMRVGLGTGSTAAWLVRCLGEMVREEGLRFTAIPTSTRTAELARELGIKVTSLDEAKWLDLTIDGADEFDKDLNLIKGGGGALLQEKIVATASDQMVVIADAGKEVECLGAFPLPLEVIPFGWQTSQALLEESLISMDVLGRNATLRMNGDAPFVTDEGNYILDLHLKRIGNARQLSLVVNQIPGVVENGLFIDICDTVIIGYGDGNVETRDINEGTIEREKLDFVESDNLFTDLSD

SEQ ID NO: 104 - protein, 262 aa, Phaeobacter gallaeciensis 2.10
MTGELSPIDKAKFVAAKRAAEMVEDGMRVGLGTGSTAAWLVRCLGDMVQNDGLRIKGVPTSTRTAELARDVGIEILTLDEAKWLDLTIDGADEFDRDLNLIKGGGGALLQEKIVATASDRMVVIADKAKEVESLGAFPLPVEVIPFGWQTTQALLEETLVAMEVMGRKTTLRMNGDAALVTDEGNHILDLHLNRIGNVRQMALVLNQIPGVVENGLFIDICDTVVVGYGDGKVEVRDINEGTVETDRLDFVESENLFTDLSD

SEQ ID NO: 105 - protein, 262 aa, Phaeobacter gallaeciensis BS107
MTGELSPIDKAKFVAAKRAAEMVEDGMRVGLGTGSTAAWLVRCLGDMVQNDGLRIKGVPTSTRTAELARDVGIETLTLDEAKWLDLTIDGADEFDRDLNLIKGGGGALLQEKIVATASDRMVVIADKAKEVESLGAFPLPVEVIPFGWQTTQALLEETLVAMEVMGRKTTLRMNGDAALVTDEGNHILDLHLNRIGNVRQMALVLNQIPGVVENGLFIDICDTVVVGYGDGKVEVRDINEGTVETDRLDFVESENLFTDLSD

SEQ ID NO: 106 - protein, 262 aa, Ruegeria sp. R11
MTGELSPIDKAKFVAAKRAAEMVEDGMRVGLGTGSTAAWLVRCLGEMVRSEGLRIKGVPTSTRTAELAREVGIDIISLDEAKWLDLTIDGADEFDGDLNLIKGGGGALLQEKIVATASDRMVVIADKAKEVETLGAFPLPVEVIPFGWQTTQALVEETLVAMNVMGRKTTLRMNGDAAFVTDEGNHILDLHLNRIGNARQLALVMNQIPGVVENGLFIDICDTVVVGYGDGKVEVRDINEGTIETDRLEFMESDNLFADLGD

SEQ ID NO: 107 - protein, 262 aa, Ruegeria sp. TM1040
MSGDLSPIDKAKFVAAKRAAELVEDGMRVGLGTGSTAAWLVRCLGEMVREDGLKITGVPTSARTAELAREVGIELITLDEARWLDLTIDGADEFDSELNLIKGGGGALLQEKIVATASDQMVVIADKAKEVETLGAFPLPIEVIPFGWQTSQALVEETLISMDVMGRSSTLRMNGASPYVTDEGNHILDLHLNRIGNPRQLALVLNQIPGVVENGLFIDICDTVVIGYGDGKVEVRDINEGTIETDRIDFVETDNLFADLND

SEQ ID NO: 108 - protein, 262 aa, Silicibacter sp. TrichCH4B
MSGELSPIDKAKFVAAKRAAELVEDGMRVGLGTGSTAAWLVRCLGEMVREDGLKITGVPTSARTAELAREVGIEVITLDEARWLDLTIDGADEFDGDLNLIKGGGGALLQEKIVATASDQMVVIADKAKEVEMLGAFPLPIEVIPFGWQTSQALVEETLISMDVMGRSSTLRMNGASPYVTDEGNHILDLHLNRIGNPRQLALVLNQIPGVVENGLFIDICDTVVIGYGDGKVEVRDINEGTIETDRIDFVETDNLFADLGE

SEQ ID NO: 109 - protein, 262 aa, Ruegeria pomeroyi DSS-3
MTGELSPIDKAKFVAAKRAADLVEDGMRVGLGTGSTAAWLVRCLGDMVRKEGLKMRGVPTSTRTAQLAREVGIEVITLDEARWLDITIDGADEFDGDLNLIKGGGGALLQEKIVATASDQMVVIADLGKEVSRLGAFPLPVEVIPFGWQTTQALLEETLISMDVLGRTATLRMNGDTPFVTDEGNHILDLHLQRIGNARQLALVLNQIPGVVENGLFIDICDTVVVGHGDGRVEIRDINQGTVEHDRLDFVESDNLFTDLAD

SEQ ID NO: 110 - protein, 262 aa, Rhodobacterales bacterium Y4I
MTGELSPIDKAKFVAAKRAAEMVEDGMRVGLGTGSTAAWLVRCLGEMVEKDGLKITAVPTSSRTAALARDVGINVVSLDEAKWLDMTIDGADEFDADLNLIKGGGGAHLQEKIVATASDQMVVIADASKSVETLGAFPLPVEVLRFGWQSSQALIEETLVSMDVMGRSTTLRMNGDVPFVTDEGNYILDLHLHRIGNARQLALVLNQIPGVIENGLFIDICDTVVIGYGDGRVEVRDINEGTVEKDKLEFVDTDNLFTDLHD

SEQ ID NO: 111 - protein, 262 aa, Roseobacter sp. GAI101
MSGELSPIDKAKFVAAKRAAQFVEDGMRVGLGTGSTAAWLVRCLGEMVRDDGLRIKGVPTSTRTAQLAREVGIEVISLDEAKWLDLTIDGADEFDGELNLIKGGGGALLQEKIVATASDQMVVIADIGKEVETLGAFPLPIEVIPFGWQTTQALVEETLISMDVLGRTSTLRMNGDIPFITDEGNYIMDLHLNRIGNARQLSLVMNQMPGVVENGLFIDICDAVVIGFGDGRVEVRDINAGTVDRDRLDFVETDNLFTDLSD

SEQ ID NO: 112 - protein, 262 aa, Sulfitobacter sp. EE-36
MTGELSPIDKAKFVAAKRAAQFVEDGMRVGLGTGSTAAWLVRCLGEMVRDDGLRIKGVPTSTRTAQLAREVGIEVISLDEAKWLDLTIDGADEFDGELNLIKGGGGALLQEKIVATASDQMVVIADIGKEVETLGAFPLPVEVIPFGWQTTQALVEETLVSMDVLGRNSTLRMNGDIPFVTDEGNYILDLHLKRIGNTRQMALVMNQMPGVVENGLFIDICDAVVIGYGDGRVEVRDINEGTVDRDKMEFVETDNLFSDLSD

SEQ ID NO: 113 - protein, 262 aa, Oceanibulbus indolifex HEL-45
MSGELSPIDKAKFVAAKRACDFVEDGMRVGLGTGSTAAWLVRCLGEMVRDDGLRIKGVPTSSRTAQLARDVGIEVISLDEAKWLDLTIDGADEFDGDLNLIKGGGGALLQEKIVATASDQMVVIADIGKEVQHLGAFPLPIEVIPFGWQTTQALVEETLISMDVLGRNSTLRMNGEVPFITDEGNYILDLRLNRIGNARQLALVLNQMPGVVENGLFIDICDAVVIGYGDGRVEVRDINEGTVATDRLEFVETDNLFSDLSD

SEQ ID NO: 114 - protein, 262 aa, Oceanicola batsensis HTCC2597
MSGELSPIDKAKFVAAKRSVDFVEDGMRVGLGTGSTAAWMVRCLGELVREDGLRIKGVPTSTRTAQLAREVGIEVISLDEAKWLDLTIDGADEFDSSLNLIKGGGGALLQEKIVATASDQMIVIADIGKQVDALGAFPLPIEVIPFGWQTTQALVEETLISMDVLGRNSTLRMNGQRPFVTDEGNYILDLHLNRIGDARQLAMVLNQMPGVVENGLFIDICDCVIVGFGDGRVEVRDINAGTVEESRLDFLEDDNLFSDLSD

SEQ ID NO: 115 - protein, 262 aa, Thalassiobium sp. R2A62
MTGELSPIDKAKFVAAKKACDYVESGMRVGLGSGSTAAWLVKCLGELVREDGLKIKGVPTSTRTAALAREVGIEVISLDEAKWLDVTIDGADEYDANLNLIKGGGGSLLQEKIVATASDQMVVIADIGKQVETLGAFPLPIEVIPFGWQTTKALVEESLISMDVLGRNSTLRLNGDTPFVTDEGNFILDLHLNRIANGRQLSLVLNQMPGVVENGLFIDICDAVVIGYGDGKVEVRDINAGTVEETRLDFVENDNLFMDLTD

SEQ ID NO: 116 - protein, 268 aa, Roseovarius sp. 217
MLGVAAMTGELSPIDKAKFVAAKRSVDFVEDGMRVGLGTGSTAAWMVRCLGEMVREGGLRIRGVPTSTRTAELAREVGIEVISLDEAKWLDLTIDGADEFDSNLNLIKGGGGALLQEKIVATASDQMIVIADVGKEVETLGAFPLPVEVIPFGWQTTKSLVEELLINMDVLGRNTSLRMNGARPFITDEGNYILDLHLGRIGAAHQLSMALNQMPGVVENGLFLDICDVVILGYGDGRVETRDINEGTVEEDRLDFVETDNLFRDLTD

SEQ ID NO: 117 - protein, 262 aa, Roseovarius sp. TM1035
MTGELSPIDKAKFVAAKRSVDFVEDGMRVGLGTGSTAAWMVRCLGELVREGGLRIRGVPTSTRTAELAREVGIEVISLDEAKWLDLTIDGADEFDSNLNLIKGGGGALLQEKIVATASDQMIVIADVGKEVETLGAFPLPVEVIPFGWQTTKSLVEELLINMDVLGRDATLRMNGARPFITDEGNYILDLHLGRIGAAHQLSMALNQMPGVVENGLFLDICDVVILGYGDGRVETRDINEGTVEEDRLDFVETDNLFRDLTD

SEQ ID NO: 118 - protein, 262 aa, Roseobacter sp. AzwK-3b
MTGELSPIDKAKFVAAKRSVDYVEDGMRVGLGTGSTAAWMVRCLGELVREDGLKIKGVPTSTRTADLAREVGIEVISLDEARWLDLTIDGADEFDASLNLIKGGGGALLQEKIVATASDQMIVIADVGKEVETLGAFPLPIEVIPFGWETTKSLVEEMLISMDVLGRDATLRMNGDRPFVTDEGNYILDLHLGRIGKPNQLAMVLNQMPGVVENGLFIDICDIVIVGYGDGRVETRDINEGTVAEDRLDFLESDNLFSDLQD

SEQ ID NO: 119 - protein, 262 aa, Roseovarius nubinhibens ISM
MSGELSPIDQAKFVAAKKAVEYVEDGMRVGLGTGSTAAWMVRCLGEMVREDGLRIKGVPTSTRTAALAQELGIDVVSLDEAKWLDLTIDGADEFDGELNLIKGGGGALLQEKIVATASDQMIVIADVGKEVESLGHFPLPIEVIPFGWQTTRALVEEMLVSMDVLGRDVTLRMSGDRPYVTDEGNHILDLHLGRIGNPRQLSMVLNQVPGVVENGLFIDICDIVCVGYGDGRVEVRDINDGTVRQDRLDFVESDNLFSDLSD

SEQ ID NO: 120 - protein, 262 aa, Octadecabacter antarcticus 238
MSFELSPIDKAKFVAAKQATQYVQDGMKVGLGTGSTAAWLVKCLGEMVEKEGLKIKGVPTSTRTAELARDVGIEVISLDEAKWLDLTIDGTDEYDGNLNLIKGGGGALLQEKIVATASDQMIVIADASKHVETLGHFPLPIEVIPFGWQTTKTLVEETLIGLDVLGRQVSLRMNGDAPYYTDEGNHILDLHLNRIGNARQFSLVINQIPGVVENGLFIDICDIVVIGYGDGRVEVRDINAGSVEESRIDFVEADNLFADLND

SEQ ID NO: 121 - protein, 262 aa, Octadecabacter antarcticus 307
MSFELSPIDKAKFVAAKQATQYVQDGMKVGLGTGSTAAWLVKCLGEMVEKDGLKIKGVPTSTRTAELARDVGIDVISLDEAKWLDLTIDGTDEYDGNLNLIKGGGGALLQEKIVATASDQMIVIADASKQVETLGHFPLPIEVIPFGWQTTKTLVEETLISMDVLGRQVSLRMNGDAPYYTDEGNHILDLHLNRIGNSRQFSLVINQIPGVVENGLFIDICDIVVIGYGDGRVKVRDINAGSVEESRIEFVETDNLFADLND

SEQ ID NO: 122 - protein, 262 aa, Oceanicola granulosus HTCC2516
MSADLSPIDKAKFAAARRATDYVEDGMRVGLGTGSTAAWLVKCLGEMVREDGLRLTGVPTSSRTAALAREVGIKVVSLDEARWLDLTIDGADEYDSNLNLIKGGGGALLQEKIVATASDQMVVIADISKQVDTLGAFPLPVEVIPFGWQTTKVLIEETLIGLDVLGRDTSLRLNGERPYVTDEGNYILDLHLNRIGNARQLSLVLNQIPGVVENGLFIDVCDAVVIGYGDGRVEVRDINEGTVEESRIDFLETENLFTDLAD

SEQ ID NO: 123 - protein, 262 aa, Roseobacter litoralis
MSSELSPIDKAKFVCAKRAAQFVENGMRVGLGTGSTAAWLVRCLGERVRDEGLHITGVPTSTRTAELAREVGIDVITLDAAKRLDLTIDGADEFDGAFNLIKGGGGALLHEKVVATSSDRMIVIADVGKEVETLGAFPLPIEVIPFGLQTTHALVDETLVSMDVLGRDSSLRMDGDKPFVTDEGNHIIDLHLKRIGDARQLAMTLNQLPGVVENGLFIDICDTVVLGFGDGKVEVRDINDGTVASERMVFAESDNLFSDLSD

SEQ ID NO: 124 - protein, 262 aa, Roseobacter denitrificans
MSSELSPIDKAKFVCAKRAAQLVESGMRVGLGTGSTAAWLVRCLGQRVRNEGLQITGVPTSTRTAELAREVGIDIITLDAAKRLDLTIDGADEFDGAFNLIKGGGGALLHEKVVAASSDRMVVIADVGKEVETLGAFPLPIEVIPFGLQTTHALVDETLVSMDVLGRDSSLRMDGDKPFVTDEGNHIIDLHLKRIGDARQLALTLNQVPGVVENGLFIDICDTVVLGFGDGKVEVRDINDGTIASERMIFAETDNLFSDLSD

SEQ ID NO: 125 - protein, 261 aa, Silicibacter lacuscaerulensis
MTQKLSPIDTAKRVAAYRAAEMVEDGMRVGLGTGSTAAWLVRRLGERVKNEGLKIRGVPTSTATAQLAREVGIEVVSLDQAGWLDLTIDGADEFDGELNLIKGGGAALLQEKIVATASDLMVVIADAGKEVETLGAFPLPIEVIPFGWQTTRTLVEELLDSMDVLGTSATLRMNGEAPTVTDEGNHILDLHLQRIGNPRQLALALNQIPGVVENGLFIDICDKVVIGFGDGRVELRDINEGTIQLDRLGEGDDNLFSDLAD

SEQ ID NO: 126 - protein, 260 aa, Rhodobacterales bacterium HTCC2654
MSSNLSPIDTAKFVAAKRAVDFVEDGMRVGLGTGSTAAWMVRCLGERVREEGLRIAGVPTSTRTAELARQVGIRVISLDEARWLDLTIDGADEFDMDLNLIKGGGGAHLQEKIVATASDQMIVITDPSKQVEHLGSFPLPVEVIPFGWQTSKALIEETLASLEVLGQTSALRMNGEAPFVTDEGNHIIDLYLQRIGNPRQLSMVLNQIPGVVENGLFIDICDKVVIGHQDGRVEVIDINEGTHDEGLVEFAETENLFSDI

SEQ ID NO: 127 - protein, 262 aa, Rhodobacterales bacterium HTCC2150
MNKALSPVDAAKLAAAQRAVEYVQDGMRIGLGTGSTAAWLVKVLGEMVRDEGLKVMGVPTSTRTAELARAENIPVVTLDEAKWLDLTIDGADEFDGELNLIKGGGGALLQEKIVATASDQMIVIADASKRVDTLGAFPLPIEVIPFGWQASKTLVEEALISLDVMGRDSSLRMNRDKPFLTDEGNFILDLNLRRIGNARQLALVLNQIPGVVENGLFIDICDVVIVGHGNSKVEVYDINNGTMEEETMGQEVNKNLFQDDLD

SEQ ID NO: 128 - protein, 262 aa, Jannaschia sp. CCS1
MTAELSPIDRAKYVAARRAVEYVEDGMRVGLGTGSTAAWMVRCLGELVRDEGMQITGVATSTRTADLARDVGVTVKTLDDVRWLDLTIDGTDEYDPNLNLIKGGGGALLHEKVVATASDQMVVIADPTKQVDTLGAFPLPVEVIPFGWQTTKALIEEMLSNLDVLGRSASLRLSGAEPFRTDEGNLILDLHLRRIAQPAQLSLVLNQIPGVVENGLFLDICDVLVIGNADGTVEVRDINNGTIEHERVDVAETDNLFVEVKE

SEQ ID NO: 129 - protein, 260 aa, Dinoroseobacter shibae DFL 12
MSGEMSPIDRAKYVAAKRAVGFVEDGMRVGLGTGSTAAWMVRHLAETVDQEGMDITCVATSTRTAELARDLKLHVTTLDEVKWLDLTIDGADEFDPTLNLIKGGGGALLQEKIVATASDRMIVITDASKAVATLGAFPLPVEVIRFGWETTRTLIEETLVNVDVGGREAILRMENGMPYVTDEGNFIVDLHLERIGNPRQVSLVLNQLPGVVENGLFLDICDVVVIGKSDGSVELRDINEGSVHQEQVEVTATGNVFSDL

SEQ ID NO: 130 - protein, 262 aa, Roseobacter sp. CCS2
MSSEMSPVEKAKFVAAKQATEFVESGMKVGLGTGSTAEWLVQCLGEMVREEGLKIKGVPTSKRTGLLAKKVGIDVITLEEAKWLDVTIDGTDEYDSDLTLIKGGGGAHLREKVVATASERMIVIADASKKVETLGAFPLPIEVIPFGLPVTQGLIEETLIGMDVLGREVTQRMKGDAPFVTDEGNFILDLHLKRIGNPRQLSLVINQIPGVVENGLFIDICDVVIVGHGDGRVTTRDITNNTANVVRFDVLDDDNIFSDVAD

SEQ ID NO: 131 - protein, 262 aa, Loktanella vestfoldensis SKA53
MTIDLFPMDTAKFVAAKQATHYVQSGMKVGLGTGSTAAWLVQCLGEMVRDHGLQIKGVPTSNRTAELARAAGIEIITLDQAKWLDLTIDGTDEYDANLNLIKGGGGAHLREKIVATASDRMIVIADASKTVATLGAFPLPVEVLPFGMQITRGLIEELLVGVDVLGRDVIQRMQGDAPYVTDEGNFILDLHLKSIGNPRQLAMMLNQIPGVVENGLFIDICDVVIVGHGTGKVEIRDITNDINDVVQFDLQDDDNLFADLAK

SEQ ID NO: 132 - protein, 262 aa, Rhodobacter sphaeroides
MPAELSPIDTAKFAAARRAVDLVQDGMKLGLGTGSTAAWMVRCLAERVREEGLRVQGVPTSTRTAELARALGIQVVTLDEAKWLDLTIDGADEFDADFNLIKGGGAALLQEKIVATASDRMVVIADAAKEVAHLGAFPLPVEVIPFGWQSTKMLIEETLEGMDVLGREVTLRLSGDAPLLTDEKNYILDLHLKRIGEPRQLGLALNQIAGVVENGLFIDICDTVVVGHGDGRVSLRDLQSGQAEEGCIDMDRARNIFADLGD

SEQ ID NO: 133 - protein, 262 aa, Rhodobacter sphaeroides
MPAELSPIDTAKFAAARRAVDLVQDGMKLGLGTGSTAAWMVRCLAERVREEGLRVQGVPTSTRTAELARALGIQVVTLDEAKWLDLTIDGADEFDADFNLIKGGGAALLQEKIVATASDRMVVIADAAKEVAHLGAFPLPVEVIPFGWQSTKMLIEETLEGMDVLGREVTLRLSGDAPLLTDEKNYILDLHLKRIGEPRKLGLALNQIAGVVENGLFIDICDTVVVGHGDGRVSLRDLQSGQAEEGFIDMDRARNIFADLGD

SEQ ID NO: 134 - protein, 262 aa, Rhodobacter sphaeroides
MPAELSPIDTAKFAAARRAVDLVQDGMKLGLGTGSTAAWMVRCLAERVREEGLRVQGVPTSTRTAELARALGIQVVTLDEAKWLDLTIDGADEFDADFNLIKGGGAALLQEKIVATASDRMVVIADAAKEVAHLGAFPLPVEVIPFGWQSTKMLIEETLEGMDVLGREVTLRLSGDAPLLTDEKNYILDLHLKRIGEPRPLALALNQIAGVVENGLFIDICDTVVVGHGDGRVSLRDLQSGQAEEGSIDMDRARNIFADLGD

SEQ ID NO: 135 - protein, 262 aa, Rhodobacter sp. SW2
MPAELSPIDKAKFVAAKRAVEFVETGMKLGLGTGSTAAWMVRCLAERIREEGLRVTGVPTSSRTAELARSLGVPIMSLDEAKWLDLTIDGADEIDPNLNLIKGGGAALLQEKIVATASDQMIVIADAAKEVGCLGAFPLPVEVIPFGWQTTKALLEETLVSMDVLNRDCTLRMNGDRPLLTDEANYIVDLHLKRIGNPRQLALVLNQIPGVVENGLFIDICDIVVIGNGDGRVTVRDINAGSSSDERVEFAASDNIFADLGD

SEQ ID NO: 136 - protein, 250 aa, Rhodobacter sphaeroides
MPAERSPIDTAKFAAARRAVDFVQDGMKLGLGTGSTAAWMVRCLAERVREEGLRVQGVPTSSRTAELARELGIPVVTLDEARWLDLTIDGADEFDSEFNLIKGGGAALLQEKIVATASDRMIVIADAAKEVAQLGAFPLPVEVIPFGWQSTRMLIEEALIGLDVLGREVTLRRSGEAPLLTDEKNYILDLHLTRIGHPRQLALTLNQIAGVVENGLFIDICDTVVVGHGDGRVTVRDLGASRNIFADLGE

SEQ ID NO: 137 - protein, 262 aa, alpha proteobacterium HTCC2255
MTLDLSPSEIGKFTSAYRALDFVESDMKLGLGTGSTAAWLVKLLAYEINNKGLNISACATSSETTKLAESLGIKISNLDELGQLDLAIDGADEFDQNLNLIKGGGAALLQEKIVETAANKLVVITDASKQVDDLGTFDLPVEVVKFGWKTTKRLIENVLIDQDVDCRIVTRRNNHTPVITDENHYILDLKLNRIGNPNALSDALLNIAGVVETGLFLGMTHSIIMGNENGLARVKSTGSLDWVDTSYDIQSLSQFIKNINDI

SEQ ID NO: 138 - protein, 241 aa, Paracoccus denitrificans
MTDPAIADLSKDAAARAAVALVEPGMRLGLGTGSTAAIFVRRLAQRVSEEGFALRCAATSKATAELATSLGLGVEELDEIGWLDLTIDGADEVDPDLNLIKGGGAAHLREKIVATASERMVVIADQGKVVDRLGQFHLPVEVIPFGWQATRKLIQRALDRLDLTQRPILLRKRGDAPLRTDEGNLILDLALEAIPDAEALAAELSSIAGVVEHGLFLNICELAIIGCPDGSVVELRREDMA

SEQ ID NO: 139 - protein, 239 aa, Roseobacter sp.
MFADLSPADQAKYVAAKRAVELVEDGMKLGLGTGSTAAWMVRCLAQRVKAEGLRIQGVPTSTRTADLARELGLEVVTLDQAGHLDITIDGTDEFDSALNLIKGGGGALLQEKIVASASDRMIVIADFDKHVPQLGKFPLPVEVLGFGLASSRDHIARLLADHGLAGCDITTRKQGDAPFVTDEGNFILDLHLAQIPDAPALAIALNQVPGVVENGLFIDICDRVILGASDGRIEEHVRP

SEQ ID NO: 140 - protein, 250 aa, Yersinia pestis
MATPPLCSHDQESRMSNQQNDAKRAAARRVIQDFVFDGMTLGLGSGTTSHFFVRELGQHVAKGLQLTCTTTSRATSEVARDVGIELSDPNEMNEIDLTIDGPDEIDRRFNMIKGGGACLLWEKIIAHASKRMICICDETKIVNCLGQFPLPVEIVPFAWKQTERRVERVLAEQGLHHVPIIRRMGGGHPVITDSGNFILDCHCGAIITAPEPLEIELNRIPGVVENGLFTREATGMVVGYFDGSSYVQLR

SEQ ID NO: 141 - protein, 236 aa, Yersinia pseudotuberculosis
MSNQQNDAKRAAARRVIQDFVFDGMTLGLGSGTTSHFFVRELGQHVAKGLQLTCTTTSRATSEVARDVGIELSDPNEMNEIDLTIDGPDEIDRRFNMIKGGGACLLWEKIIAHASKRMICICDETKIVNCLGQFPLPVEIVPFAWKQTERRVERVLAEQGLHHVPIIRRMGGGHPVITDSGNFILDCHCGAIITAPEPLEIELNRIPGVVENGLFTREATGMVVGYFDGSSYVQLR

SEQ ID NO: 142 - protein, 236 aa, Yersinia pestis
MSNQQNDAKRAAARRVIQDFVFDGMTLGLGSGTTSHFFVRELGQHVAKGLQLTCTTTSRATSEVARDVGIELSDPNEMNEIDLTIDGPDEIDRRFNMIKGGGACLLWEKIIAHASKRMICICDETKIVNCLGQFPLPVEIVPFAWKQTERRVERVLAEQGLHHVPIIRRMGGGHPVITDSGNFILDCHCGAIITAPEPLEIELNRIPGGVENGLFTREATGMVVGYFDGSSYVQLR

SEQ ID NO: 143 - protein, 236 aa, Yersinia pseudotuberculosis
MSNQQNDAKRAAARRVIQDFVFDGMTLGLGSGTTSHFFVRELGQHVAKGLQLTCTTTSRSTSEVARDVGIELSDPNEMNEIDLTIDGPDEIDRRFNMIKGGGACLLWEKIIAHASKRMICICDETKIVNCLGQFPLPVEIVPFAWKQTERRVERVLAEQGLHHVPIIRRMGGGHPVITDSGNFILDCHCGAIITAPEPLEIELNRIPGVVENGLFTREATGMVVGYFDGSSYVQLR

SEQ ID NO: 144 - protein, 236 aa, Yersinia pseudotuberculosis
MSNQQNDAKRAAARRVIQDFVFDGMTLGLGSGTTSHFFVRELGQHVAKGLQLTCTTTSRATSEVARDVGIELSDPNEMNEIDLTIDGPDEIDRRFNMIKGGGACLLWEKIIAHASKRMICICDETKIVNCLGQFPLPVEIVPFAWKQTERRVERVLAEQGLHHVPIIRRMGGGHPVITDSGNFILDCHCGAIITAPEPLEIELNRIPGVVENGLFTCEATGMVVGYFDGSSYVQLR

SEQ ID NO: 145 - protein, 252 aa, Rhodococcus jostii RHA1
MYTTETPQDAAKYAVGRAAVERYAHDGAQLGLGSGTTSAWFVRALGEKVADGLDVVGVPTSTATRDLALSVGITLVDLNDLDRPLDVTLDGPDEVDHDGDMIKGGGACLLWERMVAEASSKMVCIADDTKLVEQLGSFPLPIEVIPFGWKATRRSISALLTDLGYTDVKIIQRHRNGQPVVTDSGNFILDAHMVAITDKALLDTNLNWIAGVVENGLFTGIAHEILIASPDGAAKLIELPHRNAARIPEWRK

SEQ ID NO: 146 - protein, 252 aa, Rhodococcus opacus
MYTTETPQDAAKYAVGRAAVERYAHDGAQLGLGSGTTSAWFVRALGEKVAEGLDIVGVPTSTATRDLALSVGITLIDLNDLDRPLDVTLDGPDEVDHDGDMIKGGGACLLWERMVAEASLKMVCIADDTKLVERLGSFPLPIEVIPFGWKATRRSISALFRDLGYTDIDIVQRQRDGQPVVTDSGNFILDAHMVAITDKALLDTNLNWIAGVVENGLFTGIAHEILIASPDGAAKLIELPHRRAARIPQWRK

SEQ ID NO: 147 - protein, 227 aa, Brevundimonas subvibrioides ATCC 15264
MSDHQKQIAGEAAALRVEAGMVVGLGTGSTAGWFVKALAARSLTGLRCVPTSEKTADLARELGLPLTTLEDVSRIDLTVDGADEVGPGLALIKGGGAALLREKLVWEASDRCIVIADAAKVVPVLGAFPLPIEVVAFGHKATANRIMDVLTDHDITMPARLRQADRGVVRTDGGNVIYDAKCVAIHDPVRLADDLKLITGVVEHGLFLDLADEAIIGRDDGVEVLVP

SEQ ID NO: 148 - protein, 227 aa, Brevundimonas sp. BAL3
MSDLQKKNAGEAAAAHVEAGMIVGLGTGSTAAWFVKALAARGLSGLRCVPTSEKTADLARELGLTLSTLEDTPRIDLTVDGADEVGPGLALIKGGGAALLREKLVWEASSRCIVIADAAKVVPVLGTFPLPIEVVAFGHKTTANRIADVLIDHDINSPARVRQADRGLVRTDGGNLIYDAGCKAIHDPVRLADDLKLITGVVEHGLFLDLADLAIIGTDSGVETLTP

SEQ ID NO: 149 - protein, 228 aa, Caulobacter segnis ATCC 21756
MSSADDQKRASGEAAAQLVENGMVVGLGTGSTAAWFVKALAARKLTNIKGVPTSDATAALARELGIPLVALDDVKTIDLTVDGADEIGPGLSLIKGGGAALLREKLVWEASTRCVAIADAAKRVPALGKFPLPIEVVRFGHVHTGHRLADIAAEFDLPPPRLRTAERGVVVTDGGNLIYDMASGRIDEPAALATALKSVTGVVDHGLFLDLADEALVGTDDGVVRLVP

SEQ ID NO: 150 - protein, 227 aa, Caulobacter crescentus
MSADDQKRISGEAAAELVENGMVVGLGTGSTAAWFVKALAARGLKDIRGVPTSDATAALARELGIPLAALDDVKTVDLTVDGADEIGPGLSLIKGGGAALLREKLVWEASTRCVVIADAAKRVPALGKFPLPIEVVRFGHVHTGYRLADIAAEFDLPPPRLRTAERGMVVTDGGNLIYDMASGKIEDPTALAAALKSVTGVVDHGLFLDLADEALVGTDEGVVRLQP

SEQ ID NO: 151 - protein, 226 aa, Caulobacter sp. K31
MSADDQKRISGEAAAELVEAGMVVGLGTGSTAAWFVKALAARKLDIRGVPTSEATANLARELGIALTALDDVKSIDLTVDGADEIGPGLSLIKGGGAALLREKLVWEASKRCVVIADAAKHVKTLGKFPLPIEVVRFGHVHTGQRLADIAAEFDLLPPRLRMADRGVVVTDGGNVIYDMPSGVIAEPAALAAALKTVTGVVDHGLFLDLADEALLGTDQGVVKLVP

SEQ ID NO: 152 - protein, 228 aa, Phenylobacterium zucineum HLK1
MSDAEAQKKAAGEAAAALVESGMVVGLGTGSTAAWFVRALAARKLDIVGVPTSQATGELAASLGIRIAELGETSQIDLTVDGADEIGPGLSLIKGGGAALLREKLVWEASKRCVVIADAAKQVPTLGKYPLPIEVVTFGHQTTALRICDALAECDVGVAPRLRVRDGQPVRTDEGNLIYDAACGRIEEPAALAAALKSVTGVVDHGLFLDLADRALIGGPGGVTTLEP

SEQ ID NO: 153 - protein, 230 aa, Asticcacaulis excentricus CB 48
MSADTQKQAAGLAAIDHIESGMKVGLGTGSTAAWFVKAVADAVRDGLKLTLVSTSNQTTHLAQSLGLEIKDINDVGKLDVCVDGADEIGSGLALIKGGGGALLREKLIWEMADRCIVIADAAKHVATLGAFALPIEVEPFAYKGTINRICDVLSEFDIAKLPVLRKKGGESFVTDGGNLIFDVPCGAILDPSGLASALKATTGVVDHGLFLDLADVALIGTDSGVDILHP

SEQ ID NO: 154 - protein, 236 aa, Hyphomonas neptunium ATCC 15444
MPDMASDTEKQNAAAAAMDFVEEGMTIGLGTGSTAKFFVEMLADEIADGLIVRCIETSNQTRELARSLGVPLIPFEQVDRIHLTVDGADEVGPGGVLIKGGGAALLREKIIANASDHMVVIADSSKEVPHLGAFPLPVEVTPFGYTITAKKVHDALVASGVERPRIELRKAAGSTDLLVTDGGNHILDCHCGRIPDPAKTGAYLSGVPGVVEHGLFIGIARTVIIGEENGAHIIEY

SEQ ID NO: 155 - protein, 233 aa, Maricaulis maris MCS10
MTALRQKTLAAAAALDYIESGMTLGLGSGSTAEIFLRLLGEKIKDGLDVRGVPTSQRTAQIAAENGVPLIDVDHVNNIAITIDGADEVDGRFQLIKGGGACLLREKIIAHASDLMIVMVDESKLVATLGKFPLPVEVDRFGFSLTASQVYEALRRAGIKSPDVQLRRKGDGLEPLVTDGGNYILDCACEAIPDAGAVDRALKAIPGVVEHGLFINLARVVIVGEDGEARVMEL

SEQ ID NO: 156 - protein, 235 aa, Oceanicaulis alexandrii HTCC2633
MSAVEQKTRAAEAALEFVEDGMTLGLGSGSTADIFVRLLGAALESGSLKNVKGVPTSENTARVAREAGVPLLEVDQADKIDVTIDGADEVDGRFRLIKGGGGCLLREKIIAHASDLMVVVVDETKLVETLGAFALPVEVDPFGFTITAKKVYDALTASGVVRPDVKLRCRGDGNDPYLTDGGNYILDCACTALEDPEQVAARLNAIPGVVEHGLFINLARAVIVGEEDGARVLEL

SEQ ID NO: 157 - protein, 233 aa, Hirschia baltica
MSDIAKRNAAIEALKLVEDGMTLGLGTGSTAAFFVEELGKKVQLGLDVICVSTSEVTEAQARSLNIPMADLDTAPTIHLTIDGADEFDPELRLIKGGGAALLREKIIADSSDMMVVITDASKQVAQLGAFPLPVEVNPFGMALTKARIEETLEILGMYGIHVNVRLNEGGGPLLTDGGHHILDLHCKAIPDPDMLGAVLDQIPGVVEHGLFLDIADAVIIGTETGAETIAREE

SEQ ID NO: 158 - protein, 241 aa, Methylocella silvestris BL2
MTTLSPDEAKRAAAAEAIKLVRPGMKLGLGTGSTARHFVDLLGGLVAAGLDVLCVPTSEETRAQAAALGVALTTIDAEPELDLTVDGADEFDDSLRLVKGGGGALLREKIVATASKTMVVIADVSKHVEIMGKFPLPVEVTRFGLEATRRLIRARAEEAGCAGEIVLRDKGPGQPFITDNGNFILDCHFGALPRPEQLAQDLSAIPGVVEHGLFIGLAKAVICAGPGGIEIFGRLEAQAPP

SEQ ID NO: 159 - protein, 236 aa, Beijerinckia indica
MALLNPDEAKRLAAAKALELVKPGMRLGLGTGTTAAHFVDLLGAKVAEGLDVLCVPTSERTRTQADTYKIPLSTLDATPELDLTIDGADEFDPQLRLIKGGGGAHLREKMVAAASKRMVVITDASKAVQTLGKFPLPIEINVFGAEATRLMIIRAAAACGCQGDVKLRRIPSGGPYVTDNGHYIVDASFGAIPDPEKLSTALLEIPGVIEHGLFIGLAKAVICAGSEGIEIFGQLD

SEQ ID NO: 160 - protein, 241 aa, Hyphomicrobium denitrificans
MSSDDWKRQAAEQALSYVEDGMKLGLGTGSTAAKFVDLLGEKVKGGLKVVCVPTSEATRAQAAALGIPLATLDEHPALDLTVDGADEMDEEMRLIKGGGGALLREKIVAVASDRVVIIADSSKRVDVLGRFPLPIEVVPFGLASTQRLIFQMATDAGCDGEIKLRLGAGGAPFVTDNGNHILDCSFGAIDDPEALDDALKLVPGVVETGLFLGIADVGIVAGPMGVEVLSAIDADFDEENS

SEQ ID NO: 161 - protein, 235 aa, Methylobacterium sp. 4-46
MSAALKRAAAARALDLVADGMRLGLGTGSTAAEFVELLGARVRAGLSVVGVPTSEATHRAAQAAGIPLTTLDETPELDLTIDGADEIDGARRLIKGGGGALLREKIVAAASRRMVVIADAGKRVETLGRFPLPVEVVPFGLAATRRAVEGALGRAGCAGEVALRRAADGAPFVTDGAHLILDAHLGRIPDPEALAAALAAVPGVVEHGLFLGLCSGAILAADEAGEVRLLTLGTL

SEQ ID NO: 162 - protein, 235 aa, Methylobacterium nodulans ORS 2060
MSADLKRAAAARAVDLVQDGMRLGIGTGSTAAQFVELLGARVRSGLSVVGVPTSEATHRAAAAAGIPLTTLDETPELDLTVDGADEIDGSLRLIKGGGGALLREKIVAAASRRMVVIADGSKQVATLGRFPLPIEVVPFGLGATRRAIAAALTRTGCAGELTLRTGRDFAPFRTDGAHLILDAHLGRIPDPDALAAALAAVPGVVEHGLFLGLCTGAILAAEEAGAIRLLTLGAV

SEQ ID NO: 163 - protein, 236 aa, Methylobacterium extorquens
MSAPDLKRAAAERAIPLVEDGMRLGIGTGSTAAAFIKLLGERVRAGLKVTGVPTSEATRIACEREGIPLATLEDLPELDLTIDGADEVDGSLRLIKGGGAALLREKIVAVASRRMVVIADASKHVETLGAFPLPVEVNLFGIGATTRAVEAAVARAGCTGETVRRHDASGAPLLTDGGHAILDLRLGRIPDPEALSAGLWAVPGVVEHGLFLGIADAAILAAAEGDAAVVSVLGRL

SEQ ID NO: 164 - protein, 236 aa, Methylobacterium extorquens
MSAPDLKRAAAERAIPLVEDGMRLGIGTGSTAAAFIKLLGERVRAGLKVTGVPTSEATRIACEREGIPLATLEDLPELDLTIDGADEVDGSLRLIKGGGAALLREKIVAVASHRMVVIADASKHVETLGAFPLPVEVNLFGIGATTRAVEAAVARAGCTGEIVRRHDASGAPLLTDGGHAILDLRLGRIPDPEALSAGLWAVPGVVEHGLFLGIADAAILAAADGDAAVVSVLGRL

SEQ ID NO: 165 - protein, 236 aa, Methylobacterium chloromethanicum CM4
MSAPDLKRAAAERAIPLVEDGMRLGIGTGSTAAAFIKLLGERVRAGLKVTGVPTSEATRIACEREGIPLATLEDLPELDLTIDGADEVDGSLRLIKGGGAALLREKIVAVASRRMVVIADASKHVETLGAFPLPVEVNLFGIGATTRAVEAAVARAGCTGEIVRRHEASGAPLLTDGGHAILDLRLGRIPDPEALSAGLWAVPGVVEHGLFLGIADAAILAAAEGDTAVVSVLGRL

SEQ ID NO: 166 - protein, 236 aa, Methylobacterium extorquens
MSAPDLKRAAAERAIPLVEDGIRLGIGTGSTAAAFIKLLGERVRAGLKVTGVPTSEATRIACEREGIPLATLEDLPELDLTIDGADEVDGSLRLIKGGGAALLREKIVAVASRRMVVIADASKHVETLGAFPLPVEVNLFGIGATTRAVEAAVARAGCTGEIARRHDASGVPLLTDGGHAILDLRLGRIPDPEALSAGLWAVPGVVEHGLFLGIADAAILAAAEGDAAVVSVLGRL

SEQ ID NO: 167 - protein, 236 aa, Methylobacterium populi BJ001
MSAPDLKRAAAERAIPLVEDGMRLGIGTGSTAAAFIALLGERVRAGLTVTGVPTSEATRIACEREGIPLATLEELPELDLTIDGADEVDGNLRLIKGGGAALLREKIVAAASRRMVVIADASKRVETLGAFPLPVEVNLFGIGATTRAVEAAVAAAGCIGEIVRRLDKAGQPVLTDGGHALLDLRLGRIPDPEALSARLWAVPGVVEHGLFLGIADAAILAAAEGDQAVVSVLGRL

SEQ ID NO: 168 - protein, 237 aa, Methylobacterium radiotolerans
MSGPDLRRAAAARALDLVEPGMRLGLGTGSTAAAFVALLGERVRAGLDIVGVPTSEATRAQAESLGIRLATLDEQPELDLTIDGADEVDDRLRLIKGGGAALLREKIVACASRRMVVIADAAKHVARLGAFPLPVEVNPFGLKATHRAVEAAVAGAGCSGDVRLRAQADGKPLVTDGGHYILDARLGAIPDPEALGAALWAVPGVVEHGLFLGIADAAILAAARDGQAEVTVLGSLT

SEQ ID NO: 169 - protein, 232 aa, Rhodopseudomonas palustris
MNKEDLKRQAAARALDEVRDGMKIGLGTGSTAKHFVELLGEKVRAGLDVIGVPTSEVTRADAERCGIRLTTLDEIDRLDLTVDGADEIDPRLELIKGGGGALLREKIVAAASDRMIVIADETKWVDCLGHFPLPVEVIPFGLAATRRAIEQACAEVGASGRLQLREGKDGHAFVTDGGHWIIDAHLGRIPDAPRLAQLLSAIPGVVEHGLFIGIASTVVLAGTDGIRTVERA

SEQ ID NO: 170 - protein, 232 aa, Rhodopseudomonas palustris
MDKEDLKRQAAARALEEVRSGMKLGLGTGSTARHFVELLGEKVRGGLDVIGVPTSEVTRADAERCGIRLTTLDEIDRLDLTVDGADEVDTRLELIKGGGGALLREKIVAAASDRMIVIADESKWVDCLGKFPLPVEVIPFGLAATRRAIEKAFTQVGAAGQLKLRDGEAGHAFVTDGGHWIVDAHLGRIPDAPRLAKLLSEIPGVVEHGLFIGIASTVVLAGTEGIRTVERA

SEQ ID NO: 171 - protein, 232 aa, Rhodopseudomonas palustris
MDKEELKRRAAARALEEVRGGMKLGLGTGSTAKHFVELLGERVRLGLEIIGVPTSEVTRADAERCGIRLTSLDEIDRLDITIDGADEVDHHLDLIKGGGGALLREKIVAAASDRMIVIADESKLVDTLGRFPLPIEVIPFGLGATRRALQNAFTAAGCDGELKLRPGKDGHAFVTDGGHWILDAQLGRIPDAPRLAQLLSVIPGVVEHGLFVGMASTVVLAGADGIRTIERA

SEQ ID NO: 172 - protein, 241 aa, Rhodopseudomonas palustris
MSSDELKRQAAAVALEQVRDGMKLGLGTGSTAKHFVELLGAKVQGGLQVVGVPTSEVTRADAERCGIPLATLDEVDHLDLTVDGADEIDPALNLVKGGGGALLREKIVAAASGRMIVIADDSKLVETLGRFPLPIEVIPFGLAATRRAIEQALAVCGIDGELKLRNGKDGHAFVTDGGHWIVDAHLGRIPDAPRLAGLLSVIPGIVEHGLFIGLASSVVLASPHGIRIIERPACRDSGESK

SEQ ID NO: 173 - protein, 241 aa, Bradyrhizobium japonicum
MNMDQLKRQAAARALEEVRDGMQLGLGTGSTAKHFVELLGERVAAGLKVIGVPTSEATRLDATRCGVPLTTLDEIDHLDITVDGADEIDPELNLIKGGGGALLREKIVAAASDRMIVIADDTKWVPTLGRFPLPIEVIPFGLGATRRAIETAFAQCGVSGQMAVRKAKGGDKDGHVFVTDGGHWILDAQLGRIVDPPSLAKALSAIPGVVEHGLFIGLASSAVLAGGEGIRVIERRKPKGD

SEQ ID NO: 174 - protein, 236 aa, Oligotropha carboxidovorans
MSKEELKRAAAARALEYVSDGMQLGLGTGSTAKHFVELLGERVRAGLRVVGVPTSEGTRADAERCGVPLTTLDDVDHLDLTVDGADEIAPSLDVIKGGGGALLREKIVAAASTRMVVISDDSKWVETLGRFPLPVEVIPFGLGATRRALATAFAEAGVTGEITLRQGPDGHAFVTDGGHWILDAHLGRIPEPPRLAALLSAIPGVVEHGLFIGLAKTAILAGSQGIRIVDRPRGRV

SEQ ID NO: 175 - protein, 232 aa, Rhodopseudomonas palustris
MSSDELKRQAAAAALEHVRDGMKLGLGTGSTAKHFVELLGERVRGGLNVVGVPTSEVTRADALRCGIALTTLDEVDRLDLTVDGADEINAALNLIKGGGGALLREKIVAAASDRMIVIADESKLVANLGRFPLPIEVNSFGLAATLRAIEEACAECGVFGPLSLRKGSDGHAFVTDGGHWIVDAQLGRIPDAPSLADQLNAIPGVVENGLFIGLASMAVLAGPNGIRIIERP

SEQ ID NO: 176 - protein, 230 aa, Bradyrhizobium sp. ORS278
MDALKRQAAARALEEVESGMKLGLGTGSTAKHFVDLLGEKVRAGLKVVGVPTSEATRAQAEACGVPLTTLDEIDRLDITIDGADEINPALDLIKGGGGALLREKIVASASNRMIVIADDSKWVARLGRFPLPIEVVPFGIAATQREIADAFTKAGVAGPMSLRKSADGHVFVTDGGHWIVDVRLGEIEDPPRLASFLSAIPGVVEHGLFIGLGSTAILAGAQGIRVIQRP

SEQ ID NO: 177 - protein, 230 aa, Bradyrhizobium sp. BTAi1
MDALKRQAAAHALREVESGMKLGLGTGSTAKHFVDLLGEKVRAGLKVVGVPTSEATRAQAEACGVPLTTLDEIDHLDLTVDGADEINPALDLIKGGGGALLREKIVASASDRMIVIADESKWVARLGRFPLPIEVIPFGLAATRHAIAAAFAKAGVSGQMDLRKSADGHVFVTDGGHWIVDVRLGEIEDPPRLAGLLSAIPGVVEHGLFIGLGSTAILAGAQGIRVIQRP

SEQ ID NO: 178 - protein, 232 aa, Nitrobacter sp. Nb-311A
MTLDALKRQAAARALEYVEDGMRLGLGTGSTAKHFVELLGERVRGGLKVVGVPTSEVTRADAERCGIPLTTLDDLDRLDLTVDGADEIDADLNLIKGGGGALLREKIVAAGSERMIVIADETKWVAGLGRFPLPIEVIPFGLAATRRAITEVFAKAGVSGELVIRKRSDGHAFVTDGGHWIFDAHLGQIPDASYLAGLLNPIPGVVEHGLFIGLAGVAMLAGAQGIRIVERR

SEQ ID NO: 179 - protein, 232 aa, Nitrobacter winogradskyi
MTMDALKRQAAARALEYVEDGMRLGLGTGSTAKHFVELLGERVRDGLKVVGVPTSEATRADAERCGVPLTTLDDLDRLDLTVDGADEIDPDLNLTKGGGGALLREKIVAAASDRMIVIADETKWVAGLGRFPLPIEVIPFGLAATRRAITEVFAKAGVSGELAVRKRPDGHAFVTDGGHWIFDAHLGQIPDASYLAGLLNPIPGVVEHGLFIGLARVAMLAGAEGIRIVERR

SEQ ID NO: 180 - protein, 232 aa, Nitrobacter hamburgensis
MTLDALKRQAAARALEYVEDGMRLGLGTGSTAKHFVELLGERVRDGLKVVGVPTSEATRADAERCGIPLTTLDDLDRLDLTVDGADEIDPDLNLIKGGGGALLREKIVAAASERMIVIADETKWVAGLGRFPLPIEVIPFGLAATRRAIAEAFTKAGASGQMVVRKGPDGLAFVTDGGHWIFDAHLGQIPDASHLAGLLNPIPGVVEHGLFIGLARVAMLAGAQGIRVVERR

SEQ ID NO: 181 - protein, 292 aa, Azorhizobium caulinodans
MPPCRRFGRTFKGGVCGTARVAGAPLCLFKPGGRGTRRCASRLRFAPFAARQPANRWSTDMADAEELKRAAAAKALEYVTDGMRLGLGTGSTAKHFVALLAERVAAGLKVTGVPTSEQTKAQALSLGVPLATLDELPELDLCIDGADEIGPELALIKGGGGALLREKIVASAAREMIVIADETKTVATLGRFPLPIEVVTFGVEAIKLRLKGAIATAGCDGELKLRHKADGKPFITDQGNVIVDAHLGRIPDPRALARALEEVAGVVEHGLFLGLARRAVLAGANGISVITP

SEQ ID NO: 182 - protein, 253 aa, Xanthobacter autotrophicus
MPHAAPVGRARGTGTETPMVHAEDPKRRAAAHALTYVTDGMRLGLGTGSTARHFVELLAEKVHAGLNILGVPTSEQTLSQAVSLGVPIATLDEAGPLDLCIDGADEVGPGLALIKGGGGALLREKIVASAAREMVVIADSSKKVAMLGRFPLPIEVVDFGVASIERHVADAVRKAGCEGPVKLRRDGDGHPFVTDQGHLILDVHLGRIPDPAALARAVEEVAGVVEHGLFLGLARRVVLAGADGITVLEPGSF

SEQ ID NO: 183 - protein, 231 aa, Parvibaculum lavamentivorans DS-1
MNADDQKKAAAVRALEFVKPGMKLGMGTGSTAEHFVRALGEKVKAGLDIVGVPTSERTAKLAASLGIPLTNLDDTPHLDITVDGADELDGKLRLIKGGGGALLREKIVATASDRMIVIADASKLVKTLGSFPLPVEVIPFGSAVTARKIAEVASAHGCTGKMSRRADEYGEPFFTDSENFIYDCAFGSIPDPDGLSAALNRIPGVVDNGLFIGIAAMAIVGTDKGTDIIEA

SEQ ID NO: 184 - protein, 231 aa, Agrobacterium tumefaciens
MDARQMKIKAAEAALSHVQDGMRLGIGTGSTAEEFVRLLAEKVAAGLKVEGVPTSERTARLCVELGVPLKSLDELPELDLTIDGADEVDHVLRLVKGGGGALLREKIVAAASGRMIVIADQSKVVETLGAFPLPIEINPFGQVATRIAIEKLAARSGLSGELTMRSSGDGAFMTDGGHLILDASFGRIPDAEALARELNTIPGVVEHGLFINLASLAIIAGPEGARMMQAV

SEQ ID NO: 185 - protein, 226 aa, Agrobacterium tumefaciens
MKIKAAEAALSHVQDGMRLGIGTGSTAEEFVRLLAEKVAAGLKVEGVPTSERTARLCVELGVPLKSLDELPELDLTIDGADEVDHVLRLVKGGGGALLREKIVAAASGRMIVIADQSKVVETLGAFPLPIEINPFGQVATRIAIEKLAARSGLSGELTMRSSGDGAFMTDGGHLILDASFGRIPDAEALARELNTIPGVVEHGLFINLASLAIIAGPEGARMMQAV

SEQ ID NO: 186 - protein, 232 aa, Rhizobium etli
MDAREMKIKAAEAALAHVEDGMRLGIGTGSTAEEFVRLLAEKVASGFRVEGVPTSERTARLCVELGVPLKSLDELPALDLTVDGADEVDPALRLIKGGGGALLREKIVAAASERMIVIADESKLVDTLGAYALPIEVNPFGLVSTRMAIEKVAARLGLSGELSLRQSGDGEFTTDGGHHIIDASFGRIPDAEALSSELNSIPGVVEHGLFINMAALAIIAGPAGARTLQANR

SEQ ID NO: 187 - protein, 232 aa, Rhizobium etli
MDAREMKIKAAEAALAHVEDGMRLGIGTGSTAEEFVRLLAEKVAGGFRVEGVPTSERTARLCVELGVPLKSLDELPALDLTVDGADEVDPALRLIKGGGGALLREKIVAAASERMIVIADESKLVDTLGAYALPIEVNPFGLVSTRIAIEKVAARLGLSGELSLRQSGDGEFTTDGGHHIIDASFGRIPDAEALSSELNSIPGVVEHGLFINMAALAIIAGPAGARTLQANR

SEQ ID NO: 188 - protein, 232 aa, Rhizobium leguminosarum
MDAREMKIKAAAAALAHVEDGMRLGIGTGSTAEEFVRLLAEKVASGFKVEGVPTSERTARLCVELGVPLKSLDELPALDLTIDGADEVDPALRLIKGGGGALLREKIVAAASERMIVIADESKLVDTLGAYALPIEVNPFGLVSTRIAIEKVAARLGLAGELSLRQSGDGEFTTDGGHHIIDASFGRIPDAEALSSELNSIPGVVEHGLFINMAALAIIAGPAGARTLQANR

SEQ ID NO: 189 - protein, 232 aa, Rhizobium leguminosarum
MDAREMKIKAAEAALAHVESGMRLGIGTGSTAEEFVRLLAEKVAGGFRVEGVPTSERTARLCVELGVPLKSLDELPALDLTIDGADEVDQALRLIKGGGGALLREKIVAAASERMIVIADESKLVDTLGAFALPIEVNPFGLVSTRIAIEKVAARLGLSGELALRQSGDGEFTTDGGHHIIDASFGRIPDAEALSSELNSIPGVVEHGLFINMAALAIIAGPAGARTLQANR

SEQ ID NO: 190 - protein, 232 aa, Rhizobium etli
MDAREMKIKAAEAALAHVESGMRLGIGTGSTAEEFVRLLAEKVAGGFRVEGVPTSERTARLCVELGVPLKSLDELPALDLTIDGADEVDQALRLIKGGGGALLREKIVAAASERMIVIADESKLVDTLGAFALPIEVNPFGLVSTRIAIEKVAARLGLSGELGLRQSGDGEFTTDGGHHIIDASFGRIPDAEALSSELNSIPGVVEHGLFINMAALAIIAGPAGARTLQKNR

SEQ ID NO: 191 - protein, 232 aa, Rhizobium leguminosarum
MDAREMKIKAAEAALAHVESGMRLGIGTGSTAEEFVRLLAEKVAGGFRVEGVPTSERTARLCVELGVPLKSLDELPALDLTIDGADEVDQALRLIKGGGGALLREKIVAAASERMIVIADESKLVETLGAFALPIEVNPFGLVSTRIAIEKVAARLGLSGELDLRQSGDGEFTTDGGHHIIDASFGRIPDAEALSSELNSIPGVVEHGLFINMAALAIIAGPAGARTLQANR

SEQ ID NO: 192 - protein, 232 aa, Rhizobium etli
MDAREMKIKAAEAALAHVESGMRLGIGTGSTAEEFVRLLAEKVAGGFQVEGVPTSERTARLCVELGVPLKSLDELPALDLTVDGADEVDPALRLIKGGGGALLREKIVAAASQRMIVIADESKLVETLGAFALPIEVNPFGLVSTRIAIEKVAARLGLSGELNLRQSGDGEFTTDGGHHIIDASFGRIPDAEALSSELNSIPGVVEHGLFINMAALAIIAGPAGARTLQANR

SEQ ID NO: 193 - protein, 233 aa, Agrobacterium radiobacter
MDARQMKIEAARAALAYVESGMRLGVGTGSTAEEFVRLLAEKVAAGLVIEGVPTSERTARLCVDLGVPLKSLDELPELDLTIDGADEVDGALRLIKGGGGALLREKIVAASSQRMIVIADESKVVQTLGAFALPIEVNPFGLVSTRIQIEKTAARLGLSGALNLRQSEDGNFMTDGGHFIIDASFGRIPDAEALSIALNSIPGVVEHGLFINMATLAIIAGPSGARTLQANNT

SEQ ID NO: 194 - protein, 231 aa, Sinorhizobium medicae WSM419
MDARQMKIKAAEAALEHVENGMRLGIGTGSTAEEFVRVLAEKVASGFQISGVPTSERTARLCLELGVPLKSLDELPELDLTIDGADEVDGKLRLIKGGGGALLREKIVASASARMIVIADETKVVDVLGAFKLPIEVNPFGQLATRLAIEKVASRLGLTGDIVVRASGDGPFMTDGGHLILDASFGRIPDADALAVELNAIPGVVEHGLFIEMASMAIIAGPEGARTLKAS

SEQ ID NO: 195 - protein, 231 aa, Sinorhizobium meliloti
MDARQMKIKAAEAALEHVESGMRLGIGTGSTAEEFVRLLAEKVASGFQISGVPTSERTARLCLELGVPLKSLDELPELDLTIDGADEVDGKLRLIKGGGGALLREKIVASASTRMIVIADESKVVDVLGAFKLPIEINPFGQVATRLAIEKTASRLGLAGEIVVRSSGDGVFMTDGGHLILDASFGRIPDADALAVELNAIPGVVEHGLFIDVASMAIIAGPEGARTLTAS

SEQ ID NO: 196 - protein, 231 aa, Rhizobium sp. NGR234
MDARQMKIKAAQAALGYVESGMRLGIGTGSTAEEFVRLLAEKVASGFQIQGVPTSERTARLCLELGVPLKSLDELPELDLTIDGADEVDGKLRLIKGGGGALLREKIVASASERMIVIADESKVVDVLGAFKLPIEVNQFGLTTTRLAIEKVAARLGLTGDIGLRASGDGPFMTDGGHLILDASFGRIPDAEALAAGLNAIPGVVEHGLFLGMASLAIIAGPEGARTLTAG

SEQ ID NO: 197 - protein, 232 aa, Agrobacterium vitis
MDVRQMKIKAAELALSYVENGMRLGIGTGSTAEEFVRLLAEKVADGFKVQGVPTSERTARLCLELGVPLMSLDELPELDLTVDGADELDRHLTLIKGGGGALLREKIVAAASSRVIVIADETKLVETLGAYPLPIEINGFGGIATRISIEKAAAKLGLSGTIGLRMSGDDLFMTDGGHYILDASFGRIPDAVALSQALHAIPGVVEHGLFIGMASLAVVAGSDGARVIEPVA

SEQ ID NO: 198 - protein, 233 aa, Hoeflea phototrophica DFL-43
MDARQLKIQAAKAALDHVEDGMRLGIGTGSTADEFVRLLAEKVADGFKVHGVPTSERTARLCVELGVPLYSLDDMPELDLTIDGADEIDGALTLVKGGGGALLREKIVASASARMIVIADESKLVDTLGQFPLPIEVAKFGMVATHYAVERLASRLGLSGTIEQRADKDGPYLTDGDHFILDASFGRIPDAEAIANGLAAIPGVVEHGLFLNMASAAIIASPGGARTLLATDP

SEQ ID NO: 199 - protein, 243 aa, Mesorhizobium loti MAFF303099
MDARQLKVEAARAALAHVSDGMRLGIGTGTTAEEFVRLLADKVATGMTVIGVPTSERTAALCRELGVPLSTLEETPELDLTVDGADEVDPELTLIKGGGGALLREKIVAAASQRMIVIADRSKMVETLGRFPLPIEVNQFGLRATEIAIAKTAADLGLSGPITLRMTGGQAFVTDGGHFILDASFGRIPDTRALSNALHAIPGVVEHGLFIGLASTAIIAGGDGIQTVHAARKPGSSTNHDVA

SEQ ID NO: 200 - protein, 277 aa, Mesorhizobium opportunistum WSM2075
MDRLPKALITVKSFDPGGKNATSPKHQDFWAISGMDARQLKVEAARAALAHVTDGMRLGIGTGTTAEEFVRLLADRVATGMTVIGVPTSERTAALCRELGVPLSTLEETPELDLTVDGADEVDPALTLIKGGGGALLREKIVAAASQRMIVIADRSKMVETLGRFPLPIEVNQFGLRATEIAVAAAAEKLGLSGPVTLRMTGGQAFVTDGGHFILDASFGRIPDTRALSNALHAIPGVVEHGLFIGLASAAIIAGGDGIQTVHAARKPGSSIDHDVA

SEQ ID NO: 201 - protein, 235 aa, Mesorhizobium sp. BNC1
MTDAKTLKIEAARVALGYVEDGMKLGIGTGSTAEEFVRLLATRVSSGMKIVGVPTSERTAALCRELSVPLSTLDETPELDLTVDGADEVGPDLTLIKGGGGALLREKIVAAASRRMIVIADESKVVDVLGTFPLPIEVNPFGLRATRIAIEAAAARLGLAGEMRTRMAGQEPFVTDGGHFIIDASFGRIQAPRALAEALNAIPGVVEHGLFIGLAGAAIIAGRNGVRTLDAGSRI

SEQ ID NO: 202 - protein, 257 aa, Ochrobactrum intermedium LMG 3301
MLRRARMLEANRMTMRIRWDFGELGMDEARKLKIAAAAEALTHVKDGMRLGIGTGSTAEEFVRLLAEKVSGGFKIIGVPTSERTAKLCEELGVPLTTLDETPHLDLTVDGADEVDTNLSLIKGGGGALLREKIVAAASDAMIVIADSSKVVETLGRFPLPVEVNRFGLGATFRAIEEAAAKCGLAGPLALRLKDGSPFVTDGGHYIVDASFGRIPDPKTLSDALFAIPGVVEHGLFIGLARAAVIAGNDGIRTMNRS

SEQ ID NO: 203 - protein, 232 aa, Ochrobactrum anthropi
MDEARKLKIAAAAEALTHVKDGMRLGIGTGSTAEEFVRLLADKVSNGFKIIGVPTSERTAKLCKELGVPLTTLDETPHLDLTVDGADEVDTNLSLIKGGGGALLREKIVAAASDAMIVIADSSKVVETLGRFPLPVEVNRFGLGATMRAIEEAAAKCGLAGPLALRLKDGSPFVTDGGHYIVDASFGRIPDPKTLSDALFAIPGVVEHGLFIGLARAAVVAGNDGIRTMNRS

SEQ ID NO: 204 - protein, 232 aa, Brucella suis
MDEARKLKIAAAAEALTYVKDGMRLGIGTGSTAEEFVRLLAEKVKGGFRVIGVPTSERTAKLCEELGVALTTLEETPHLDLTIDGADEVDGELSLIKGGGGALLREKIVAAASDSMIVIADQSKVVETLGRFPLPIEVNRFGLGATIRAIEAAAVKCGLAGPLNLRLKDGSPFLTDGGHYIVDASFGRIPDPKTLSDALFAIPGVVEHGLFIGLARAAIIAGTDGIRTMNRS

SEQ ID NO: 205 - protein, 232 aa, Brucella ovis
MDEARKLKIAAAAEALTYVKDGMRLGIGTGSTAEEFVRLLAEKVKGGFRVIGVPTSERTAKLCEELGVALTTLEETPHLDLTIDGADEVDGELSLIKGGGGALLREKIVAAASDSMIVIADQSKVVETLGRFPLPIEVNRFGLGATIRAIEAAAVKCGLAGPLNLRLKDGSPFLTDGGHYIVDASFGRIPDPKTLSDALFAIPGVVEHGLFIGLARATIIAGTDGIRTMNRS

SEQ ID NO: 206 - protein, 232 aa, Brucella abortus
MDEARKLKIAAAAEALTYVKDGMRLGIGTGSTAEEFVRLLAEKVKGGFRVIGVPTSERTAKLCEELGVALTTLEETPHLDLTIDGADEVDGELSLIKGGGGALLREKIVAAASDSMIVIADQSKVVETLGRFPLPIEVNRFGLGATIRAIEAAAVKCGLAGPLNLRLKDGSPFLTDGGHYIVDASFGRIPDPKTLSDALFAIPGVVEHGLFIELARAAIIAGTDGIRTMNRS

SEQ ID NO: 207 - protein, 244 aa, Brucella ceti str. Cudo
MRIRGGRNGNSGMDEARKLKIAAAAEALTYVKDGMRLGIGTGSTAEEFVRLLAEKVKGGFRVIGVPTSERTAKLCEELGVALTTLEETPHLDLTIDGADEVDGELSLIKGGGGALLREKIVAAASDSMIVIADQSKVVETLGRFPLPIEVNRFGLGATIRAIEAAAVKCGLAGPLNLRLKDGSPFLTDGGHYIVDASFGRIPDPKTLSDALFAIPGVVEHGLFIGLARAAIIAGTDGIRTMNRS

SEQ ID NO: 208 - protein, 244 aa, Brucella melitensis
MRIRGGRNGNSGMDEARKLKIAAAAEALTYVKDGMRLGIGTGSTAEEFVRLLAEKVKGGFRVIGVPTSERTAKLCEELGVALTTLEETPHLDLTIDGADEVDGELSLIKGGGGALLREKIVAAASDSMIVIADQSKVVETLGRFPLPIEVNRFGLGATIRAIEAAAVKCGLAGPLNLRLKDGSPFLTDGGHYIVDASFGRIPDPKTLSDALFAIPGVVEHGLFIELARAAIIAGTDGIRTMNRS

SEQ ID NO: 209 - protein, 231 aa, Aurantimonas manganoxydans SI85-9A1
MTDSATLKTMAGEAALAHVEDGMRLGIGTGSTAEAFVRVLAERVRDGMKIVGVTTSNRTETLCAELGVPTETLETVPELDLTIDGADEVDGSLRLIKGGGGALLREKIVAAASERFLVIADASKKVETLGAFPLPIEINGFGMIATYLAIRKAAAGLGLEGDMILRRSGDEPFITDNGHLILDASFGRIGDPEALSQALFAVPGVVEHGLFLGMANTVILAGDDGLETLEA

SEQ ID NO: 210 - protein, 231 aa, Fulvimarina pelagi HTCC2506
MSDAKSLKRKAAEAAFAELDEGLNIGIGTGSTAEEFVRVLAEHVEADFEMTGVTTSERTETLCRELGVPTKTLDEIPILDVTVDGADEIDGDLRLIKGGGGALLREKIVAFSSAKMIVIADASKKVETLGAFPLPIEVNGFGLMSTFMAIRRVAETLDLTGDIVLRKNGDQPFITDGGHLILDASFGRIPDPEALSAALRSIPGIVEHGLFIKLASVAILASEDGIERLEA

SEQ ID NO: 211 - protein, 234 aa, Bartonella grahamii
MDVQQLKKMAAIKALEFIEDDMRLGIGSGSTVNEFIRLLGERVSDGLRVTGVATSRYSEQLCRKFGVPVSTLEQIPELDLDIDGADEIGPEMMLIKGGGGALLYEKIVASASRAMLVIADETKVVKRLGAFALPIEVNPFGIHTTRRAIEKVADDLGLSGEIVLRMNGKNPFETDGGHFILDAFWGCILQPKPLSDALLAIPGVVEHGLFLGLASRAIVAMVDGQTKILESFDF

SEQ ID NO: 212 - protein, 234 aa, Bartonella tribocorum CIP 105476
MDVQQLKKRAAVKALEFIEDDMLLGIGSGSTVNEFIRLLGERVADGLRVTGVATSRYSEQLCHKFGVPVSTLEQIPELDLDIDGADEIGPEMMLIKGGGGALLYEKIVASASRAMLIIADETKMVKKLGAFALPIEVNPFGVHTTRKAIEKVADDLGLSGEIVLRMNGKNPFKTDGGHFILDAFWGCILQPKLLSDALLVIPGVVEHGLFLGMASRAIVAMADGQIKVLEPFDF

SEQ ID NO: 213 - protein, 234 aa, Bartonella henselae
MNVQQLKKMAALKALEFVEDDMRLGIGSGSTVNEFIPLLGERVANGLRVTCVATSQYSEQLCHKFGVPISTLEKIPELDLDIDGADEIGPEMTLIKGGGGALLHEKIVASASRAMFVIADETKMVKTLGAFALPIEVNPFGIHATRIAIEKAADNLGLSGEITLRMNGDDPFKTDGGHFIFDAFWGRILQPKLLSEALLAIPGVVEHGLFLGLASRAIVAMADSQIKVLEPFDF

SEQ ID NO: 214 - protein, 234 aa, Bartonella quintana
MNVQQLKKRAAAKALEFVQDDMRLGIGTGSTANEFIRLLGERVADGLRVTGVATSQYSEQLCRKFGVPVTTLEQMPELDLDIDGADEIGPEMTLIKGGGGALWREKIVAAASRAMLVIADETKVVKTLGAFALPIEVNPFGMPATRRLIEKVADDLGLSGEIILRMNGENPFKTDGGHFIFDAFWGCILQPRLLSEALLAIPGVVEHGLFWGLASRAIVAMADGQIKVLESSDF

SEQ ID NO: 215 - protein, 233 aa, Bartonella bacilliformis
MNAQELKKVAAAKALEFVQDGMRLGIGSGSTANEFIRLLGERVANGLHVIGVATSHYSEQLCRQVGVPVTTLEQIPELDLDIDGADEIGPNMTLIKGGGGALLREKIVAAASHEMLIIADETKVVKTLGAFALPIAVNQFGLSVTRSAIEKMAKGLGLSGKVTLRMNGDNPFKTDDGHFIFDASWGHIVQPKLLSNALFEIPGVIEHGLFVGLASRSIIAMADGQIKILEKKC

SEQ ID NO: 216 - protein, 232 aa, Labrenzia alexandrii DFL-11
MSDNLKQQAAERAAEDVISGMRLGIGTGSTAEFFVHALAKRVADGLDVIGVPTSERTAELAASLGIKLTTLEELPELDLTVDGADELDANLALIKGGGGALLREKIVAAASGKMIVIADGTKNVDTLGQFPLPIEVVPFGQEATRRAILALLREMGLPQNLQLRMAGEHPFVTDGGHHIFDAHLLKIEDPETLAQALVKIPGVVEHGLFLNLASKAYVAGEDGVKTITPASM

SEQ ID NO: 217 - protein, 230 aa, Stappia aggregata IAM 12614
MSDQYKKLAAERAADDVTSGMRLGIGTGSTAEFFVHALARRVQDGLDVIGVPTSERTRELASSLGIRLTTLDELPELDLTVDGADELDPHLSLIKGGGGALLREKIVASASASMIVIADGSKEVATLGRFPLPIEVVPFGLEATRRAILKVFEGLGLPQNLALRGGSAEPFVTDGGHFILDAQLESIPEVRTLGDRLVAIPGVVEHGLFIELATKAYVAGTDGVKTVLPI

SEQ ID NO: 218 - protein, 229 aa, Pseudovibrio sp. JE062
MAMSLKAQAAAAALKEVKPGMKLGIGSGSTVNEMIRLLADMVKDGFEIIGVPASSYSQALCDELGVPLTTLDETPVLDLVIDGADEIDPQLNLIKGGGAALLREKIIAAASGRMLVIADESKIVDTLGKFPLPVEVIPFGLEATRQMMQNSLDAEGLQGEMILRMAGDKPLVTDNGNYILDCHLKAISDPKSLAKRLEVIPGVVEHGLFIDMAVRAYVAGTDEIRVLEP

SEQ ID NO: 219 - protein, 228 aa, Parvularcula bermudensis HTCC2503
MSDDKKQRAAAAALAHVRPGMTLGLGTGSTAAHFVKLLGDQGFEGQAIPTSEETARLAEAVGISLITPDETTRIDLAVDGADEADPSGALIKGGGGALLREKIIAQQAQTFIVIADDGKDVVQLGQFPLPVEVTGFAVGLTIQAIRSTLAALGYEDPSLTLRRGEGGFFQTDGGHLIVDIALGRIDEAEPLDAALTMIPGVVTTGLFVGLTDLMIFGTESGVREAVPT

SEQ ID NO: 220 - protein, 224 aa, Leeuwenhoekiella blandensis MED217
MTADQEKKQAALEAVKYIEDNMVVGLGTGSTAKHMIEAVGALVAKGMNLTCVPSSDATEKLAKELGIKIVALDEIEKIDVTIDGADEFDANFQLIKGGGGALLREKILAWNTKFNIIIADSSKDVEKLGAFKLPLEVIPFATKQIITFLEEEGLKPVQRMKGNDPYRTDENNNIVDVDIFEVDDLKALEIKLLKVPGIVETGLFLDTTSLIIVGKEDGPEIKKR

SEQ ID NO: 221 - protein, 230 aa, Desulfatibacillum alkenivorans AK-01
MTSQDALKKQAAEKAVEYLESGMVVGLGSGSTATFAIHAIARLMKEGKLKDIVGIPSSTPTEEVARSLGIPLVGFEEHAVIDVTIDGADEVDPDLNLIKGGGGALLREKVVAQATKKNIIIVDESKISDKLGTIFALPVEVVPFATASETRFLESLGAKVTVRENQLGKAFKTDNHNRILDADFGPMDDAVKIGMALSQRAGVVEHGLFLGTTALVIVAGADGIREMKAA

SEQ ID NO: 222 - protein, 225 aa, Dyadobacter fermentans DSM 18053
MKDLKSEKALAAKEAVKYLSNGQIVGLGSGSSAYIAIAEIGELVKNGLDIQGVPTSEKTRALAESLNIPLLSIEEVGSIDITIDGADEFTPDLQLIKGGGSFLLKEKVVASLSKAEIIITDSTKKVELLGKFTVPIEVIPYAQNYVLAQIGKLNGLGKIRLADGKPLVTEQGNLLIDGDFGLIQDPALLADQLIRIVGVVEHGLFINIAKKVIMGVGDTTITFEK

SEQ ID NO: 223 - protein, 228 aa, Sphingopyxis alaskensis RB2256
MSNFVAEKSIAAVRAVDEVRDGMLVGLGTGSTAAYAVKSLSERIKHGLRITAVATSQATEALALRLAVPLVPFQQLSAVDLTIDGADEIDDRFQAIKGGGGALLREKITESASTRVIIIADSSKLVAQLGKFPLPVEVVPFATEFVRARLSALGARVTVREAGGTPFLTDQGNYILDAALDEIPRPREIAAAITTIPGVLEHGLFLDEIDTIMIARGDMVEVRHRGEA

SEQ ID NO: 224 - protein, 220 aa, Bacillus thuringiensis
MNLKQLAGEYAAYFVNDGMKIGLGTGSTVYWTIQKLGERVKEGLSFQAVPTSKETEALAKQLNIPLISLNDVQSLDLTIDGADEIDSNLQLIKGGGGALLREKIVASSSKELLIIADESKLVTHLGTFPLPVEIIPFSWKQTERKIQSLGCQTTLRLKNNEIFITDNNNMIVDCIFPNHIATPSDLHKRLKMITGVVETGLFVNMTSKAIIGTKNGIQEL

SEQ ID NO: 225 - protein, 220 aa, Bacillus cereus
MNLKQLAGEYAAYFVNDGMKIGLGTGSTVYWTIQKLGERVKEGLSFQAVPTSKETEALAKQLNIPLISLNDVQSLDLTIDGADEIDSNLQLIKGGGGALLREKIVASSSKELLIIADESKLVTHLGTFPLPVEIIPFSWKQTERKIQSLGCQTTLRLKNNEIFITDNNNMIVDCIFPNHIATPSDLHKRLKMITGVVETGLFVNMTSKAIIGTKNGIKEL

SEQ ID NO: 226 - protein, 220 aa, Bacillus thuringiensis
MNLKQLAGEYAAYFVNDGMKIGLGTGSTVYWTIQKLGERVKDGLSFQAVPTSKETEALAKQLNIPLISLNDVQSLDLTIDGADEIDSNLQLIKGGGGALLREKIVASSSKELLIIADESKLVTHLGTFPLPVEIIPFSWKQTERKIQSLGCQTTLRLKNNEIFITDNNNMIVDCIFPNHIATPSDLHKRLKMITGVVETGLFVNMTSKAIIGTKNGIKEL

SEQ ID NO: 227 - protein, 220 aa, Bacillus cereus
MNLKQLAGEYAAYFVNDGMKIGLGTGSTVYWTIQKLGERVKEGLSFQAVPTSKETEALAHQLNIPLISLNDVQSLDLTIDGADEIDSNLQLIKGGGGALLREKIVASSSKELLIIVDESKLVTHLGTFPLPVEIIPFSWKQTERKIQSLGCQTTLRLKNNEIFITDNNNMIVDCIFPNHIATPSALHKRLKMITGVVETGLFVNMTSKAIIGTKNGIKEL

SEQ ID NO: 228 - protein, 220 aa, Bacillus thuringiensis
MNLKQLAGEYAANFVNDGMKIGLGTGSTVYWTIQKLGERVKEGLSFQAVPTSKETEALAHQLNIPLISLNDVQSLDLTIDGADEIDSNLQLIKGGGGALLREKIVASSSKELIIIADESKLVTHLGTFPLPIEIIPFSWKQTENKIQSLGCQTTLRLKNNETYITDNNNMIIDCIFPNHISNPAHLHTQLKMITGVVETGLFISMTSKVIIGAKNGIKEL

SEQ ID NO: 229 - protein, 220 aa, Bacillus cereus
MNLKQLAGEYAANFVNDGMKIGLGTGSTVYWTIQKLGERVKEGLSFQAVPTSKETEALAHQLNIPLISLNDVQSLDLTIDGADEIDSNLQLIKGGGGALLREKIVASSSKELIIIADESKLVTHLGTFPLPIEIIPFSWKQTENKIQSLGCQTTLRLKNNETYITDNNNMIIDCIFPNHISNPAHLHTQLKMITGVVETGLFISMTSKVIIGAKNRIKEL

SEQ ID NO: 230 - protein, 220 aa, Bacillus cereus
MNLKQLAGEYAANFVNDGMKIGLGTGSTVYWTIQKLGERVKEGLSFQAVPTSKETEALAQQLNIPLISLNDVQSLDLTIDGADEIDSNLQLIKGGGGALLREKIVASSSKKLIIIADESKLVTHLGTFPLPIEIIPFSWKQTENKIQSLGCQTTLRLKNNETYITDNNNMIIDCIFPNHISNPAHLHTQLKMITGVVETGLFISMTSKVIIGAKNGIKEL

SEQ ID NO: 231 - protein, 220 aa, Bacillus cereus
MNLKQLAGEYAANFVNDGMKIGLGTGSTVYWTIQKLGERVKEGLSFQAVPTSKETEALAQQLNIPLISLNDVQSLDLTIDGADEIDSNLQLIKGGGGALLREKIVASSSKKLIIIADESKLVTHLGTFPLPIEIIPFSWKQTENKIQSLGCQTTLRLKNNETYITDNNNLIIDCIFPNHISNPVHLHTQLKMITGVVETGLFISMTSKVIIGAKNGIKEL

SEQ ID NO: 232 - protein, 220 aa, Bacillus cereus
MNLKQLAGEYAANFVNDGMKIGLGTGSTVYWTIQKLGERVKEGLSFQAVPTSKETEALAQQLNIPLISLNDVQSLDLTIDGADEIDSNLQLIKGGGGALLREKIVASSSKKLIIIADESKLVTHLGTFPLPIEIIPFSWKQTENKIQSLGCQTTLRLKNNETYITDNNNMIIDCIFPNHISNPVHLHTQLKMITGVVETGLFISMTSTAIIGTKNGIKKL

SEQ ID NO: 233 - protein, 220 aa, Bacillus cereus
MNLKQLAGEYAANFVNDGMKIGLGTGSTVYWTIQKLGERVKEGLSFQAVPTSKETEALAQQLNIPLISLNDVQSLDLTIDGADEVDSNLQLIKGGGGALLREKIVASSSKKLIIIADESKLVTHLGTFPLPIEIIPFSWKQTENKIQSLGCQTTLRLKNNETYITDNNNLIIDCIFPNHISNPVHLHTQLKMITGVVETGLFISMTSTAIIGTKNGIKKL

SEQ ID NO: 234 - protein, 220 aa, Bacillus thuringiensis
MNLKQLAGEYAANFVNDGMKIGLGTGSTVYWTIQKLGERVKEGLSFQAVPTSKETEALAQQLNIPLISLNDVQSLDLTIDGADEIDSNLQLIKGGGGALLREKIVASSSKELIIIADESKFVTHLGNFPLPVEIIPFSWKQTENKIQSLGCQTTLRLKNDETYITDNNNLIIDCIFPNHISNPAHLHTQLKMITGVVETGLFISMTSTAIIGTKNGIKKL

SEQ ID NO: 235 - protein, 220 aa, Bacillus cereus
MNLKQLAGEYAANFVNDGMKIGLGTGSTVYWTIQKLGERVKEGLSFQAVPTSKETEALAQQLNIPLISLNDVQSLDLTIDGADEIDSNLQLIKGGGGALLREKIVASSSKELIIIADESKFVTHLGNFPLPVEIIPFSWKQTENKIQSLGCQTTLRLKNDETYITDNNNMIIDCIFPNHISNPAHLHTQLKMITGVVETGLFISMTSTAIIGTKNGIKKL

SEQ ID NO: 236 - protein, 220 aa, Bacillus cereus
MNLKQLAGEYAANFVNDGMKIGLGTGSTVYWTIQKLGERVKEGLSFQAVPTSKETEALAQQLNIPLISLNDVQSLDLTIDGADEIDSNLQLIKGGGGALLREKIVASSSKELIIIADESKFVTHLGNFPLPVEIIPFSWKQTENKIQSLGCQTTLRLKNDKTYITDNNNLIIDCIFPNHISNPAHLHTQLKMITGVVETGLFISMTSTAIIGTKNGIKKL

SEQ ID NO: 237 - protein, 220 aa, Bacillus cereus
MNLKQLAGEYAANFVNDGMKIGLGTGSTVYWTIQKLGERVKEGLSFQAVPTSKETEALAHQLNIPLLSLNDVQSLDLTIDGADEIDSNLQLIKGGGGALLREKIVASSSKELIIIADESKLVTHLGNFPLPVEIIPFSWKQTENKIQSLGCQTTLRLKNNETYITDNNNMIIDCIFPNHISNPAHLHTQLKMITGVVETGLFISMTSTAIIGTKNGIKKL

SEQ ID NO: 238 - protein, 220 aa, Bacillus thuringiensis
MNLKQLAGEYAANFVNDGMKIGLGTGSTVYWTIQKLGERVKEGLSFEAVPTSKETEALAHQLNIPLLSLNDVQSLDLTIDGADEIDSNLQLIKGGGGALLREKIVASSSKELIIIADESKLVTHLGNFPLPVEIIPFSWKQTENKIQSLGCQTTLRLKNNETYITDNNNMIIDCIFPNHISNPAHLHTQLKMITGVVETGLFISMTSTAIIGTKNGIKKL

SEQ ID NO: 239 - protein, 220 aa, Bacillus cereus
MNLKQLAGEYAANFVNDGMKVGLGTGSTVYWTIQKLGERVKEGLSFQAVPTSKETEALAHQLNIPLLSLNDVQSLDLTIDGADEIDSDLQLIKGGGGALLREKIVASSSKKLIIIADESKLVTHLGNFPLPVEIIPFSWKQTENKIQSLGCQTTLRLKNNEIYITDNNNMIIDCIFPNHISNPAHLHTQLKMITGVVETGLFISMTSTAIIGTKNGIKKL

SEQ ID NO: 240 - protein, 220 aa, Bacillus thuringiensis
MNLKQLAGEYAANFVNDGMKIGLGTGSTVYWTIQKLGERVKEGLSFQAVPTSKETEALAQQLNIPLISLNDVQSLDLTIDGADEIGSNLQLIKGGGGALLREKIVASSSKELIIIADESKLVTHLGNFPLPVEIIPFSWKQTENKIQSLGCQTTLRLKNNETYITDNNNMIIDCIFSNHISNPAHLHTQLKMITGVVETGLFISMTSKAIIGTKNGIKEL

SEQ ID NO: 241 - protein, 220 aa, Bacillus cereus
MNLKQLAGEYAANFVNDGMKIGLGTGSTVYWTIQKLGEYVKEGLSFQAVPTSKETEALAQQLNIPLISLNDVQSLDLTIDGADEIDSNLQLIKGGGGALLREKIVASSSKELIIIADESKLVTHLGNFPLPVEIIPFSWKQTENKIQSLGCQTTLRLKNNETYITDNNNMIIDCIFSNHISNPAHLHTQLKMITGVVETGLFISMTSKAIICTKNGIKEL

SEQ ID NO: 242 - protein, 220 aa, Bacillus thuringiensis
MNLKQLAGEYAANFVNDGMKIGLGTGSTVYWTIQKLGEYVKEGLSFQAVPTSKETEALAQQLNIPLITLNDVQSLDLTIDGADEIDSNLQLIKGGGGALLREKIVASSSKELIIIADESKLVTHLGNFPLPVEIIPFSWKQTENKIQSLGCQTTLRLKNNETYITDNNNMIIDCIFSNHISNPAHLQTQLKMITGVVETGLFISMTSKAIIGTKNGIKEL

SEQ ID NO: 243 - protein, 220 aa, Bacillus cereus
MNLKQLAGEYAATFVKDGMKIGLGTGSTVYWTIEKLGERVKEGLSFQAVPTSKETEVLAQQLNIPLISLNDIQSLDLTIDGADEIDSNLHLIKGGGGALLREKIVASSSKELLIIADESKLVTHLGTFPLPVEIIPFSWKQTESKIQSLGCQTTLRLKNNETFITDNNNMIIDCVFPHNITNPANLHNHLKMITGVVETGLFVNMTSKAIIGTKNGIQEL

SEQ ID NO: 244 - protein, 222 aa, Bacillus cereus
MVNLKQIAGEYAANFVQDGMKVGLGTGSTVYWTIQKLGQRVQEGLSIQAIPTSKETESLAQQLNIPLISLNDIQTLDLTIDGADEIDSNLQLIKGGGGALLREKIVAASSKELIIIADESKLVTHLGTFPLPVEIIPFSWKQTENKIQSLGCQTTLRLKNNDTFITDNNNMIIDCVFPNHISNPATLHEKLKMITGVVETGLFINMTSKAIIGTKNGIKELS

SEQ ID NO: 245 - protein, 221 aa, Bacillus cereus
MMNLKQLVGEYAANFVKDGMNIGLGTGSTVYWTIQKLGQLVQDGLYFQAVPTSKETEALAKQLNIPLISLNNVQSLDLTIDGADEIDSDLQLIKGGGGALLREKIVASSSKELIIIADESKLVARLGNFPLPVEIIPFSWKQTESKIQSLGCQTTLRIKNNGTFITDNNNMIIDCIFPNHISNPANLHEQLKMITGVVDSGLFINMTRKAIIGTKNGIKEL

SEQ ID NO: 246 - protein, 221 aa, Bacillus cereus
MMNLKQLVGEYAANFVKDGMNIGLGTGSTVYWTIQKLGQLVQDGLYFQAVPTSKETEALAKQLNIPLISLNNVQSLDLTIDGADEIDSDLQLIKGGGGALLREKIVASSSKELIIIADESKLVARLGNFPLPVEIIPFSWKQTESKIQSLGCQTTLRIKNNGTFITDNNNMIIDCIFPNHISNPANLHEQLKMITGVVDSGLFINMTKKAIIGTKNGIKEL

SEQ ID NO: 247 - protein, 221 aa, Bacillus cereus
MMNLKQLVGEYAANFVKDGMNIGLGTGSTVYWTIQKLGQLVQEGLYFQAVPTSKETEALAKQLNIPLISLNDVQSLDLTIDGADEIDSDLQLIKGGGGALLREKIVASSSKELIIIADESKLVARLGNFPLPVEIIPFSWKQTESKVQSLGCQTTLRIKNNETFITDNNNMIIDCIFPNHISNPANLHEQLKMITGVVDSGLFINMTRKAIIGTKNGIKEL

SEQ ID NO: 248 - protein, 221 aa, Bacillus cereus
MMNLKQLVGEYAANYVKDGMNIGLGTGSTVYWTIQKLGQFVQEGLYFQAVPTSKETEALAKQLNIPLISLNDVQSLDLTIDGADEIDSDLQLIKGGGGALLREKIVASSSKELIIIADESKLVARLGNFPLPVEIIPFSWKQTESKIQSLGCQTTLRLKNNETFITDNNNMIIDCIFPNHISNPANLHEQLKMITGVVDSGLFINMTRKAIIGTKNGIKEL

SEQ ID NO: 249 - protein, 220 aa, Bacillus cereus
MNLKQLAGEYAANFVKDGMNIGLGTGSTVYWTIQKLGQFVQEGLYFQAVPTSKETEALAKQLNIPLISLNDVQSLDLTIDGADEIDSDLQLIKGGGGALLREKIVASSSKELIIIADESKLVTRLGNFPLPVEIIPFSWKQTESKIQSLGCQTTLRFKNNETFITDNNNMIIDCIFPNHISNPAHLHTQLKMITGVVDSGLFINMTKKAIIGTKNGIKEL

SEQ ID NO: 250 - protein, 221 aa, Bacillus cereus
MLNLKQLADEYAANFVKDGMKVGLGTGSTAYWAIQKLGQRVKEGLSIQAVPTSKETEALAKQLNIPLILLNDVQRLDLTIDGADEIDSNLQLIKGGGGALLREKIVASSSKELIIIADESKFVTRLGTFPLPVEIIPFSWKQTERKIQSLGCQTTLRLKNNEIFITDNNNMIVDCIFPNHIATPSDLHKRLKMITGVVETGLFVNMTSKAIIGTKNGIQEL

SEQ ID NO: 251 - protein, 236 aa, Bacillus thuringiensis
MKIQALMLDHVRRSKAMDLKQIAGEYAATFVKDGMKIGLGTGSTAYWTIQKLGQRVKEGLSIQAVPTSKETEALAQQLNIPLISLNDVQSLDLTIDGADEIDSNLQLIKGGGGALLREKIVASSSKELIIIVDESKVVTRLGTFPLPIEIIPFAWKQTESKIQSLGCQTTLRLKNNETFITDNNNMIIDCIFPNHIPTPSDLHKRLKMITGVVETGLFVNMTSKAIIGTKNGIQEL

SEQ ID NO: 252 - protein, 220 aa, Bacillus anthracis
MDLKQIAGEYAATFVKDGMKIGLGTGSTAYWTIQKLGQRVKEGLSIQAVPTSKETEALAQQLNIPLISLNDVQSLDLTIDGADEIDSNLQLIKGGGGALLREKIVASSSKELIIIVDESKVVTRLGTFPLPIEIIPFAWKQTESKIQSLGCQTTLRLKNNETFITDNNNMIIDCIFPNHIPTPSDLHKRLKMITGVVETGLFVNMTSKAIIGTKNGIQEL

SEQ ID NO: 253 - protein, 220 aa, Bacillus cereus
MDLKQIAGEYAATFVKDGMKIGLGTGSTAYWTIQKLGQRVKEGLSIQAVPTSKETEALAQQLNIPLISLNDVQSLDLTIDGADEIDSNLQLIKGGGGALLREKIVASSSKELIIIIDESKVVTRLGTFPLPIEIIPFAWKQTESKIQSLGCQTTLRLKNNETFITDNNNMIIDCIFPNHIPTPSDLHKRLKMITGVVETGLFVNMTSKAIIGTKNGIQEL

SEQ ID NO: 254 - protein, 220 aa, Bacillus thuringiensis
MDLKQIAGEYAATFVKDGMKVGLGTGSTAYWTIQKLGQRVKEGLSIQAVPTSKETEALAQQLNIPLISLNDVQSLDLTIDGADEIDSNLQLIKGGGGALLREKIVASSSKELIIIVDESKVVTRLGTFPLPIEIIPFAWKQTESKIQSLGCQTTLRLKNNETFITDNNNMIVDCIFPNHIPTPSDLHKRLKMITGVVETGLFVNMTSKAIIGTKNGIQEL

SEQ ID NO: 255 - protein, 220 aa, Bacillus cereus
MDLKQIAGEYAATFVKDGMKIGLGTGSTAYWTIQKLGQRVKEGLSIQAVPTSKETEALAQQLNIPLISLNDVQSLDLTIDGADEIDSNLQLIKGGGGALLREKIVASSSKELIIIVDESKVVTRLGTFPLPIEIIPFAWKQTESKIQSLGCQTTLRLKNNEMFITDNNNMIIDCIFPNHIPTPSDLHKRLKMITGVVETGLFVNMTSKAIIGTKNGIQEL

SEQ ID NO: 256 - protein, 220 aa, Bacillus cereus
MNLKQLAGEYAATFVKDGMKIGLGTGSTAYWTIQKLGQRVKEGLSIQAVPTSKETEALAQQLNIPLISLNDVQSLDLTIDGADEIDSNLQLIKGGGGALLREKIVASSSKELIIIVDESKVVTRLGTFPLPIEIIPFAWKQTESKIQSLGCQTTLRLKNNETFITDNNNMIIDCIFPNHIPTPSDLHKRLKMITGVVETGLFVNMTSKAIIGTKNGIQEL

SEQ ID NO: 257 - protein, 221 aa, Bacillus thuringiensis
MDLKQIAGEYAATFVKDGMKIGLGTGSTTYWTIQKLGQRVKEGLSIQAVPTSKETEALAQQLNIPLISLNDVQSLDLTIDGADEIDSNLQLIKGGGGALLREKIVASSSKELIIIVDESKVVTRLGTFPLPIEIIPFAWKQTESKIQSLGCQTTLRLKNNETFITDNNNMIIDCIFPNHIPTPSDLHKRLKMITGVVETGLFVNMTSKAIIGTKNGIQELS

SEQ ID NO: 258 - protein, 221 aa, Bacillus cereus
MDLKQIAGEYAATFVKDGMKIGLGTGSTAYWTIQKLGQRVKEGLSIQAVPTSKETEALAKQLNIPLISLNDVQSLDLTIDGADEIDSNLQLIKGGGGALLREKIVASSSKELIIIVDESKVVTRLGTFPLPIEIIPFAWKQTESKIQSLGCQTTLRLKNNETFITDNNNMIIDCIFPNHIPTPSDLHKRLKMITGVVETGLFVNMTSKAIIGTKNGIQELS

SEQ ID NO: 259 - protein, 220 aa, Bacillus cereus
MDLKQIAGEYAATFVKDGMKIGLGTGSTAYWTIQKLGQRVKEGLSIQAVPTSKETEALAQQLNIPLISLNDVQSLDLTIDGADEIDSNLQLIKGGGGALLREKIVASSSKELLIIADESKLVTHLGTFPLPVEIIPFSWKQIESKIQSLGCQTTLRLKNNETFITDNNNMIIDCIFPNHIPTPSDLHKRLKMITGVVETGLFVNMTSKAIIGTKNGIQEL

SEQ ID NO: 260 - protein, 221 aa, Bacillus cereus
MLNLKQLAGEYAANFVKDGMTVGLGTGSTVYWTIKKLGERVKEGLSFQAVPTSKETEALAKQLNIPLISLNDVQILELTIDGADEIDANLQLIKGGGGALLREKIVASSSKELIIIADESKLVTYLGTFPLPVEITPFSWKQTERKIRSLGCQTTLRLKNNETFITDNNNVIIDCVFPQNITNPANLHTKLKMITGVVETGLFVNIASKAIIGTENGIKEL

SEQ ID NO: 261 - protein, 221 aa, Bacillus cereus
MMNLKQLAGEYAAGFVRDGMTIGLGTGSTVYWTIQKLGHRVQEGLSIQAAPTSKETEVLAKQLSIPLISLNEIDILDLTIDGADEINNDLQLIKGGGGALLREKIVATSSKELIIIADESKLVSHLGTFPLPIEIIPFSWKQTEKRIQSLGCETRLRMKDGGPFITDNGNLIIDCIFPNKILNPNDTHTELKMITGVVETGLFINMTSKAIIGTKNGIKEY

SEQ ID NO: 262 - protein, 221 aa, Bacillus mycoides
MMNLKQLAGEYAAGFVRDGMTIGLGTGSTVYWTIQKLGHRVQEGLSIQAAPTSKETEVLAKQLSIPLISLNEIDILDLTIDGADEINNDLQLIKGGGGALLREKIVATSSKELIIIADESKLVSHLGTFPLPIEIIPFSWKQTEKRIQSLGCETCLRMKDGGPFITDNGNLIIDCIFPNKILNPNDTHTELKMITGVVETGLFINMTSKTIIGTKNGIKEY

SEQ ID NO: 263 - protein, 221 aa, Bacillus weihenstephanensis KBAB4
MMNLKQLAGEYAAGFVRDGMTIGLGTGSTVYWTIQKLGHRVQEGLSIQAVPTSKETEVLAKQLSIPLISLNEIDILDLTIDGADEINNDLQLIKGGGGALLREKIVATSSKELIIIADESKLVSHLGTFPLPIEIISFSWKQTEKRIQSLGCETHLRMKDSRPFITDNGNLIIDCIFPNKILNPNDTHTELKMITGVVETGLFINMKSKAIIGTKNGIKEY

SEQ ID NO: 264 - protein, 221 aa, Bacillus cereus
MMNLKQLAGEYAAGFVRDGMTIGLGTGSTVYWTIQKLGQRVQEGLSIQAVPTSKETEVLAKQLSIPLISLNEIDILDLTIDGADEMNSNLQLIKGGGGALLREKIVAASSKELIIIADESKLVSHLGVFPLPVEIIPFSWKQTEKRVQALGCETRLRMKDDGPFITDNGNLIIDSIFPNKILNPNETHTKLKMITGVVETGLFINMTSKAIIGTENGIKEY

SEQ ID NO: 265 - protein, 220 aa, Bacillus cereus
MNLKQLAGEYAADFVKDGMKVGLGTGSTVYWTIQKLGERVQEGLSIQAVPTSKETEVLAKQLAIPLISLNETDILDLTIDGADEINNDLQLIKGGGGALLREKIVATSSEKLIIIADESKIVSHLGTFPLPIEIIPFSWKQTEKKVQSIGCETCLRMKDGGPFITDNGNFIIDCIFTNKILNPNDTNTELKMITGVVETGLFINMTSKVIIGTENGIKEY

SEQ ID NO: 266 - protein, 221 aa, Bacillus mycoides
MTDLKRLAGEYAADFVKDGMKIGLGTGSTVYWTIQKLGQLISEGLTIQAVPTSIETQKLAVQLSIPLIPLSDVDYLDLTIDGADEINPNLHLIKGGGGALLREKIVATSSQKLIIIADESKLVKDLGTFPLPIEIVPFAWEQTAKRIQSFGCQTILRTQNNQPFITDNGNMILDCVFPNQITNPIETHQQVKIVTGVIETGLFINMVNKAIIATEKGIKVL

SEQ ID NO: 267 - protein, 221 aa, Bacillus pseudomycoides DSM 12442
MTDLKRLAGEYAADFVKDGMKIGLGTGSTVYWTIQKLGQLISEGLTIQAVPTSIETEKLAVQLSIPLIPLSNVDYLDLTIDGADEINPNLHLIKGGGGALLREKIVATSSQKLIIIADESKLVKDLGTFPLPIEIVPFAWEQTAKRIQSFGCQTILRTQNNPPFITDNGNMILDCVFPNQITNPIETHQQVKIVTGVIETGLFINMVNKAIIATEKGIKVL

SEQ ID NO: 268 - protein, 221 aa, Bacillus cereus
MTNLKRKVGEYAADFIKDGMKIGLGTGSTVYWTIQKLGQLISEGLTIQAVATSIETEKLAEQLSIPLISLSDVDYLDLTIDGADEINPDLHVIKGGGGALLREKIVATSSKKLIIIADESKLVKDLGTFPLPIEIVPFAWEQTAKRIQSLGCQTILRIQNNQAFITDNGNMILDCVFQNRIKNPIDTHQQLKMLTGVIETGLFINMVDKAILATEKGIKEL

SEQ ID NO: 269 - protein, 224 aa, Paenibacillus sp. JDR-2
MESKRIAAEKAVELVKDGMKVGLGTGSTAYWAIQAIGRKVKEEGLTIQAVATSVQSEQLAKELGIPMMPFADVDVLDLTIDGADEVDPALHLIKGGGGALLREKIVAAASKQLIIIVDESKDVKQLGKFPLPVEIVPFAFELTVRKLRKLGCEPKLRKNGEELYVTDNGNYIADCEFGAIADPEALHDDLNRIPGVVDNGLFIHMASLVIVGSADGSIRSITKE

SEQ ID NO: 270 - protein, 238 aa, Geobacillus sp. Y412MC10
MTSEMNMKKIAAEHAAKYVQDGMKIGLGTGSTAYYAILKIGEMVRSGLSIQAVATSDASEKLAMEQGIPLTPVHQIDRLDLTIDGADELDDQLRLIKGGGGALLREKITAYHSERLVIVADEAKAVAQLGAFPLPVEIVPFAYEWTIRSLAQLGCSVQLRRQPDEGLYVTDNGNYVADCRFQEISGPEELSSRLGTVPGVVEHGLFIGMADQAIIGCRDGSVRILHSASMQAKNTFDS

SEQ ID NO: 271 - protein, 228 aa, Paenibacillus sp. oral taxon 786 str. D14
MNAKQAAGYRAAKWVKDGMTVGLGTGSTAYYAIEKIGEMVGNGLQIRAIATSKASEELAAKYHIPLIEAKDVDRLDLAIDGADEVDPQMALIKGGGGALLREKLVAINSDRFIVIADNGKMVSTLGRFKLPIELVPFCYEWTLRELKSRYDVPFEMRMQGDQLYVTDNGNYIVDAAFGQITDPARLSDELKAMTGVVEHGLFVGIAHTVVIGYEDGRTEIKEASCSNQ

SEQ ID NO: 272 - protein, 224 aa, Chitinophaga pinensis DSM 2588
MDTITKAKKAAGEKAASLVQPGMLVGLGTGSTAYWAIEKIGQMVKEGLNIRAVATSVASEQQAIALGIPITSFSEIQQLDIDIDGADEISEDLQIIKGGGGALLREKIVAHASRRKVIVADERKYVKTLGKFPLPVEIIPFGWELVFKSIQALQGAPTLRTREDKPYITDNGNYILDCMFGAIEHPEQLHHQLKAMTGVVETGLFINLKPTVIIAYENGEVKTL

SEQ ID NO: 273 - protein, 230 aa, Aciduliprofundum boonei T469
MELKEELKRKAGERAVEYIKDGMVVGLGTGSTVKYTILKLGELVKDGLDIIGIPTSIATEKLAKEMGIKLGSINDYQVIDLTIDGADEVDRNLNLIKGGGGALLREKMIAHASKYEIIVVDESKVKSVLGDFPLPIEIVKFGYKRTMNVLSTLGCKPLLRVKNGEAYITDNGNYIVDCKFERIDEPAKLERRIDEIPGVVEVGLFVGLTNKVIVGKKDKIEIMTSSGDSL

SEQ ID NO: 274 - protein, 230 aa, Aciduliprofundum boonei T469
MELKEELKRKAGEKAVKYIKDGMVVGLGTGSTVKYTILKLGELVKDGLDIIGIPTSIATEKLAKEMGIKLGSINDYQVIDLTIDGADEVDRNLNLIKGGGGALLREKMIAHASKYEIIVVDESKVKSVLGDFPLPIEIVKFGYKRTMNVLSTLGCKPLLRVKNGEAYITDNGNYIVDCKFERIDEPAKLERRIDEIPGVVEVGLFVGLANKVIVGKKDKIEIMTSSGDSL

SEQ ID NO: 275 - protein, 224 aa, Oceanobacillus iheyensis HTE831
MNEQDKLKKAVGEKAATMVKDGMKVGLGSGSTVYWMIRSLGERIQQDGLKIEGIPSSNQTATWAEEAGIPLTDFSNVKELDITIDGADEVDANNHLIKGGGAALFREKIIAQAAKEFVIIVDQSKVVETLGEFSLPVEVLPFSWQRTANEISKLGCVPTVRVHEEEPLVTDNGNYILDCPFKVIPHPDKLNKEIKSIVGVIETGLFIDMATTVIVGEKDNIYIK

SEQ ID NO: 276 - protein, 228 aa, Bacillus clausii KSM-K16
MDQLKRMAAEAAAEYVKDGMKIGLGSGSTVFEFVRVLGEKAKEGLNIQAVAASRKTEALAKACGIHIIDFPTMEKLEVAFDGADEIAPGLMLLKGGGGSLLREKLVAAAAKRLVVLADESKLVEELGAFKLPVEIIPFGWETTAMRIEALGGVASLRQTGKSPFVSDNHNWILDCDFGNIRDPYSLHEKVKKLVGVVETGLFLDMACEAIVASKNGIHHITKGDEFNV

SEQ ID NO: 277 - protein, 224 aa, Alicyclobacillus acidocaldarius
MEKKRMAGEAAAKRIQSGMKVGLGTGSTAYYTIVEVGRRVKEGLEIVAIPTSRETERLARELGIPLTDFRSCPRLDLTIDGADAVTPDLQLIKGGGGALLREKLVASISDELIIVVDDSKLYDSLSGLAIPVEVVPFAWETTARRIEQLGGRWTLRERNGETFVTDNHNYILDTVFDEVVDPADLARRLKLTTGVVESGLFIDMASEVAIGTDEGVVWRKKPGT

SEQ ID NO: 278 - protein, 224 aa, Alicyclobacillus acidocaldarius
MEKKRMAGEEAAKRIQPGMKVGLGTGSTAYYTIVEVGRRVKEGLEIVAIPTSRETERLARELGIPLTDFRSCPRLDLTIDGADAVTPDLQLIKGGGGALLREKLVASISDELIIVVDDSKLYDSLSGLAIPVEVVPFAWETTARRIEQLGGRWTLRERNGETFVTDNHNYILDTVFDEVADPADLARRLKLTTGVVESGLFIDMANEVAIGTDEGVVWRKKPGT

SEQ ID NO: 279 - protein, 230 aa, Synechococcus sp. JA-3-3Ab
MASADELKQAAAQAAAQKVQSGMVVGLGTGSTAAFAVGALAQRMQKEGLQFIGVPTSERTAEQARSLGIPLATLEEQPRLDLAIDGADEIEVGSLNLIKGAGGALLREKLVEASAAELIIIADASKKVAHLGTRFPVPVEVVRFGWKTTLARVEALGCQAVLRRTAEGDPYLTDEQHYILDCQFGPIANPAKLAEQLKGTVGVVEHGLFIGMATEAIIAGPEGIETLRQS

SEQ ID NO: 280 - protein, 238 aa, Synechococcus sp. JA-2-3B'a(2-13)
MTTLRVSGTESLDDLKQAAARAAVQKVQSGMVVGLGTGSTAAFAVSALAERMQTEGLQIIGVPTSERTAEQARSLGIPLATLEEQPRLDLAIDGADEIEVGSLNLIKGAGGALLREKLVEASAAELIIIADASKKVAQLGIRFPVPVEVVRFGWKTTLARVEALGCTATLRRNANGDPYLTDEQHYILDCQFGPMADPAKIADQLKGTVGVVEHGLFIGMAKEAIIALPTGIETLQPS

SEQ ID NO: 281 - protein, 230 aa, Gloeobacter violaceus
MDLDILKQTAARRAVELVEDGMVVGLGTGSTAAFAVSVLAERVRLGLRVVGIPTSERTARQAEAEGIVLGTLAEQSRVDLTIDGADEVALGELALIKGLGGALLREKIVAAASERLIIIVDATKLVEQLGSHGPLPVEVAPFGWQATARALERLGAEVNLRAQHGQAFLTDGGHYILDCRFGPIARPAELEAAIDRIPGVVESGLFVGMASAVIVADEGGIEVLTPSAAP

SEQ ID NO: 282 - protein, 234 aa, Sphaerobacter thermophilus
MPPEGDEQTRRKRAAAERAASAVQDGAVVGLGTGSTAECVIQALAERVKEGLRIVGVPTSLRSERLARSLGIPLIDLQDATRIDVTIDGADEVAVGTLDVLKGHGGALLREKLVAVASEREVIVVDDTKLVERLGSRFAVPVEVVPFGWRVPAQALEALGGRVALRSVPPEGEPFVTDNGNYILDVDFGPIANPAALANEIKTITGVIEHGLFIGIAHEVIVAGAQGVEVLTRG

SEQ ID NO: 283 - protein, 230 aa, Granulibacter bethesdensis CGDNIH1
MDTDALKRLAGEEAAALVQDGMVVGLGTGSTAACMVDALIRRVAQGLKIVGIPTSLRTAEQAQAGGIPLTDLGAHPRIDLTIDGADQVERGTLNLIKGMGGALLREKLVAAASERLVIIVDDRKLSENLSLPVPVEVVPFGWQATDLRIQALGGRTVLRGGADGTPYVTDNHNYILDVDFGAMGGSRKPETLDAALREIVGVVETGFFIHRAETVIIAGEGGVTRWQRSA

SEQ ID NO: 284 - protein, 234 aa, Gluconacetobacter diazotrophicus PAl 5
MGVQNSDPMIELKRMAAEEAAAMVQDGMAVGLGSGSTSAMMIDALGRRWAEGLRFVAIPTSEHSAEQARAHGITLVTFATHPQLDMAIDGADEVERGSLNLVKGLGGALFREKIVASAAKRFIIVVDESKLVDHLGSRVAVPVEVTSFGWESTARQLGELGARVSQRMDRNGGLFVTDGGNMILDCAFGPIADPPQLAADIRAIVGVIESGLFIRRTSEVIVAGRSGLTRLVAA

SEQ ID NO: 285 - protein, 237 aa, Acetobacter pasteurianus
MTATPPDPAAAFKQQAAIKAASLVQDGMAVGLGTGSTAKFVVAELGRRVREEGLRIRAIPTSSVTEKQAKEEGIPLTTFGEQPELDIAIDGADEIEPRTLNLIKGLGGALLWEKIVASAAKQFVVVADASKYVDHLGAKCPLPVEVIPFGWENVARQLGELGAHVTPRRNRDGSFYLTDEKNLIMDCVFGPMMEPEKLGRSILEIVGVVEHGLFLHMACQTITAGPEGIRILTPQQD

SEQ ID NO: 286 - protein, 231 aa, Gluconobacter oxydans
MSGTDMNVHKRTAAREAADMVKSGMVVGLGTGSTAAYMIERLGERVAEGLEIFGIPTSDDSEDKALKAGIPLTDFSAHRRIDIAIDGADEVQRGSLNLIKGLGGALLREKIVAQAAKRFVVIVDGTKPVDLLGERAPVPVEVISFGWECTAERLAACGARGVKPRTDRAGSLFVTDTGNMILDCHFGPIEKPEELAEKIDRIVGVVEHGMFLNMASEVLVATPDGVEHWEP

SEQ ID NO: 287 - protein, 237 aa, Thermomicrobium roseum
MGTERAKERAARFAASLVEDGMIVGLGSGSTAELAVRALGERLHDGLRLIGVATSQRTAALARRVGIELRDPDSVDRIDLAIDGADEVEERSLGLLKGRGGALVREKLVARMARRLVIIIDDSKLVAALGARFPLPVEVVPFGWRWCARWLEDLGGRPTLRCRPTGHPFRSDNGNLILDVAFGAIADPAWLDRTIKMLPGVIDHGLFLDMADLVIVGSETGIRLLERSRTVSETSKS

SEQ ID NO: 288 - protein, 229 aa, Thermobaculum terrenum ATCC BAA-798
MNQLDLKRMVAYRAAQLVPDGALIGLGSGSTAELFVQFLGERVRNEGLRVVGVPTSERTVAAAKAAGVELTTLEEHPELDMAFDGADEVDPDLNLVKGLGGALAREKIVAKASRVFVVLVDESKLVDILGSKSPVPVEVLQFGWTRTSRELESMGLQPVLRTRDGLPYVTDNGNYVLDLHVGPISNPSDLDLKLHLVTGVVETGLFIDIASLVMVGTQDGVIEMRRPQD

SEQ ID NO: 289 - protein, 233 aa, Clostridium beijerinckii
MDQKRVAGEKSTEYIKDGMILGLGTGSTAYYMIKKVGELIKNGMKIKAVATSKSTESLARELKIPLLSIDEVDRIDLAIDGVDEIDNEFNAIKGGGGALFREKIVASLANEVIWIMDESKLVDGIGEFPLPVEILPYGYKHVIKELQDYSLNPKIRMKEEEIFVTDNGNYIVDLHIGTPMNINDVYNKVNRITGVLETGLFINMCNRIIIGTNSGAKIINNSNSQNVKMEQFR

SEQ ID NO: 290 - protein, 224 aa, Gemella haemolysans
MNLKEVVGKKAVDYVKDGMIVGLGTGSTVFYFVHALADRVKEGLNVEMVSTSIQTVELAKSLGLSIKELEEIDHIDLAVDGVDEIDKDFNAIKGGGAALFREKIVADIAREVIWIYDESKDVEKLGNFNLPVEILPFGYSHTIRKMEEVGLKPVLRLKDGATLITDNNNYIVDLHLGYGFDIKAVKEKLESIVGVVEHGLFLNMCKLCIKGTEQGAVIIENPNN

SEQ ID NO: 291 - protein, 226 aa, Clostridium bolteae ATCC BAA-613
MYSKEEQKKAAAWQAAMEVEDNMVLGLGTGSTVYYLMEKLSERIRGGLYVHGAATSLETEGLARRLGIPLISLEDARTIHLAIDGVDAIDPDFYSIKGGGGALFREKIIACKARRVLWIMDQSKLVHSLSGCVLPVEVPAFAVPYVEEQVREAGFIPKLRIKNGTVFVTDNGSHILDLTGGVEMDYPMAAVRLKSMTGVLETGLFGDICEKIIVGTENGTQERFHN

SEQ ID NO: 292 - protein, 247 aa, Clostridiales bacterium 1_7_47_FAA
MAALKAASEIQDNMVLGLGTGSTVYYLILKLAERVRGGLHIHAAATSARTEGLAAHYGIPLIPLHQAEQIHLAIDGVDAIDSDFYSIKGGGGALFREKVIASKARRVIWIMDQSKLVPTLNGLTLPVEVVPFATGFVEEQVRAMGFISRLRRNGDGLDGNNPDRDDSGASVFLTDNGNHILDLQGKEGVDYRLMAGRLKALTGVVETGVFGNICEKIIIGTEDGVIVKSSGNHSIPSPLIQISSCQK

SEQ ID NO: 293 - protein, 231 aa, Clostridium hathewayi DSM 13479
MPDTKDKQIKEQKKAAAVMAAGELRDGMVAGLGTGTTVYYLIQEIARLVKEGLTIHVLPTSEQTRSLASQLNIPLLSTDTAPAADLAIDGVDGVDSHFWSVKGGGGALFREKLIASNARRVIWILDESKLLNHLSEVPLPIEVVPFGFSYVMKEVAALGFRPRLRLNDGMPFLTDNGNYILDLAGDSSMDYREKSALLKSLTGVVETGLFPDFCEKLIIGGADGVRVLENR

SEQ ID NO: 294 - protein, 232 aa, Exiguobacterium sibiricum 255-15
MYEQEKKMLAEAAIKQVKNGMILGLGTGSTTRSFIDALGEWVKAGGEVQGVATSNETVEQAKRLNIPLLSLEEATHIDLVIDGIDQIDPRFRVLKGGGGALFREKVVALMSREILYLADASKFVHHLTGPLPVEIDAFARPYVERYLRDKQLDVTLREHDGQPFVTDGGHLILDVDLERVQDVRHFAQELKSLTGVLETGYFERQPDHVLTVEQGKVRQLAHPNLRDGGGLV

SEQ ID NO: 295 - protein, 228 aa, Staphylococcus capitis
MKDVKELKLMTLDDVTSQIKDGMTLGIGTGSTIELLVPKIAELIHQHHYEITGVCTSNKTAFLAKELDINIVEVNDVKKIDLAIDGADEVDPNLNLIKGGGGALFREKVIDEMAEKFVVIADENKIVDYLGQTFVLPVEVDKFNWYQVSKKIESIKGVKVNRRVNEDVPFTTDNGNYILDCNLPEGIDPYEMHEFLIHLTGVLETGYFLDMTDQVIVGTQNGVKIMDK

SEQ ID NO: 296 - protein, 229 aa, Staphylococcus epidermidis
MKDVKELKLMTLDDVISQIEDGMTLGIGTGSTIELLVPRIAELVHQHHYDITGVCTSNKTAFLAKELDIKIVEVNDVNHIDLAIDGADEVDPNLNLIKGGGGALFREKVIDEMAERFVVIADENKLVDYLGQTFVLPVEVDKFNWYQVAKRIEDIQGVKVNRRVNEDVPFTTDNGNYILDCTLPEGIDPYDMHEFLIHLTGVLETGYFLDMTDQVIVGTQDGVKIMNKA

SEQ ID NO: 297 - protein, 230 aa, Staphylococcus warneri
MNDVKQLKLMTLDDVLSQIEDGMTLGIGTGTTIELLVPKIAQLIKEKHYNIIGVCTSNKTAFLAKELNINIVDVNDVEKIDLAIDGADEVDPQLNLIKGGGGALFREKVIDEMADRFVVIADENKVVNYLGETFKLPVEVDKFNWYQVAKKIETIGGVTTQRRVTDDVPFTTDNGNYILDCALPKGIDPYEMHEFLIHITGVLETGYFLDVADQAIIGTQQGVKKMNRQD

SEQ ID NO: 298 - protein, 230 aa, Staphylococcus epidermidis
MKDAKELKLMTLEDVLSQIENGMTIGIGTGSTIELLIPQIAELIQQKNYTITGVCTSNKTAFLAKELAMNIVDVNDVEKIDLAIDGADEVDSALNLIKGGGGALFREKVIDEMADRFVVVVDESKLVNYLGETFALPVEVDKFNWYQVAKKIERTYDIHVSRRVNEDVPFITDNGNYILDCSLQNRIPAYELHEFLIHLTGVLETGYFLDIADQVIVGTQEGVKILNKET

SEQ ID NO: 299 - protein, 230 aa, Staphylococcus epidermidis
MKDAKELKLMTLEDVLGQIENGMTLGIGTGSTIELLIPQIAELIQKKNYTITGVCTSNKTAFLAKELAMNIVDVNDVEKIDLAIDGADEVDSALNLIKGGGGALFREKVIDEMADRFVVVVDESKLVNYLGETFALPVEVDKFNWYQVAKKIECTYDIHVNRRINEDVPFITDNGNYILDCSLQNRISAYELHEFLIHLTGVLETGYFLDIADQVIVGTQEGVKILNKET

SEQ ID NO: 300 - protein, 228 aa, Staphylococcus aureus
MKDVKALKLMTLNDVLSQINGDMTLGIGTGSTMELLLPQMAQLIKERGYNITGVCTSNKIAFLAKELGIKICEINDVDHIDLAIDGADEVDPSLNIIKGGGGALFREKVIDEMASRFVVVVDETKIVQYLGETFKLPVEVDKFNWYQILRKIESYADIKVERRVNEDVAFITDNGNYILDCKLPKGIDPYKFHEYLIHLTGVFETGYFLDMADQVIVGTQEGVKILEK

SEQ ID NO: 301 - protein, 228 aa, Staphylococcus aureus
MKDVKALKLMTLNDVLSQINGDMTLGIGTGSTMELLLPQMAQLIKERGYNITGVCTSNKIAFLAKELGIKICEINDVDHIDLAIDGADEVDPSLNIIKGGGGALFREKVIDEMASRFVVVVDETKIVQYLGETFKLPVEVDKFNWYHILRKIESYADIKVERRVNEDVAFITDNGNYILDCKLPKGIDPYKFHEYLIHLTGVFETGYFLDMADQVIVGTQEGVKILEK

SEQ ID NO: 302 - protein, 228 aa, Staphylococcus aureus
MKDVKALKLMTLNDVLSQINGDMTLGIGTGSTMELLLPQMAQLIKERGYNITGVCTSNKIAFLAKELGIKICEINDVDHIDLAIDGADEVDPSLNIIKGGGGALFREKVIDEMASRFVVVVDETKMVQYLGETFKLPVEVDKFNWYHILRKIESYADIKVERRVNEDVAFITDNGNYILDCKLPKGIDPYKFHEYLIHLTGVFETGYFLDMADQVIVGTQEGVKILEK

SEQ ID NO: 303 - protein, 228 aa, Staphylococcus aureus
MKDVKALKLMTLNDVLSQINGDMTLGIGTGSTMELLLPQMAQLIKERGYNITGVCTSNKIAFLAKELGIKICEINDVAHIDLAIDGADEVDPSLNIIKGGGGALFREKVIDEMASRFVVVVDETKMVQYLGETFKLPVEVDKFNWYHILRKIESYADIKVERRVNEDVAFITDNGNYILDCKLPKGIDPYKFHEYLIHLTGVFETGYFLDMADQVIVGTQEGVKILEK

SEQ ID NO: 304 - protein, 229 aa, Staphylococcus hominis
MKDAKELKLMTTDDAVAQIQDNMILGIGTGSTIELLIPKIAERIQQDNLNVTGVCTSNKSEFLAKQYNINVVDINDITYINLAIDGADEIDSDLNLIKGGGGALFREKVIDEMARKFIVLADESKMVNYLGETFKLPIEVDKFNWLLVSKKIEAYHDISVERRMNEDIPFITDNGNYILDCELKSKIDPYQLHEFLIHLTGVLETGYFLDMTTQAIIGTQEGIKVINKK

SEQ ID NO: 305 - protein, 230 aa, Staphylococcus haemolyticus
MKDSKELKIMTVDDAVAQIEDNMVLGIGTGSTIELLIPKLAERIHKEQLNITGVCTSNKSAFIAKKLDINVVDINDVGHVDLAIDGADEVDVNINLIKGGGGALFREKVIDEMAHRFVVLADESKLVNYLGESFKLPVEVDKFNWFHIAKKIEAFDDIITERRMSDDVPFITDNGNYILDCQLNKQIDPYQFHEYLIHLTGVLETGYFLNITDQVIVGTQDGVKIINKSN

SEQ ID NO: 306 - protein, 227 aa, Staphylococcus carnosus
MDIKELKLKTVDDAVTEIKDGMIVGIGTGSTIELLLPKIAALLNDGTQITGVCTSNKTALIAKELGIKIVDVNDVDYIDVAIDGADEFDSDLNLIKGGGGALFREKVIDDMAERFVVIADETKFVDYLGQTFKLPVEVDKFNWLLVSKKITKDTQAVVSRRNVEDIPFVTDNGNYILDVELLPHTNPYEMHEYLIHLTGVLETGYFLDVTDRVIVGTKEGVKILDKE

SEQ ID NO: 307 - protein, 232 aa, Staphylococcus saprophyticus
MDKKQLKMSTFNDALDQIKDGMIVGIGSGSTIELLVPKIAEKLEQEQIKITGVCTSNKTAFIAKELGIHIIDVNDVDHIDIAIDGADEIDNDLNLIKGGGGALFREKVIDAMAERFVVLADDSKCVDYLGQTFKLPVEVDKFNWLLVAKRIKAYDELKVTRRMVDDVPFITDNGNYILDVVLNEGINAAGMHEFLIHLIGVLETGYFLNVADQAIIGTTNGVKIKNKASLID

SEQ ID NO: 308 - protein, 232 aa, Sorangium cellulosum
MSTAGPDPSDLDRIANAALARVESGMLLGLGTGRASEAFIRRLGERVRRGLQIKGVATSERSEALARRENIPTVSLEEVERLHVAVDGADEVTPDLGLIKGLGGALLRERVVAYEAAQFIILVTPEKLVEKLGSRVPIPIEVVPFAVTTATRHLTALGGKPAIRKNADGYPFQTDNHNWILDTAFGPMDAPAAVDARIRSIPGVVDTGLFLDMATLVLVADPGAVRELTRQR

SEQ ID NO: 309 - protein, 230 aa, Gemmata obscuriglobus
MSAGTPDTDAIAAKAVELVQPDTVVGLGTGRAATAFIQALGAKVQAGLRIRGLPTSEVSAELATKLGIPLVTFDDVPYIDVCVDGADEVDPNGDLIKGYGGALVREKVVAAYARTFVVLAGGEKVVKVLGERGKLPVEVVTFALTPCRKRLETLGLPSALRMKDGKPFVTDNGNYILDCRTTAITAPADTEAQILAIPGVVGTGIFAKMAHTIMIQGTDGSVEVRAGSAK

SEQ ID NO: 310 - protein, 224 aa, Listeria monocytogenes
MINQKKIAGEKACEWIKDGMVVGLGTGSTVYYTIEKLGEMVNNGLHITGVATSEETNKQAQNLGIPLKSLNDVTEIDITIDGADEIDTDFQGIKGGGGALLREKMVASASLKNIWVVSEEKLVRNLGKFPLPLEVIPFGWKQVERKLEKEHIQTNLRKQSSGEVYVTNNGNYILDIVNQTFTDAEMWQEKLAQIPGIVEHGLFLHYVDIIICAKANGEIELIKK

SEQ ID NO: 311 - protein, 224 aa, Listeria monocytogenes
MINQKKIAGEKACEWIKDGMVVGLGTGSTVYYTIEKLGEMVNNGLHITGVATSEETNKQAQNLGIPLKSLNDVTEIDITIDGADEIDTVFQGIKGGGGALLREKMVASASLKNIWVVSEEKLVRNLGKFPLPLEVIPFGWKQVERKLEKEHIQTNLRKQSSGEVYVTNNGNYILDIVNQTFTDAEMWQEKLAQIPGIVEHGLFLHYVDIIICAKANGEIELIKK

SEQ ID NO: 312 - protein, 224 aa, Listeria monocytogenes
MINQKKIAGEKACEWIKDGMVVGLGTGSTVYYTIEKLGEMVNNGLHITGVATSEETSKQAQNLGIPLKSLNDVAEIDITIDGADEIDTDFQGIKGGGGALLREKMVASASLKNIWVVSEEKLVRNLGKFPLPIEVIPFGWKQIERTLEKEHVQTILRRQSSGEIYVTNNGNYILDIVNQTFRDAEMWQEKLAQIPGIVEHGLFLHYVDIIVCAKANGEIELIKK

SEQ ID NO: 313 - protein, 224 aa, Listeria monocytogenes
MINQKKIAGEKACEWIKDGMVVGLGTGSTVYYTIEKLGEMVNNGLHITGVATSEETSKQAQNLGIPLKSLNDVAEIDITIDGADEIDTDFQGIKGGGGALLREKMVASASLKNIWVVSEEKLVRNLGKFPLPIEVIPFGWKQIERTLEKEHIQTILRRQSSGEIYVTNNGNYILDIVNQTFRDAEMWQEKLAQIPGIVEHGLFLHYVDIIVCAKANGEIELIKK

SEQ ID NO: 314 - protein, 224 aa, Listeria monocytogenes
MINQKKIAGEKACEWIKDGMVVGLGTGSTVYYTIEKLGEMVNNGLHITGVATSEETSKQAQNLGIPLKSLNDVAEIDITIDGADEIDTDFQGIKGGGGALLREKMVASASLKNIWVVSEEKLVRNLGNFPLPIEVIPFGWKQIERTLEKEHIQTILRRQSSGEIYVTNNGNYILDIVNQTFRDAEMWQEKLAQIPGIVEHGLFLRYVDIIVCAKENGEIELIKK

SEQ ID NO: 315 - protein, 223 aa, Listeria monocytogenes
MNQKKLAGEKACEWIEDGMVVGLGTGSTVYYTIEKLGQMVNNGLHITGVATSDETTKQAEKLGIPLKALNDVTEIDVTIDGADEIDTNFQGIKGGGGALLREKMVASASLKNIWVVGEEKLVRTLGKFPLPLEVIPFGWKQIERTLAKEQIQTNLRKQSNGEVYVTNNGNYILDIVNQSFTDAEMWQEKLAQIPGVVEHGLFLDYVDVIICGKANGETEIIKK

SEQ ID NO: 316 - protein, 223 aa, Listeria monocytogenes
MNQKKIAGEKACEWIEDGMVVGLGTGSTVYYTLEKLGQMVNNGLHITGVATSDETTKQAEKLGIPLKSLNDVTEIDVTIDGADEIDTNFQGIKGGGGALLREKMVASASLKNIWVVSEEKLVRTLGKFPLPLEVIPFGWKQIERTLAKEQIQTNLRKQSNGEVYVTNNGNYILDIVNQSFTDAEMWQEKLAQIPGVVEHGLFLDYVDVIICGKANGETEIIKK

SEQ ID NO: 317 - protein, 223 aa, Listeria monocytogenes
MNQKKIAGEKACEWIEDGMVVGLGTGSTVYYTIEKLGQMVNNGLHITGVATSEETTKQAEKLGIPLKSLNDVTEIDVTIDGADEIDANFQGIKGGGGALLREKMVASASLKNIWVVSEEKLVRTLGKFPLPVEVIPFGWKQIERILAKEHIQTNLRKQSSGEVYVTNNGNYILDIVNQSFTDAKMWQEKLAQIPGVVEHGLFLDYVDVIICGKANGETEIIKK

SEQ ID NO: 318 - protein, 205 aa, Listeria monocytogenes
MVVGLGTGSTVYYTIEKLGEMVNNGLHITGVATSEETSKQAQNLGIPLKSLNDVAEIDITIDGADEIDTDFQGIKGGGGALLREKMVASASLKNIWVVSEEKLVRNLGKFPLPIEVIPFGWKQIERTLEKEHVQTILRRQSSGEIYVTNNGNYILDIVNQTFRDAEMWQEKLAQIPGIVEHGLFLHYVDIIVCAKANGEIELIKK

SEQ ID NO: 319 - protein, 224 aa, Listeria innocua
MINQKKIAGEKACEWIEDGMVVGLGTGSTVYYTIEKLGEMVQKGLNITGVSTSIETEQQARTLGIPLKSLNDVTKIDVTIDGADEINQAFQGIKGGGGALLREKMVAQASSKNIWVVGEEKLVTELGKFPLPLEVIPFGWKQIKRMLENDGVETTLRKQSSGEIYETNNGNYILDIINQTFTNPEAWHEKLAGIPGVLEHGLFLHYVDIIICGKASGEIEIIKK

SEQ ID NO: 320 - protein, 223 aa, Listeria welshimeri
MNQKKIAGEKACGWVKDGMVVGLGTGSTVYYTIEKLGEMVRDGLNITGIATSEETAIQAKKLGIPLKSLNDVKQIDVTIDGADEVNKDFQGIKGGGGALLREKMVAAASLMNIWVVEEKKLVEELGEFSLPIEVIPFGWKQIKWSLEKEAIETELRKNDSGKVYQTNNGNYILDIKNQILTNPVEWQEKLAGIPGIVEHGLFLDYVDIVICGKANGEAIVIKK

SEQ ID NO: 321 - protein, 231 aa, Listeria grayi
MEALGMNAKQLAGEKAAEWVEDGMTIGLGTGSTVYYTIEKIGEMVKNGLQIVGVPTSERTRIQAEGLGIPLTSLNEVEKIDLTIDGSDEVDASFRGIKGGGGALLREKMVADISDTNIWVVSSNKRVDVLGKFPLPIEVIPFGYKQVANKLQKRSADARLRKTEDGDIYVTDNGNYILDVYDQAFTDPAEWQDWLQKVPGIVEQGFFLGIVDIVIAASESGEIELFESEKS

SEQ ID NO: 322 - protein, 228 aa, Bacillus coagulans
MDGKKMAGEKAAELVEDGMIVGLGTGSTVYYTIKKLGERVQSGLHITGVPTSRATEKLARECGIPIADLNDTAQMDVTIDGADEVDPSLNGIKGGGGALLFEKLVAKASKRNIWVVDSRKMVQQLGAFPLPVEVVPFGYKHLMKTFEREGLNPVLRMKEGRPYVTDGGHYIVDIKLKSPDIGAFGAWLDGYTGVVEHGLFLGICDLVVIGDGSKVYTKNRAEAKNIIL

SEQ ID NO: 323 - protein, 226 aa, Granulicatella elegans ATCC 700633
MRVNMKEMVGKQAATYIESGMTVGLGTGSTAYYFVEEIGRRVKEEGLDIIGVTTSKRTKEQAEKLGIPLKSVDEVDFIDVTVDGADEIAPDFSGIKGGGGALLFEKIVAEQSKRIIWIVDESKMVDYLGRFPLPVEVIPYGSEQLFKKFEAKGYRPKFRVLENGERYLTDSQNYIIDLDVFPIKDPVTFGAELKALTGVVEQGLFTNMTETVLIGTPDGVKVQTLG

SEQ ID NO: 324 - protein, 222 aa, Granulicatella adiacens ATCC 49175
MNMKELVGKKAAEYVESGMTVGLGTGSTAYYFVEEIGRRVKEEGLEIVGVTTSLATKKQAEALGIPLKSVDEVDYIDVTIDGADEIAPDFSGIKGGGGALLFEKIVAEQSKSVIWIVDESKMVDYLGRFPLPVEVVPYGSLQLFKRFEALGYKPTFRERDGERYLTDSKNYIIDLDVYPIKDPIAFGEKIKGMTGVVEQGLFTNMTDIVLVGTPDGVVVKQF

SEQ ID NO: 325 - protein, 227 aa, Enterococcus faecium
MNLKQLAGIEAAKFVKDGMIVGLGTGSTAYYMVEEIGRRMREEGLRITGVTTSNATKEQAEKLGIPLKSIDEVPVVDLTIDGADEISADFQGIKGGGAALLFEKIVATYSKETIWIVDSSKLVDKLGKFPLPVEVIPYGSQQLLHIFEEKGFQPVLRTDENGEVLTTDGGHYIIDLHLEVIEQPESLATYLDELVGVVEHGLFLNMVSKVVVGSEKGVEILDAIRRK

SEQ ID NO: 326 - protein, 227 aa, Enterococcus faecium
MNLKQLAGIEAAKFVKDGMIVGLGTGSTAYYMVEEIGRRMREEGLRITGVTTSNATKEQAEKLGIPLKSIDEVPVVDLTIDGADEISADFQGIKGGGAALLFEKIVATYSKETIWIVDSSKLVDKLGKFPLPVEVIPYGSQQLLHIFEEKRFQPVLRTDENGEVLTTDGGHYIIDLHLEVIEQPESLATYLDELVGVVEHGLFLNMVSKVVVGSEKGVEILDAIRRK

SEQ ID NO: 327 - protein, 227 aa, Enterococcus faecium
MNLKQLAGIEAAKFVKDGMIVGLGTGSTAYYMVEEIGRRMREEGLRITGVTTSNATKEQAEKLGIPLKSIDEVPVVDLTIDGADEISADFQGIKGGGAALLFEKIVATYSKKTIWIVDSSKLVDKLGKFPLPVEVIPYGSQQLLHIFEEKGFQPVLRTDENGEVLTTDGGHYIIDLHLEVIEQPESLATYLDELVGVVEHGLFLNMVSKVVVGSEKGVEILDAIRRK

SEQ ID NO: 328 - protein, 227 aa, Enterococcus faecium
MNLKQLAGIEAAKFVKDGMIVGLGTGSTAYYMVEEIGRRMREEGLRITGVTTSNATKEQAEKLGIPLKSIDEVPVVDLTIDGADEISADFQGIKGGGAALLFEKIVATYSKETIWIVDSSKLVHKLGKFPLPVEVIPYGSQQLLHIFDEKGFQPVLRTDENGEVLTTDGGHYIIDLHLEVIEQPESLATYLDELVGVVEHGLFLNMVSKVVVGSEKGVEILDAIRHK

SEQ ID NO: 329 - protein, 231 aa, Enterococcus faecium
MDAKMNLKQLAGIEAAKFVKDGMIVGLGTGSTAYYMVEEIGRRMREEGLRITGVTTSNATKEQAEKLGIPLKSIDEVPVVDLTIDGADEISADFQGIKGGGAALLFEKIVATYSKETIWIVDSSKLVHKLGKFPLPVEVIPYGSQQLLHIFDEKGFQPVLRTDENGEVLTTDGGHYIIDLHLEVIEQPESLATYLDELVGVVEHGLFLNMVSKVVVGSEKGVEILDAIRHK

SEQ ID NO: 330 - protein, 226 aa, Enterococcus faecalis
MNLKQMVGIEAAKYVEDGMIVGLGTGSTAKFMVDEIGRRVKEEGLSIVGVTTSKETEKQALALGIPLKSIDEVPYVDLTIDGADEISADFQGIKGGGAALLFEKIVATYSKKCIWIVDKSKMVDDLGAFPLPVEVVPYGSRQLVHLFEEKGYHPTLRLNAAGETLITDGGHHIIDLHLEKITDPEALGSYLDNLVGVVEHGLFLNMVSMVIVGYEDGPKTLHVPAR

SEQ ID NO: 331 - protein, 226 aa, Enterococcus faecalis
MNLKQMVGIEAAKYVEDGMIVGLGTGSTAKFMVDEIGRRVKEEGLSIVGVTTSKETEKQALALGIPLKSIDEVPYVDLTIDGADEISADFQGIKGGGAALLFEKIVATYSKKCIWIVDKSKMADDLGAFPLPVEVVPYGSRQLVHLFEEKGYHPTLRLNAAGETLITDGGHHIIDLHLEKITDPEALGSYLDNLVGVVEHGLFLNMVSMVIVGYEDGPKTLHVPAR

SEQ ID NO: 332 - protein, 226 aa, Enterococcus faecalis
MNLKQMVGIEAAKYVEDGMIVGLGTGSTAKFMVDEIGRRIKEEGLSIVGVTTSKETEKQALALGIPLKSIDEVPYVDLTIDGADEISADFQGIKGGGAALLFEKIVATYSKKCIWIVDKSKMVDDLGAFPLPVEVVPYGSRQLVHLFEEKGYHPTLRLNAAGETLITDGGHHIIDLHLEKITDPEALGSYLDNLVGVVEHGLFLNMVSMVIVGYEDGPKTLHVPAR

SEQ ID NO: 333 - protein, 226 aa, Enterococcus faecalis
MNLKQMVGIEAAKYVEEGMIVGLGTGSTAKFMVDEIGRRVKEEGLSIVGVTTSKETEKQALALGIPLKSIDEVPYVDLTIDGADEISADFQGIKGGGAALLFEKIVATYSKKCIWIVDKSKMVDDLGAFPLPVEVVPYGSRQLVHLFEEKGYHPTLRLNAAGETLITDGGHHIIDLHLEKITDPEALGSYLDNLVGVVEHGLFLNMVSMVIVGYEDGPKTLHVPAR

SEQ ID NO: 334 - protein, 226 aa, Enterococcus faecalis
MNLKQMVGIEAAKYVEDGMIVGLGTGSTAKFMVDEIGRRVKEEGLSIVGVTTSKETEKQALALGIPLKSIDEVPYVDLTIDGADEISADFQGIKGGGAALLFEKIVATYSKKCIWIVDKSKMVDDLGAFPLPVEVVPYGSCQLVHLFEEKGYHPALRLNAAGETLITDGGHHIIDLHLEKITDPEALGSYLDNLVGVVEHGLFLNMVSMVIVGYEDGPKTLHVPAR

SEQ ID NO: 335 - protein, 226 aa, Enterococcus faecalis
MNLKQMVGIEAAKYVEDGMIVGLGTGSTAKFMVDEIGRRVKEEGLSIVGVTTSKETEKQALALGIPLKGIDEVPYVDLTIDGADEISADFQGIKGGGAALLFEKIVATYSKKCIWIVDKSKMVDDLGAFPLPVEVVPYGSCQLVHLFEEKGYHPALRLNAAGETLITDGGHHIIDLHLEKITDPEALGSYLDNLVGVVEHGLFLNMVSMVIVGYEDGPKTLHVPAR

SEQ ID NO: 336 - protein, 226 aa, Enterococcus faecalis
MNLKQMVGIEAAKYVEDGMIVGLGTGSTAKFMVDEIGRRVKEEGLSIVGVTTSKETEKQALALGIPLKSIDEVPYVDLTIDGADEISADFQGIKGGGAALLFEKIVATYSKKCIWIVDKSKMVDDLGAFPLPVEVVPYGSCQLVHLFKEKGYHPALRLNAAGETLITDGGHHIIDLHLEKITDPEALGSYLDNLVGVVEHGLFLNMVSMVIVGYEDGPKTLHVPAR

SEQ ID NO: 337 - protein, 226 aa, Enterococcus faecalis
MNLKQMVGIEAAKYVEDGMIVGLGTGSTAKFMVDEIGRRVKEEGLSIVGVTTSKETEKQALALGIPLKSIDEVPYVDLTIDGADEISADFQGIKGGGAALLFEKIVATYSKKCIWIVDKSKMVDDLGAFPLPVEVVPYGSRQLVHLFEEKGYHPALRLNAAGETLITDGGHHIIDLHLEKITDPEALGSYLDNLVGVVEHGLFLNMVSMVIVGYEDGPKTLHVPAR

SEQ ID NO: 338 - protein, 224 aa, Enterococcus faecalis
MKQMVGIEAAKYVEDGMIVGLGTGSTAKFMVDEIGRRIKEEGLSIVGVTTSKETEKQALALGIPLKSIDEVPYVDLTIDGADEISADFQGIKGGGAALLFEKIVATYSKKCIWIVDKSKMVDDLGAFPLPVEVVPYGSRQLVHLFEEKGYHPTLRLNAAGETLITDGGHHIIDLHLEKITDPEALGSYLDNLVGVVEHGLFLNMVSMVIVGYEDGPKTLHVPAR

SEQ ID NO: 339 - protein, 224 aa, Enterococcus faecalis
MKQMVGIEAAKYVEDGMIVGLGTGSTAKFMVDEIGRRVKEEGLSIVGVTTSKETENQALALGIPLKSIDEVPYVDLTIDGADEISADFQGIKGGGAALLFEKIVATYSKKCIWIVDKSKMVDDLGAFPLPVEVVPYGSRQLVHLFEEKGYHPTLRLNAAGETLITDGGHHIIDLHLEKITDPEALGSYLDNLVGVVEHGLFLNMVSMVIVGYEDGPKTLHVPAR

SEQ ID NO: 340 - protein, 224 aa, Enterococcus faecalis
MKQMVGIEAAKYVEDGMIVGLGTGSTAKFMVDEIGRRVKEEGLSIVGVTTSKETEKQALALGIPLKSIDEVPYVNLTIDGADEISADFQGIKGGGAALLFEKIVATYSKKCIWIVDKSKMVDDLGAFPLPVEVVPYGSCQLVHLFKEKGYHPALRLNAAGETLITDGGHHIIDLHLEKITDPEALGSYLDNLVGVVEHGLFLNMVSMVIVGYEDGPKTLHVPAR

SEQ ID NO: 341 - protein, 224 aa, Enterococcus casseliflavus
MNLKEMVGIEAASYVKDGMVVGLGTGSTAYYMIEELGRRVKEEGLSITGVPTSWASKKQAEGLGIPIRTIDEVDAVDLTIDGADEISQDYHGIKGGGAALLFEKIVASNSKKVLWIVDESKMVETLGAFPLPVEVIPYGSQQLLRLFEKKNYHPKLRLNEEGEPLKTDCSNYIIDLHLETITAPTELAQELDATVGVVEHGLFLDMVHTIIVGLPEGPSTKHVR

SEQ ID NO: 342 - protein, 224 aa, Enterococcus casseliflavus
MNLKEMVGIEAASYVKDGMVVGLGTGSTAYYMIEELGRRVKEEGLSITGVPTSWASKKQAEGLGIPIRTIDEVDAVDLTIDGADEISKDYHGIKGGGAALLFEKIVASNSKKVLWIVDESKMVETLGAFPLPVEVIPYGSQQLLRLFEKKNYHPKLRLNEEGEPLKTDCSNYIIDLHLETITAPTELAQELDATVGVVEHGLFLDMVHTIIVGLPEGPSTKHVR

SEQ ID NO: 343 - protein, 224 aa, Enterococcus gallinarum
MNLKEMVGIEAASYVTDGMVVGLGTGSTAYYMIEELGRRVKEENLSIVGVPTSWASKKQAESLGIPVKTIDEVASVDLTIDGADEISGDYHGIKGGGAALLFEKIVATYSKKVLWIVDKSKIVEKLGAFPLPVEVIPYGSQQLMRLFTEKNYHPVLRLAEDGTPLKTDCGHYIIDLHLQTINEPVALAHELDQTVGVVEHGLFLDMVHTIIIGQEDGPETRSVR

SEQ ID NO: 344 - protein, 223 aa, Carnobacterium sp. AT7
MNLKQLVGEKAAEYVKDGMVVGLGTGSTAYYMVEALGKRVKEGLTITGVTTSTRTKEQAEKLGIPLKTIDEVESVDLTIDGADEIDSKYQGVKGGGGALLFEKIVADYSKKVIWIVDESKMVETLGAFPLPIEVMPYGSQQLVRIFEEKGFQPTMRKNDVGGNYLTDGGHYIIDLHMTKIEDPHSLATWLDGLTGVMEHGLFLDRVNTIIVGRNTGLEIIEAR

SEQ ID NO: 345 - protein, 227 aa, Streptococcus pneumoniae
MENLKKMAGITAAEFIKDGMVVGLGTGSTAYYFVEEIGRRIKEEGLQITAVTTSSVTSKQAEGLNIPLKSIDQVDFVDVTVDGADEVDSQFNGIKGGGGALLMEKVVATPSKEYIWVVDESKLVEKLGAFKLPVEVVQYGAEQVFRHFERAGYKPSFREKDGQRFVTDMQNFIIDLALDVIENPIAFGQELDHVVGVVEHGLFNQMVDKVIVAGRDGVQISTSKKGK

SEQ ID NO: 346 - protein, 227 aa, Streptococcus pneumoniae
MENLKKMAGIKAAEFVSDGMVVGLGTGSTAYYFVEEIGRRIKEEGLQITAVTTSSVTTKQAEGLNIPLKSIDQVDFVDVTVDGADEVDSQFNGIKGGGGALLMEKVVATPSKEYIWVVDESKLVEKLGAFKLPVEVVQYGAEQVFRHFERAGYKPSFREKDGQRFVTDMQNFIIDLALDVIENPIAFGQELDHVVGVVEHGLFNQMVDKVIVAGRDGVQISTSKKGK

SEQ ID NO: 347 - protein, 227 aa, Streptococcus pneumoniae
MENLKKMAGIKAAEFVSDGMVVGLGTGSTAYYFVEEIGRRIKEEGLQITAVTTSSVTTKQAEGLNIPLKSIDQVDFVDVTVDGADEVDSQFNGIKGGGGALLMEKVVATPSKEYIWVVDESKLVEKLGAFKLPVEVVQYGADQVFRHFERAGYKPSFREKDGQRFVTDMQNFIIDLALDVIENPIAFGQELDHVVGVVEHGLFNQMVDKVIVAGRDGVQISTSKKGK

SEQ ID NO: 348 - protein, 227 aa, Streptococcus pneumoniae
MENLKKMAGIKAAEFVKDGMVVGLGTGSTAYYFVEEIGRRIKEEGLQIIAVTTSSVTTKQAEGLNIPLKSIDQVDFVDVTVDGADEVDSQFNGIKGGGGALLMEKVVATPSKEYIWVVDESKLVEKLGAFKLPVEVVQYGAEQVFRRFERAGYKPSFREKDGQRFVTDMQNFIIDLALDVIENPIAFGQELDHVVGVVEHGLFNQMVDKVIVAGRDGVQISTSKKGK

SEQ ID NO: 349 - protein, 221 aa, Streptococcus pneumoniae
MAGITAAEFIKDGMVVGLGTGSTAYYFVEEIGRRIKEEGLQITAVTTSSVTSKQAEGLNIPLKSIDQVDFVDVTVDGADEVDSQFNGIKGGGGALLMEKVVATPSKEYIWVVDESKLVEKLGAFKLPVEVVQYGAEQVFRHFERAGYKPSFREKDGQRFVTDMQNFIIDLALDVIENPIAFGQELDHVVGVVEHGLFNQMVDKVIVAGRDGVQISTSKKGK

SEQ ID NO: 350 - protein, 246 aa, Streptococcus pneumoniae
MNKKRFHSKIRTENDGGKSVENLKKMAGIKAAEFVSDGMVVGLGTGSTAYYFVEEIGRRIKEEGLQITAVTTSSVTTKQAEGLNIPLKSIDQVDFVDVTVDGADEVDSQFNGIKGGGGALLMEKVVATPSKEYIWVVDESKLVEKLGAFKLPVEVVQYGAEQVFRHFERAGYKPSFREKDGQRFVTDMQNFIIDLALDVIENPIAFGQELDHVVGVVEHGLFNQMVDKVIVAGRDGVQISTSKKGK

SEQ ID NO: 351 - protein, 227 aa, Streptococcus sp. M143
MENLKKMAGIKAAEFVKDGMVVGLGTGSTAYYFVEEIGRRIKEEGLQITAVTTSSVTSKQAEGLNIPLKSIDQVDFVDVTVDGADEVDSQFNGIKGGGGALLMEKVVATPSKEYIWVVDESKLVEKLGAFKLPVEVVQYGSEQVFRRFERAGYKPSFREKDGQRFVTDMQNFIIDLALDVIEDPIAFGQELDHVVGVVEHGLFNQMVDKVIVAGRDGVQILTSTKGK

SEQ ID NO: 352 - protein, 227 aa, Streptococcus pneumoniae
MENLKKMAGIKAAEFVSDGMVVGLGTGSTAYYFVEEIGRRIKEEGLQITAVTTSSVTSKQAEGLNIPLKSIDQVDFVDVTVDGADEVDSQFNGIKGGGGALLMEKIVATPSKEYIWVVDESKLVDKLGAFKLPVEVVQYGAEQIFRRFERAGYKPSFREKDGQRFVTDMQNFIIDLALDVIEDPIVFGQELDHVVGVVEHGLFNQMVDKVIVAGRDGVQILTSRKEK

SEQ ID NO: 353 - protein, 208 aa, Streptococcus pneumoniae
MENLKKMAGIKAAEFVSDGMVVGLGTGSTAYYFVEEIGRRIKEEGLQITAVTTSSVTTKQAEGLNIPLKSIDQVDFVDVTVDGADEVDSQFNGIKGGGGALLMEKVVATPSKEYIWVVDESKLVEKLGAFKLPVEVVQYGAEQVFRHFERAGYKPSFREKDGQRFVTDMQNFIIDLALDVIENPIAFGQELDHVVWCCGAWFIQPNGG

SEQ ID NO: 354 - protein, 225 aa, Streptococcus gordonii
MENLKKMAGIKAAEFVTDGMVVGLGTGSTAYYFVEEIGRRIKEEGLQIIAVTTSSVTSQQAEGLGIPLKSIDEVDLVDVTVDGADEVDPNFNGIKGGGGALLMEKVVATPTKSYIWVVDESKLVEKLGAFKLPVEVVQYGAEQVFRRFERAGYKPAFRQKDGQRFVTDMKNFIIDLDLGVIENPIEFARELDHIVGIVEHGLFNQMVDKVIVAGKAGVQVLEANK

SEQ ID NO: 355 - protein, 225 aa, Streptococcus sp. 2_1_36FAA
MENLKKMAGIKAAEFVTDGMVVGLGTGSTAYYFVEEIGRRIKEEGLQIIAVTTSSVTSQQAEGLGIPLKSIDEVDLVDVTVDGADEVDPNFNGIKGGGGALLMEKVVATPTKCYIWVVDESKLVEKLGAFKLPVEVVQYGAEQVFRRFERAGYKPAFRQKDGQRFVTDMKNFIIDLDLGVIENPIEFARELDHIVGVVEHGLFNQMVDKVIVAGKAGVQVLEANK

SEQ ID NO: 356 - protein, 225 aa, Streptococcus sanguinis SK36
MENLKKLAGIKAAEFVQSGMIVGLGTGSTAYYFVEEIGRRIKEEGLQITAVTTSSVTSKQAEGLGIPLKSIDDVDQVDVTVDGADEVDSAFNGIKGGGGALLMEKVVAVPTKHYIWVVDESKMVEKLGAFKLPVEVVQYGAEQLFRRFERAGYKPAFREKDDQRFVTDMQNFIIDLDLGVIENSVEFAQELDHVVGVVEHGLFNQMVDKVIVAGKSGLQVLEANK

SEQ ID NO: 357 - protein, 226 aa, Streptococcus thermophilus
MDELKKLAGVYAAGFVEDGMVVGLGTGSTAYFFVEEIGRRIKEEGLSVVGVTTSSQTTKQAEGLGIPLKSVDDIDSIDVTVDGADEVDPQLNGIKGGGGALLMEKIVATPTKKYIWVVDESKMVDQLGAFKLPVEVVQYGADRLYLDFESKGYKPSFRVTEQGDRFVTDMKNFIIDLDLGKINNPVALGDELKAMTGVVEHGLFNGMVNKVIVAGKDGVKIVEVKD

SEQ ID NO: 358 - protein, 226 aa, Streptococcus thermophilus
MDELKKLAGVYAAGFVEDGMVVGLGTGSTAYFFVEEIGRRIKEEGLSVVGVTTSTQTTKQAEGLGIPLKSVDDIDSIDVTVDGADEVDPQLNGIKGGGGALLMEKIVATPTKKYIWVVDESKMVDQLGAFKLPVEVVQYGADRLYLDFESKGYKPSFRVTEQGDRFVTDMKNFIIDLDLGKINNPVALGDELKAMTGVVEHGLFNGMVNKVIVAGKDGVKIVEVKD

SEQ ID NO: 359 - protein, 226 aa, Streptococcus salivarius
MEELKKIAGVTAAKYVEDGMVVGLGTGSTAYFFVEEIGRRIKEEGLSVVGVTTSSQTTKQAEGLGIPLKAVDDIDSIDVTVDGADEVDPQLNGIKGGGGALLMEKIVATPTKEYIWVVDESKMVDQLGAFKLPVEVVQYGADRLYRVFESKGYKPSFRLTEQGDRFVTDMKNYIIDLDLGKIENPVALGEELKAMTGVVDHGLFNGMVNKVIVAGKDGVKVVEVKA

SEQ ID NO: 360 - protein, 218 aa, Streptococcus infantarius subsp. infantarius ATCC BAA-102
MAGVTAAQYVKDGMVVGLGTGSTAYFFVEEIGRRMKEEGLKVVGVTTSSQTTAQAEGLGIPLKAVDDIDVIDVTVDGADEVDKNFNGIKGGGGALLMEKIVATPSKEYIWVVDESKMVDTLGAFKLPVEVVQYGADRIFREFEKKGYKPSYRMANGERFVTDMKNYIIDLDLGAIKNPVELGKELKAMVGVVEDGLFNGMVNKVIVAGKDGVKILEAK

SEQ ID NO: 361 - protein, 225 aa, Streptococcus mutans
MEELKKIAGVRAAQYVEDGMIVGLGTGSTAYYFVEEVGRRVQEEGLQVIGVTTSSRTTAQAQALGIPLKSIDEVDSVDVTVDGADEVDPNFNGIKGGGGALLMEKIVGTLTKDYIWVVDESKMVDTLGAFRLPVEVVQYGAERLFREFEKKGYKPSFREYDGVRFVTDMKNFIIDLDLGSIPDPIAFGNMLDHQVGVVEHGLFNGMVNRVIVAGKDGVRILEANK

SEQ ID NO: 362 - protein, 227 aa, Streptococcus pyogenes
MEALKKIAGVTAAQYVTDGMTIGLGTGSTAYYFVEEIGRRVKQEGLQVVGVTTSSVTSKQAEGLGIPLKSIDDIDSIDLTVDGADEVDKDFNGIKGGGAALLMEKIVATPTKEYIWVVDASKMVEHLGAFKLPVEVVQYGADRLFRVFEKAGYKPSFRMKGDSRLVTDMQNYIIDLDLGCIKDPVAFGHLLDGTVGVVEHGLFNGMVDKVIVASKDGVTVLEAPKAS

SEQ ID NO: 363 - protein, 227 aa, Streptococcus pyogenes
MEALKKIAGVTAAQYVTDGMTIGLGTGSTAYYFVEEIGRRVKQEGLQVVGVTTSSVTSKQAEGLGIPLKSIDDIDSIDLTVDGADEVDKDFNGIKGGGAALLMEKIVATPTKEYIWVVDASKMVEHLGAFKLPVEVVQYGADRLFRVFEKAGYKPSFRMKGDSRLVTDMQNYIIDLDLGCIKDPVAFGHLLDGTVGVVEHGLFNGMVDKVIVASKDGVTVLEAPKAG

SEQ ID NO: 364 - protein, 227 aa, Streptococcus pyogenes
MKALKKIAGVTAAQYVTDGMTIGLGTGSTAYYFVEEIGRRVKQEGLQVVGVTTSSVTSKQAEGLGIPLKSIDDIDSIDLTVDGADEVDKDFNGIKGGGAALLMEKIVATPTKEYIWVVDASKMVEHLGAFKLPVEVVQYGADRLFRVFEKAGYKPSFRMKGDSRLVTDMQNYIIDLDLGCIKDPVAFGHLLDGTVGVVEHGLFNGMVDKVIVASKDGVTVLEAPKAG

SEQ ID NO: 365 - protein, 227 aa, Streptococcus pyogenes
MEALKKIAGVTAAQYVTDGMTIGLGTGSTAYYFVEEIGRRVKQEGLQVVGVTTSSVTSKQAEGLGIPLKSIDDIDSIDLTVDGADEVDKDFNGIKGGGAALLMEKIVATPTKEYIWVVDASKMVEHLGAFKLPVEVVQYGADRLFRVFEKAGYKPSFRMKGDSRLVTDMQNYIIDLDLGCIKDPVAFGHLLDGTVGVVEHGLFNGMVDKVIVASKDGVIVLEAPKAG

SEQ ID NO: 366 - protein, 227 aa, Streptococcus pyogenes
MEALKKIAGVTAAQYVTDGMTIGLGTGSTAYYFVEEIGRRVKQEGLQVVGVTTSSVTSKQAEVLGIPLKSIDDIDSIDLTVDGADEVDKDFNGIKGGGAALLMEKIVATPTKEYIWVVDASKMVEHLGAFKLPVEVVQYGADRLFRVFEKAGYKPSFRMKGDSRLVTDMQNYIIDLDLGCIKDPVAFGHLLDGTVGVVEHGLFNGMVDKVIVASKDGVTVLEVPKAS

SEQ ID NO: 367 - protein, 227 aa, Streptococcus pyogenes
MEALKKIAGVTAAQYVTDGMTIGLGTGSTAYYFVEEIGRRVKQEGLQVVGVTTSSVTSKQAEVLGIPLKSIDDIDSIDLTVDGADEVDKDFNGIKGGGAALLMEKIVATPTKEYIWVVDASKMVEHLGAFKLPVEVVQYGADRLFRVFEKAGYKPSFRMKGDSRLVTDMQNYIIDLDLGCIKDPVAFGHLLDGTVGVVEHGLFNGMVDKVIVASKDGVTVLEAPKAG

SEQ ID NO: 368 - protein, 227 aa, Streptococcus pyogenes
MEALKKIAGVTAAQYVTDGMTIGLGTGSTAYYFVEEIGRRVKQEGLQVVGVTTSSVTSKQAEVLGIPLKSIDDIDSIDLTVDGADEVDKNFNGIKGGGAALLMEKIVATPTKEYIWVVDASKMVEHLGAFKLPVEVVQYGADRLFRVFEKAGYKPSFRMKGDSRLVTDMQNYIIDLDLGCIKDPVAFGHLLDGTVGVVEHGLFNGMVDKVIVASKDGVTVLEAPTAG

SEQ ID NO: 369 - protein, 227 aa, Streptococcus dysgalactiae
MEALKKIAGVTAAQYVTDGMTIGLGTGSTAYYFVEEIGRRVKEEGLQVVGVTTSSVTSKQAESLGIPLKSVDDIDSIDLTVDGADEVDKDFNGIKGGGAALLMEKIVATPTKEYIWVVDDSKMVEHLGAFKLPVEVVQYGADRLLRVFEKAGYKPSFRMKGDSRLVTDMQNYIIDLDMGCIEDPLAFGHLLDGTVGVVEHGLFNGMVDKVIVASKSGVTVLEAPKVG

SEQ ID NO: 370 - protein, 227 aa, Streptococcus equi
MEALKKLAGVTAAQYVTDGMTIGLGTGSTAYYFVEEIGRRIKEEGLQVVGVTTSSVTTKQAEGLGIPLTSIDDIDCIDLTVDGADEVDKAFNGIKGGGAALLMEKIVATPTKEYIWVVDESKLVDHLGAFKLPVEVVQYGADRLFRVFERAGYKPSFRMKGDKRLITDMQNFIIDLDLGCIENPCEFGRLLDQTVGVVEHGLFNGMVDKVIVAGQAGVTVLEANQST

SEQ ID NO: 371 - protein, 227 aa, Streptococcus equi
MEALKKIAGVTAAQYVTDGMTIGLGTGSTAYYFVEEIGRRIKEEGLQVVGVTTSSVTTKQAEGLGIPLTSIDDIDCIDLTVDGADEVDKAFNGIKGGGAALLMEKIVATPTKEYIWVVDESKLVDHLGAFKLPVEVVQYGADRLFRVFERAGYKPSFRMKGDKRLITDMQNFIIDLNLGCIENPCEFGRLLDQTVGVVEHGLFNGMVDKVIVAGQAGVTVLEANQST

SEQ ID NO: 372 - protein, 227 aa, Streptococcus equi
MEALKKLAGVTAAQYVTDGMTIGLGTGSTAYYFVEEIGRRIKEEGLQVVGVTTSSVTTKQAEGLGIPLTSIDDIDCIDLTVDGADEVDKAFNGIKGGGAALLMEKIVATPTKEYIWVVDESKLVDHLGAFKLPVEVVQYGADRLFRVFERAGYKPSFRMKGDKRLITDMQNFIIDLDLGCIENPFDFGRLLDQTVGVVEHGLFNGMVDKVIVAGQAGVTVLEANQST

SEQ ID NO: 373 - protein, 226 aa, Streptococcus uberis
MEALKKMAGVTAAQYVKDGMIVGLGTGSTAYFFVEEIGRRVNEEGLQVVGVTTSSATTKQAESLGIPLKAVDEIDEIDLTVDGADEVDKEFNGIKGGGAALLMEKIVATPTKEYIWVVDESKMVEKLGAFKLPVEVVQYGAERLFRVFEKAGYNPSFRMKEDQKLITDMGNFIIDLDLKVIEKPFEFAEMLDKTVGVVEHGLFNGMVHKVIVAGKDGVKVLEAPSK

SEQ ID NO: 374 - protein, 223 aa, Streptococcus agalactiae
MDELKKLAGVTAAKYVKNGMIVGLGTGSTAYFFVEEIGRRVKEEGLQVVGVTTSNRTTEQARGLGIPLKSADDIDVIDVTVDGADEVDPDFNGIKGGGGALLMEKIVATPTKEYIWVVDESKLVETLGAFKLPVEVVRYGSERLFRVFKSKGYCPSFRETEGDRFITDMGNYIIDLDLKKIEDPKQLANELDHTVGVVEHGLFNGMVNKVIVAGKNGLDILEK

SEQ ID NO: 375 - protein, 223 aa, Streptococcus agalactiae
MDELKKLAGVTAAKYVKNGMIVGLGTGSTAYFFVEEIGRRVKEEGLQVVGVTTSNRTTEQARGLAIPLKSADDIDVIDVTVDGADEVDPDFNGIKGGGGALLMEKIVATPTKEYIWVVDESKLVETLGAFKLPVEVVRYGSERLFRVFKSKGYCPSFRETEGDRFITDMGNYIIDLDLKKIEDPKQLANELDHTVGVVEHGLFNGMVNKVIVAGKNGLDILEK

SEQ ID NO: 376 - protein, 223 aa, Streptococcus agalactiae
MDELKKLAGVTAAKYVKNGMIVGLGTGSTAYFFVEEIGRRVKEEGLQVVGVTTSNRTTEQARGLGIPLKSADDIDVIDVTVDGADEVDPDFNGIKGGGGALLMEKIVATPTKEYIWVVDESKLVETLGAFKLPVEVVRYGSERLFRVFKSKGYCPSFRETEGDRFITDMGNYIIDLDLKKIEDPKQLANELDHTVGVVEHGLFNSMVNKVIVAGKNGLDILEK

SEQ ID NO: 377 - protein, 223 aa, Streptococcus agalactiae
MDELKKLAGVTAAKYVKNGMIVGLGTGSTAYFFVEEIGRRVKEEGLQVIGVTTSNRTTEQARGLGIPLKSADDIDVIDVTVDGADEVDPDFNGIKGGGGALLMEKIVATPTKEYIWVVDESKLVETLGAFKLPVEVVRYGSERLFRVFKSKGYCPSFRETEGDRFITDMGNYIIDLDLKKIEDPKQLANELDHTVGVVEHGLFNGMVNKVIVASKNGLDILEK

SEQ ID NO: 378 - protein, 224 aa, Streptococcus suis
MTNLKEQVGIKAAEFVTDGMIVGLGTGSTAYYFVQEIGRRVAEEGLQITGVTTSHATAEHAASLGIPLKNIDEVEYVDLTVDGADEVDGDFNGIKGGGAALLMEKVVAVNSKDCIWIVDESKVVQTLGAFKLPVEVVQYGAENLFRLFEKKGYRPSFRMRNGEKHITDMQNFIIDLDLRRIEDTYALAEELDRTVGVVEHGLFIGLISKVIVGTPEGPNIIEKK

SEQ ID NO: 379 - protein, 224 aa, Streptococcus suis
MINLKEQVGIKAAEFVTDGMIVGLGTGSTAYYFVQEIGRRVAEEGLQITGVTTSHATAEHAASLGIPLKNIDEVEYVDLTVDGADEVDGDFNGIKGGGAALLMEKVVAVNSKDCIWIVDESKMVQTLGAFKLPVEVVQYGAENLFRLFEKKGYRPSFRMRNGKKHITDMQNFIIDLDLRRIEDTYALAEELDRTVGVVEHGLFIGLISKVIVGTPEGPNIIEKK

SEQ ID NO: 380 - protein, 224 aa, Lactococcus lactis
MDNLKKQVGIKAAEFVKSGMVVGLGTGSTAAYFVEELGRRIAEEQLEITGVTTSNVTSSQARALGIPLASIDEVDYVDLTVDGADEIDSSLNGIKGGGAALLMEKIVATYSKDYIWIVDESKLSENLGSFKIPVEVIPYGSQQVFKKFEAAGYAPTWRLNEENERLITDMHHFIIDLHISQIKEPEKLAEELDLMGGVVEHGLFNNMVKKVIVAGNEGVRIINK

SEQ ID NO: 381 - protein, 224 aa, Lactococcus lactis
MDNLKKQVGIKAAEFVKSGMVVGLGTGSTAAYFVEELGRRIAEEQLEITGVTTSNVTSSQARALGIPLASIDEVDYVDLTVDGADEIDSSLNGIKGGGAALLMEKIVATYSKDYIWIVDESKLSENLGSFKIPVEVIPYGSQQVFKKFEAAGYAPTWRLNEENERLITDMYHFIIDLHISQIKEPEKLAEELDLMVGVVEHGLFNNMVKKVIVAGNEGVRIINK

SEQ ID NO: 382 - protein, 224 aa, Lactococcus lactis
MENLKKQVGIKAAEFVKSGMVVGLGTGSTAAYFVEELGRRVAEEQLEITGVTTSSVTSEQAKALGIPLASIDEVDYVDLTVDGADEIDSHLNGIKGGGAALLMEKIVATYSKDYIWIVDESKLSENLGSFKVPVEVIRYGSEQLFKEFERAAYAPTWRLNEEGEKLITDMQHFIIDLHIAKIENPQKLADELDLMVGVVEHGLFNDMVKKVIVAGSDGVKIISQ

SEQ ID NO: 383 - protein, 224 aa, Lactococcus lactis
MENLKKQVGIKAAEFVKSGMVVGLGTGSTAAYFVEELGRRVAEEQLEITGVTTSSVTSEQAKALGIPLASIDEVDYVDLTVDGADEIDSHLNGIKGGGAALLMEKIVATYSKDYIWIVDESKLSENLGSFKVPVEVITYGSEQLFKEFERAAYAPTWRLNEEGEKLITDMQHFIIDLHIAKIENPQKLADELDLMVGVVEHGLFNGMVKKVIVAGSDGVKIISQ

SEQ ID NO: 384 - protein, 227 aa, Lactobacillus brevis
MTKQDELKQLVGQEAVKFIEDGMIVGLGTGSTVKFMVDALGKRVADEQLSIVGVPTSQRTKEQAAGLGIPTKGLDEVDHIDLTIDGADQIDKNFQGIKGGGAAHLWEKIVAINSTKNMWIVDKSKMVDQLGSFPLPLEVIPYGSQQLFKRLEKRGFNPVFRMKNNNYVTTDSNNYLIDLHLHKIDNPNKLALTLDQMTGIVEHGLFLNIVNTVIVGEDDGPKVLQAR

SEQ ID NO: 385 - protein, 227 aa, Lactobacillus buchneri
MTKQDELKQLVGQEAVKFIEDGMIVGLGTGSTVKFMVDALGKRVADEQLSIVGVPTSQRTKEQAAGLGIPTKGLDEVDHIDLTIDGADQIDKNFQGIKGGGAAHLWEKIVAINSTKNMWIVDKSKMVDQLGSFPLPLEVIPYGSQQLFKRLEKQGFNPVFRMKNNNYVTTDSNNYLIDLHLHKIDNPKELALTLDQMTGIVEHGLFLNIVNTVIVGEDDGPKVLQAR

SEQ ID NO: 386 - protein, 228 aa, Pediococcus pentosaceus
MDQNELKKLVGEEAVKFIEDGMTVGLGTGSTVKFMVDALGERVKNENLNIVGVPTSDRTAEQARSLGINVKSVDEVDHIDLTIDGADEISSDFQGIKGGGAAHLFEKIVATNSKKVMWIVDESKMVDHLGAFPLPLEVIPYGSKQVFKKLEKEGLHPEFRKNDAGEYVLTDSKNYVIDLHLGEIKHPHQLADYLIKQVGIVEQGLFLDMVNTVIVGRQNGPEVLTARP

SEQ ID NO: 387 - protein, 228 aa, Pediococcus acidilactici
MDQNELKKLVGNEAVKFIEDGMTVGLGTGSTVKFMVDALGKRVKEENLNIVGVPTSDRTAKQARDLGITVKSVDEVDHIDLTIDGADEISSDFQGIKGGGAAHLFEKIVATNSSKNMWIVDESKMVDKLGAFPLPLEVIPYGSKQVFKKLEAKGFNPEFRMDENGNHVLTDSKNYVIDLHLHEIDDPHALADYLIKQVGIVEQGLFLDTVNTVIVGRQDGPEVLQARP

SEQ ID NO: 388 - protein, 228 aa, Lactobacillus brevis
MDQNALKALVGQEAVKYVEDGMILGIGTGSTVRYMIDALGERVKNEGLHIIGVATSDRSAKQAESLGITIKELDEVDHLDLTIDGADEIDDNFQGIKGGGAAHLWEKIVAINSTKNMWIVDESKMVHHLGAFPLPLEVIPFGSSHVLEKLNKMGFNPSFRMTDTGEHVLTDSKNYIIDLHLGRIDHPHDLANTLNGIVGVVEHGLFLDTVNTVIVGRQDGPEVLNARD

SEQ ID NO: 389 - protein, 227 aa, Lactobacillus salivarius
MNQDELKQLVGTKAVEWIKDGMIVGLGTGSTVKYMVDALGKRVNEEGLDIVGVTTSIRTAEQAKSLGIVIKDIDEVDHIDLTIDGADEISSDFQGIKGGGAALLYEKIVATKSNKNMWIVDESKMVDDLGQFPLPVEVIPYGSGTVFKRFEEKGLNPKFRKNEDGSLLHTDSDNYIIDLHLGKIENPKELGDYLINQVGVVEHGLFLDIVNTVIVGRQDGPEVLEAR

SEQ ID NO: 390 - protein, 227 aa, Lactobacillus salivarius
MNQDELKQLVGTKAVEWIKDGMIVGLGTGSTVKYMVDALGKRVNEEGLDIVGVTTSIRTAEQAKSLGIVIKDIDEVDHIDLTIDGADEISSDFQGIKGGGAALLYEKIVATKSNKNMWIVDESKMVDDLGQFPLPVEVIPYGSGTVFKRFEEKGLNPEFRKNEDGSLLHTDSDNYIIDLHLGKIENPKELGDYLINQVGVVEHGLFLDIVNTVIVGRQDGPEVLEAR

SEQ ID NO: 391 - protein, 227 aa, Lactobacillus ruminis
MDQNELKSLVGKKSVEWIKDGMTVGLGTGSTVYYMVEELGRRVKDENLKITGVTTSIRTANQAKSLGIPLKSVDTVDHIDITIDGADEISSDFQGIKGGGAALLYEKIVATNSDKVMWIVDESKMVDKLGRFPLPVEVIPYGSQKIFERFEKKGLNPAFRKDDKGGLLLTDSDNYIIDLHLGQIDNPHELAEYLIHQVGVVEHGLFLDMVDTVIVGRQNGPEVLEAK

SEQ ID NO: 392 - protein, 227 aa, Lactobacillus plantarum
MNQDQLKQLVGQKAVEYIQDGMQVGLGTGSTVKFMVDALGERVKNEHLNIVGVSTSDRTAAQAKALGIPMKSVDEVDHLDLTIDGADEIADDFQGVKGGGAALLFEKIVAINSDKVMWIVDESKMVHQLGAFGLPVEVIPYGSQHVFEKMAARGYNPVFRKVNDELVRTDSNNIIIDLHIDPITDPHALAEDLIHMVGVVEHGLFLDMVNTVIVGHANGPEVIEARP

SEQ ID NO: 393 - protein, 229 aa, Lactobacillus casei
MNQNDLKQQAAQKAAELVKDGMTIGLGTGSTVYYLVKAIAQRVETEHVQLTGVATSIRTREQAESLGIPMKDLDEVDHIDLTIDGADEVDKHFQGIKGGGAAHLIEKVVAINSAQNIWIVDESKLVDTLGKFPLPLEVIPFGSGKLVQRLANEGLNPEYRLTNDGEKVLTDSDNFIVDLHLGRIEHPHLLASWLNEQVGLVEHGLFLDVVKKVVVGTENGPKILDAYRG

SEQ ID NO: 394 - protein, 229 aa, Lactobacillus paracasei
MNQNDLKQQAAQKAAELVKDGMTIGLGTGSTVYYLVKAIAQRVETEHIQLTGVATSIRTREQAESLGIHMKDLDEVDHIDLTIDGADEVDKHFQGIKGGGAAHLIEKVVAINSAQNIWIVDESKLVDTLGKFPLPLEVIPFGSGKLVQRLANEGLNPEYRLTNDGEKVLTDSDNFIVDLHLGRIEHPHLLASWLNEQVGLVEHGLFLDVVKKVVVGTENGPKILDAYRG

SEQ ID NO: 395 - protein, 229 aa, Lactobacillus rhamnosus
MDQNKLKQEAAQRAAEFVEDGMTIGLGTGSTVFYLVEAIAKRIKEEHLSLNGVATSIRTRKQAESLGIPMKELDGVDKIDLTIDGADEVDKHFQGIKGGGRSHLIEKIVAINSARNIWIVDETKLVDTLGKFPLPLEVIPFGSGKLLQRLADEGLKPAYRLNEDGSKALTDSKNYIIDLHLGRIEHPHLLAEWLNKQVGIVEHGLFLDLVKTVVVGTTHGPEILDAHRG

SEQ ID NO: 396 - protein, 229 aa, Lactobacillus rhamnosus
MDQDKLKQEAAQKAAEFVEDGMTIGLGTGSTVFYLVEAIAQRIKEEHLSLTGVATSVRTQKQAESLEIPMKALDDVDKIDLTIDGADEVDKHFQGIKGGGRSHLIEKIVAINSARNIWIVDETKLVDTLGKFPLPLEVIPFGSGKLLQRLADEGLKPAYRLNEDGSKALTDSKNYIIDLHLGRIEHPHLLAEWLNKQVGIVEHGLFLDLVKTVVVGTTHGPEILDAHRG

SEQ ID NO: 397 - protein, 240 aa, Lactobacillus rhamnosus
MKIIKRKGWLTMDQNKLKQEAAQRAAEFVEDGMTIGLGTGSTVFYLVEAIAKRIKEEHLSLNGVATSIRTRKQAESLGIPMKELDGVDKIDLTIDGADEVDKHFQGIKGGGRSHLIEKIVAINSARNIWIVDETKLVDTLGKFPLPLEVIPFGSGKLLQRLADEGLKPAYRLNEDGSKALTDSKNYIIDLHLGRIEHPHLLAEWLNKQVGIVEHGLFLDLVKTVVVGTTHGPEILDAHRG

SEQ ID NO: 398 - protein, 240 aa, Lactobacillus paracasei
MKATKRKGWLAMDQNKLKQEAAQRAAEFVEDGMTIGLGTGSTVVYLVEAIAQRIKDEHLNLTGVATSVRTRKQAESLGIPMKALDEVGQIDLTIDGADEVDKHFQGIKGGGRSHLIEKIVAINTARNIWIVDETKLVDTLGKFPLPLEVIPFGSGKLLQRLADEGLKPAYRLNEDGSKALTDSKNYIIDLHLGKIEHPHLLAEWLNKQVGIVEHGLFLDLVKTVVVGTTHGPEILDAHRG

SEQ ID NO: 399 - protein, 229 aa, Lactobacillus casei
MDQNKLKQEAAQRAAEFVEDGMTIGLGTGSTVVYLVEAIAQRIKDEHLNLTGVATSVRTRKQAESLGIPMKALDEVGQIDLTIDGADEVDKHFQGIKGGGRSHLIEKIVAINSARNIWIVDETKLVDTLGKFPLPLEVIPFGSGKLLQRLADEGLKPAYRLNEDGSKALTDSKNYIIDLHLGKIEHPHLLAEWLNKQVGIVEHGLFLDLVKTVVVGTTHGPEILDAHRG

SEQ ID NO: 400 - protein, 229 aa, Lactobacillus casei
MDQNKLKQEAAQRAAEFVEDGMTIGLGTGSTVVYLVEAIAQRIKDEHFNLTGVATSVRTRKQAESLGIPMKALDEVGQIDLTIDGADEVDKHFQGIKGGGRSHLIEKIVAINSARNIWIVDETKLVDTLGKFPLPLEVIPFGSGKLLQRLADEGLKPAYRLNEDGSKALTDSKNYIIDLHLGKIEHPHLLAEWLNKQVGIVEHGLFLDLVKTVVVGTTHGPEILDAHRG

SEQ ID NO: 401 - protein, 227 aa, Lactobacillus sakei subsp. sakei 23K
MDKNAMKKMAAERSVDYVEDNMILGLGTGSTVVYMVEALAKRVKAENLHLTCVCTSIRTAEQATSLGIPVKALNEVDHIDLTIDGADEVDDNFQGIKGGGAAHLFEKLVATTSTRNIWIVDEEKVVDTIGRFPLPVEVIPFGSQQVFNKFVKEGLNPEFRTTEDGQRVLTDSKNEVIDLHLEKITHPHLLATWLSEQVGVVEHGLFLDLVNEVVVGSPEGVKILKAR

SEQ ID NO: 402 - protein, 227 aa, Leuconostoc citreum
MSQALQKIIAGRRAAEFVQNGMVVGIGSGSTIAHVIEALGERVAQEQLNIVGVATSEKTRRNAAQLGIPMYNVDDIDKIDLTIDGADQIADDFSAIKGGGAALLWEKIVAFNSRQNIWVVDETKRVTKLNQYLPVEVIPYGANQLFKRFQADGFHPTWRLDQNGNPVRTDSANFLIDLHLPMIDNPRDLGDELIKMVGVVEHGLFTDVVNRVIIGTDSQTAKVIDVK

SEQ ID NO: 403 - protein, 228 aa, Leuconostoc mesenteroides
MSSSQDLQKIIAGRRAADFVQDGMVVGIGSGSTIAQVITALGERVANENLKIVGVPTSEKTRRNAAKLGIPMYNVDDVDKIDLTIDGADQISDDFSAIKGGGAALLWEKIVAFNSRENIWVVDSSKRVSKLNQYLPVEIIPYGSDQLFKRFTADGFHPTWRLDQNGNPVRTDSANYLIDLHVPVIEDPRDLGQELINMVGVVEHGLFTDVVNRVVIGSDDGVEIIEAP

SEQ ID NO: 404 - protein, 233 aa, Weissella paramesenteroides
MADQTALKKLAGYRAAEFVEDGMVVGIGSGSTIAFVVEALGKRVAEEGLQIKGIPTSDKTRRTAAKLGIPMHNVDDVDHIDLTIDGADQIDENFAAIKGGGAALLWEKIVAVNSRRNIWVVDDTKLAPQLTHYLPVEVIPYGADQLFKRLKYAGYQPTWRLDQNGNPVRTDSANYLIDLHFTKMPDPFKLGRELTSMVGVVEHGLFLNIVDQVVVGRADETIAVFDAHPKPLI

SEQ ID NO: 405 - protein, 227 aa, Lactobacillus reuteri
MDQNALKEQTGKESVKYIKSGMIVGLGTGSTVKYMVDELGKQVQEGKIKDIIGVTTSNRTAKQARDLGITIKDIDDVDHIDLTIDGADEISDDFQGIKGGGGALLWEKIVANASNKVMWIVDESKLVHKLGAFPLPVEVIPFGSQHVFDRLEKKGYKPTWRMDGDKKFRTDENNYIIDLHLGEIDDPKALADELIHMVGIVETGLFLNRVNDVIVGTSEGPKVLHAR

SEQ ID NO: 406 - protein, 227 aa, Lactobacillus reuteri
MDQNALKEQTGKESVKYIKSGMIVGLGTGSTVKYMVDELGKQVQEGKIKDIIGVTTSNRTAKQARDLGITIKDIDDVDHIDLTIDGADEISDDFQGIKGGGGALLWEKIVANASNKVMWIVDESKLVHKLGAFPLPVEVIPFGSQHVFDRLEKKGYKPTWRMDGDKKFRTDENNYIIDLHLGEIDDPKALADELIHMVGIVETGLFLNRVNDVIVGTPEGPKVLHAR

SEQ ID NO: 407 - protein, 227 aa, Lactobacillus antri DSM 16041
MNQDELKAQTGRESVKYIQSGMIVGLGTGSTVRYMVDELGKQVQEGKLTDIIGVTTSTRTAKQARDLGITIKDIDDVDHIDLCIDGADEVSDDFQGIKGGGGALLWEKIVANASNKIIWIVDESKLVHKLGKFPLPVEVIPFGAQLVFNRLEKKGYKPSWRMDGDHKFLTDEKNYIIDLHLGEIDHPVELADELIHMVGLVETGLFLNRVNDVIVGTQDGPKVLHAR

SEQ ID NO: 408 - protein, 226 aa, Lactobacillus fermentum
MDQNELKALVGKEAVKYVEDGMIVGLGTGSTVRFMVDALGERVKNEGLKIVGVTTSRRTTKQATELGITIKDIDEVDHVDLTIDGADEVSNDFQGIKGGGGALLWEKVVNDASTKNIWIVDESKLVDKLGDFGVPVEVIPFGAAHVFRKFEKKGYQPQWRMDGDNRYLTDEKNYIIDLKMGKIDSPKTLAEDLIHTVGVVEHGLFLDRVNEVIVGRQDGPEVLHAR

SEQ ID NO: 409 - protein, 226 aa, Lactobacillus fermentum
MDQNELKALVGKEAVKYVEDGMIVGLGTGSTVRFMVDALGERVKNEGLKIVGVTTSRRTTKQATELGITIKDIDEVDHVDLTIDGADEVSNDFQGIKGGGGALLWEKVVNDASTKNIWIVDESKLVDKLGDFGVPVEVIPFGAAHVFRKFEKKGYQPQWRMDGDNRYLTDEKNYIIDLKMGKIDAPKTLAEDLIHTVGVVEHGLFLDRVNEVIVGRQDGPEVLHAR

SEQ ID NO: 410 - protein, 227 aa, Lactobacillus coleohominis 101-4-CHN
MDQNELKAQVSKEAVKYIQDGMIVGLGTGSTVRYMVDALGERVKNEGLKIIGVTTSNRTTKQAESLGITIKDIDDVDHIDLCIDGADEVDDDFNGIKGGGGALLWEKIVNNASTKKIWIVDQSKLVPRIGDFGVPVEVIPFGSQHVFNTFEKKGYKPVWRMDGDHKYRTDENNFIIDIHLGQIDDPHALAEDLIHTVGVVEHGLFLNRVDDVIVGRDNGPEVLHATK

SEQ ID NO: 411 - protein, 230 aa, Lactobacillus vaginalis
MNQDELKQQVGREAVKYIHPGMVVGLGTGTTVHCLVEALGEHVKNGDLSDVVCVTTSNRTTRQAQSLGIKVEEIDDVDHIDLTIDGADEISDDFQGIKGGGGALLWEKIVSNYSDHVMWIVDESKLVHHLGAFPLPVEVTPYGSQHLFTKLARRGYNPTWRMLPDNSDKFRTHQRNFIIDLHLEDINDPFALHEELIGMVGLIEDGLFLNQVNDVLVGTQDGPKFLHARP

SEQ ID NO: 412 - protein, 228 aa, Lactobacillus fermentum
MNQQDSLKQLVGQTAAKLVKNGMIVGLGTGSTVRFLVDALGKRVQEEGLAITGVTTSNRTTAQATSLGIKIVDLDDVDHVDLTIDGADEVDRDFYGIKGGGGALLWEKIVNDASTNNVWIVDQSKVVDRIGAFGVPVEVIPFGASKVFAKFEHQGYQPQWRTDEAGQLYRTDENNYIIDLKLGPLTDPLALAEDLINTVGVVEYGLFLNRVNQVIVGNEAGITTLTAP

SEQ ID NO: 413 - protein, 228 aa, Lactobacillus fermentum
MNQQDILKQLVGQTAAKLVKNGMIVGLGTGSTVRFLVDALGKRVQEEGLAITGVTTSNRTTAQATSLGIKIVDLDDVDHVDLTIDGADEVDRDFYGIKGGGGALLWEKIVNDASTNNVWIVDQSKVVDRIGAFGVPVEVIPFGASKVFAKFEHQGYQPQWRTDEAGQLYRTDENNYIIDLKLGPLTDPLALAEDLINTVGVVEHGLFLNRVNQVIVGNEAGITTLTAP

SEQ ID NO: 414 - protein, 228 aa, Lactobacillus fermentum
MNQQDSLKQLVGQTAAKLVKNGMIVGLGTGSTVRFLVDALGKRVQEEGLAITGVTTSNRTTAQATSLGIKIVDLDDVDHVDLTIDGADEVDRDFYGIKGGGGALLWEKIVNDASTNNVWIVDQSKVVDRIGAFGVPVEVIPFGASKVFAKFEHQGYQPQWRTDEAGQLYRTDENNYIIDLKLGPLTDLLALAEDLINTVGVVEHGLFLNRVNQVIVGNETGITTLTAP

SEQ ID NO: 415 - protein, 232 aa, Bifidobacterium adolescentis
MDKAQQDALKKAAGIEAAKLIQNGMIAGLGTGSTVRFLVDELGRRVKEEGLEFTGVTTSRRTQEQAEGYGIKIVNIDDVDHIDVTIDGADEVDKNFNGIKGGGAALLWEKIVATNSNKIVWIVDESKVVDTIGKFPLPVEVIPFGAGQVVKKFEAKGYKPVLRLDANGEPVRTDENNYVVDLHLERIDHPQELAQDLITTVGVVEHGLFLNMVDQVIVGDPNGPRVMDNPNK

SEQ ID NO: 416 - protein, 288 aa, Bifidobacterium adolescentis
MRGFFARHLTQDRETFRENFSAVQNRHLLPQPTIRALKINASDSMETVLTPYRRRIMDKAQQDALKKAAGIEAAKLIQNGMIAGLGTGSTVRFLVDELGRRVKEEGLEFTGVTTSRRTQEQAEGYGIKIVNIDDVDHIDVTIDGADEVDKNFNGIKGGGAALLWEKIVATNSNKIVWIVDESKVVDTIGKFPLPVEVIPFGAGQVVKKFEAKGYKPVLRLDANGEPVRTDENNYVVDLHLERIDHPQELAQDLITTVGVVEHGLFLNMVDQVIVGDPNGPRVMDNPNK

SEQ ID NO: 417 - protein, 264 aa, Bifidobacterium dentium
MPNVAPMTWLKPPKISASDSMEPVLIPYRRSIMDKAQQDALKKAAGIEAAKLIQSGMIAGLGTGSTVRFLVDELGRRVKEEGLEFTGVTTSRRTQEQAEGYGIKIVDIDDVDHIDVTIDGADEVDKDFNGIKGGGAALLWEKIVATNSNKIVWIVDESKVVDTIGKFPLPVEVIPFGAGQVIKKFESRGYKPVLRLDAEGQPVRTDENNYVVDLHLERIDHPEDLAEDLITTVGVVEHGLFLHMVDQVIVGDPNGPRVMTNSNK

SEQ ID NO: 418 - protein, 244 aa, Bifidobacterium pseudocatenulatum
METVLTPYRRRIMDKAQQDALKKAAGIEAAKLIQNGMIAGLGTGSTVRFLVDELGRRVQEEGLEFTGVTTSRRTQEQAEGYGIKIVDIDDVDHIDVTIDGADEVDKNFNGIKGGGAALLWEKIVATNSNKIVWIVDESKVVDTIGKFPLPVEVIPFGAGQVVKKFESRGYKPVLRLDAEGQPVRTDENNYVVDLHLECIEHPEALADDLINTVGVVEHGLFLHMVDQVIVGDPNGPRVLTNSNK

SEQ ID NO: 419 - protein, 244 aa, Bifidobacterium catenulatum
METVLTPYRRRIMDKAQQDALKKAAGIEAAKLIQNGMIAGLGTGSTVRFLVDELGRRVQEEGLEFTGVTTSRRTQEQAEGYGIKIVDIDDVDHIDVTIDGADEVDKNFNGIKGGGAALLWEKIVATNSNKIVWIVDESKVVDTIGKFPLPVEVIPFGAGQVVKRFEARGYKPVLRLDAEGKPVRTDENNYVVDLHLERIEHPEALADDLINTVGVVEHGLFLHMVDQVIVGDPNGPRVLTNSNK

SEQ ID NO: 420 - protein, 241 aa, Bifidobacterium bifidum
MHGHFKEYMMDKAQQDALKKAAGIEAAKLIENGMIAGLGTGSTVRFLVDELGRRVKEEGLQFTGVTTSRRTQEQAEGYGIKIVDIDDVDHIDITIDGADEVDKNFNGIKGGGAALLWEKIVATNSNKIVWIVDESKVVDTIGKFPLPVEVIPFGAGHVIKQFEAKNYKPVLRLDADGKEVRTDENNFVVDLHLERIDHPQDLAEDLINTVGVVEHGLFLNMVDKVIVGDPNGPRVMTNGNK

SEQ ID NO: 421 - protein, 232 aa, Bifidobacterium longum
MDKAQQDALKKAAGIEAAKLVENGMIAGLGTGSTVKFLVDELGRRHQEEGLEFTGVTTSRRTQVQAESYGIKIVDIDDVDHIDVTIDGADEVDKNFNGIKGGGAALLWEKIVATNSNQIVWIVDESKVVDTIGKFPLPVEVIPFGAGQVIKKFEARGYKPVLRLDADGKEVRTDENNFVVDLHLERIDHPQELAEDLINTVGVVEHGLFLNMVDKVIVGDPNGPRVMTNANK

SEQ ID NO: 422 - protein, 232 aa, Bifidobacterium longum
MDKAQQDALKKAAGIEAAKLVENGMIAGLGTGSTVKFLVDELGRRHQEEGLEFTGVTTSRRTQAQAESYGIKIVDIDDVDHIDVTIDGADEVDKNFNGIKGGGAALLWEKIVATNSNQIVWIVDESKVVDTIGKFPLPVEVIPFGAGQVIKKFEARGYKPVLRLDADGKEVRTDENNFVVDLHLERIDHPQELAEDLINTVGVVEHGLFLNMVDKVIVGDPNGPRVMTNANK

SEQ ID NO: 423 - protein, 232 aa, Bifidobacterium longum
MDKAQQDALKKAAGIEAAKLVENGMIAGLGTGSTVKFLVDELGRRHQEEGLEFTGVTTSRRTQAQAESYGIKIVDIDDVDHIDVTIDGADEVDKNFNGIKGGGAALLWEKIVATNSNQIVWIVDESKVVDTIGKFPLPVEVIPFGAGHVIKKFEACGYKPVLRLDADGKEVRTDENNFVVDLHLERIDHPQELAEDLINTVGVVEHGLFLNMVDKVIVGDPNGPRVMTNANK

SEQ ID NO: 424 - protein, 232 aa, Bifidobacterium angulatum
MDKAQQDAMKKAAGIEAAKLVHNGMIAGLGTGSTVRFLVDELGRRVQEEGLQFTGVTTSRRTQEQAESFGIKIVDIDDVDHIDVTIDGADEVDKDFNGIKGGGAALLWEKIVATNSNKIVWIVDESKVVDTIGKFPLPVEVIPFGAGQVVKKFEAKGYKPVLRLDADGKEVRTDENNFVVDLHLERIDHPTELAEDLINTVGVVEHGLFLNMVDTVIVGNPDGPRILTNSNK

SEQ ID NO: 425 - protein, 232 aa, Gardnerella vaginalis
MDKAQQDALKKAAGIEAAKIVQNGMMVGLGTGSTVRFLVDELGRRVKEEGLSFTGVTTSRRTQEQAEGYGIKILDINDVDHIDVTIDGSDEVDKNFDGIKGGGAALLWEKIVAINSDRIVWIVDASKVVDTIGKFPLPVEVIPFGSAQVIRKFEKRGYKPVLRLDADGKEVRTDENNFVVDLHLERIEHPQELAKDLIETVGVVEHGLFLNMVDTVIVGDPNGPRTLTNPNK

SEQ ID NO: 426 - protein, 232 aa, Bifidobacterium gallicum DSM 20093
MDKAQQDALKKAAGIEAAKLVKDGMIVGLGTGSTVRFLVDELGRRVQEEGLQFTGVTTSRRTQEQAEGYGIKIVNVDDVEEIDVTIDGADEVDDNFNGIKGGGAALLWEKIVAINSKKIVWIVDESKVVETIGKFPLPVEVIPFGHGHVVEKMEKKGYKPVLRLDADGNPVLTDEKNYVVDLHLEKIEKPFELQEDLINMVGVVETGLFLNMVDEVIVGDPDGPRILTNPNK

SEQ ID NO: 427 - protein, 233 aa, Bifidobacterium animalis
MDKAQQDAMKKEAGIEAAKLVKSGMIVGLGTGSTVRFLVDELGRRKQEEGLEFTGVTTSRRTQEQAEGYGIKIVNIDDVDHIDLCIDGADEVDKNFNGIKGGGAALLWEKIVAINSNRIVWIVDASKLVDVIGKFPLPVEVIPFGAMHVIERMKERGYNPTLRLDAEGKPVRTDENNYVVDLHLERIDDPAGLNEDLINMVGVVEDGLFLDMVNEVIVGDPNGPRTLINPNKA

SEQ ID NO: 428 - protein, 240 aa, Lactobacillus brevis
MSTINSELQNKLKKAAAVKAADYVKDGMIVGLGSGSTVTMLVDELGRRVQEKGLKFTGVSTSISTAKQAESLGIKIVDLDSIDAIDLTIDGADQVDSDFNGIKGGGGNLLWEKIVAANSKKLIWIVDKSKVVDRIGAFPLAVDVEPFGSHHVLKKFSDAGFNPVVRTDKDGKVFKTDSNNIILDLHLHEINNPDKLADTLINTVGVVEHGLFLNAVNEVVVGKEGAPQILINPKADPSYK

SEQ ID NO: 429 - protein, 240 aa, Lactobacillus hilgardii
MSTINSELQNKLKKAAAVKAADYVKDGMIVGLGSGSTVTMLVDELGRRVQEKGLKFTGVSTSISTAKQAESLGIKIVDLDSIDTIDLTIDGADQVDSDFNGIKGGGGNLLWEKIVAANSKKLIWIVDKSKVVDRIGAFPLAVDVEPFGSHHVLKKFSDAGFNPVVRTDKDGKVFKTDSNNIILDLHLHEINNPDKLADTLINTVGVVEHGLFLNAVNEVVVGKEGAPQILINPKADPSYK

SEQ ID NO: 430 - protein, 240 aa, Lactobacillus buchneri
MSTINSELQNKLKKAAAVKAADYVKDGMIVGLGSGSTVTMLVDELGRRVQEEGLKFTGVSTSISTAKQAESLGIKIVDLDSIDTIDLTIDGADQVDSNFNGIKGGGGNLLWEKIVAANSKKLIWIVDKSKVVDRIGAFPLAVDVEPFGSHHVLKKFSDAGFNPVVRTDKDGKVFKTDSNNIILDLHLHEINNPDKLADTLINTVGVVEHGLFLNAVNEVVVGKEGAPQILINPKADPSYQ

SEQ ID NO: 431 - protein, 240 aa, Lactobacillus brevis
MSTINSELQNKLKKAAAVKAADYVKDGMIVGLGSGSTVTMLVDELGRRVQEDGLNFTAVSTSISTAKQAESLGIKISDLDSIDTIDLTIDGADQVDSDFNGIKGGGGNLFWEKIVAANSKKLIWIVDQSKIVDRIGAFPLAVDVEPFGSHHVLKKFSDAGFNPVVRTDKNGKIFKTDSNNIILDLHLHKINDPDKLSNALINTVGVVEHGLFLNAVNEVVVGKEGAPQIMINSKAHPSYQ

SEQ ID NO: 432 - protein, 233 aa, Oenococcus oeni
MDAELQNKLKKEAARKAASYVKNGMVVGLGSGSTVKMLVDELGRRVKEEDLQFTGVATSIFTAQQAKSLGIKIVDLDMVDSIDLTIDGADQVDSNFNGIKGGGGNLLWEKIVAINSKKIVWVVDKSKVVDTIGAFPLAVDVIPFGSQHVMQNFDKAGYEPVLRLDKEGKPFKTDSNNLIIDLHLHKIEEPTQLADNLIQTVGVVEHGLFLNMVSEVVVGKEGQPEILVNPNIG

SEQ ID NO: 433 - protein, 232 aa, Oenococcus oeni
MEKNLQNELKKEAAIRAAEFVENDTVVGLGTGSTVKFLVDELGRKVREENLSFTGVTTSKRTASQAESLGIKIVSLDSIPRIDLTIDGADQVDNNFNGIKGGGAALLWEKIVATNSKKNIWIVDQSKLVDRIGSFPLPVEVIPFGALHVLNKFEELNLNPALRLTENGKKVMTDSQNYIIDLHLNQIIDPAKLSNQLINTVGVVEHGLFLNVVDKVVVGKKGQPLILENPDK

SEQ ID NO: 434 - protein, 232 aa, Oenococcus oeni
MEKNLQNELKKEAAIRAAEFVENDTVVGLGTGSTVKFLVDELGRKVREENLSFTGVTTSKRTASQAESLGIKIVSLDSIPRIDLTIDGADQVDNNFNGIKGGGAALLWEKIVATNSKKNIWIVDQSKLVDRIGSFPLPVEVIPFGALHVLNKFEELNLNPVLRLTENGKKVMTDSQNYIIDLHLNQIIDPAKLSNQLINTVGVVEHGLFLNVVDKVVVGKKGQPLILENPDK

SEQ ID NO: 435 - protein, 237 aa, Catonella morbi
MVDTKELVGRYAANYVKDGMVVGLGTGSTAYWFVEEVGARIADGRLKQIVGVATSRRTAEQALKLGITIMDLDRVNHIDLVVDGADEVTRDFYGIKGGGGALLHEKIVAKNAKRSIWVVGEDKLVDTLGAFPLPVEVVQFGSWNLFRQLMAAGLEPSFRKVGSDSLYMTDSGNYIIDLKLGQIPYPHQLAHELKNTVGVVEHGLFLDVCDTFLVGRADGTILLYQKDQTEPMTIEVS

SEQ ID NO: 436 - protein, 229 aa, Leuconostoc mesenteroides
MNKQKKHAGEFAATLIEDGMVVGLGTGSTIAYFLEALAKRIQDEKMTIIGVTTSTKTARCAEELGIPIRDIDLVPMIDLTIDGADEVDQHLNGIKGGGAAFLMEKIVARYSRRVIWIIDEQKLHSKLGQFPLPVEVVAFGSGKLIAELKERHLHPKLRLDNHQQPLVTDLGHYIVDLDLEQIDQPFELGRYLDGQIGIVEHGLFLNVADQVIIGQDEGYRIMNNLQKEM

SEQ ID NO: 437 - protein, 255 aa, Leuconostoc citreum
MVIVCHIRLLSIFFYFCYDRHMDNILMAKKKAAIAASKLVKDGMTVGLGTGSTIAFFLDALAERVQHEKLNIIGVTTSFKTADRAKELGIQIQDIDSAPMIDLTIDGADEVDTELNGIKGGGAAFLMEKIVAKNSKRVVWIVDSLKVHDKLGQFPLPVEVVPFGSGKLITEFEQHHLYPKLRTGADGQPVVTDMGHYIVDLDLQVIDQPYELSRYLDGRIGVVEHGLFLDIADEVIVGSQQGVSYLRRTDLQKKM

SEQ ID NO: 438 - protein, 278 aa, Weissella paramesenteroides
MFFSLKNFMIQILLVINIGSIVNTFIAIFFYALSVKLIYCQGEKEEHIVIDQQIIQKKQAGEFAATLITDGMIVGLGTGSTVRFFIEALAAKINNEGLNITGVTTSNKTSSLAKSLGIKLASVDEVPMIDLTIDGADEVDHQLNGIKGGGAALLFEKIVALNSKKNIWIIDESKYHEVIGQFPLPVEVVPYGSHHLLKKFLAADMQPTFRRTATGERVTTDVGNYIIDLHLNRIEYPQSLAYFLEQTIGVVEHGLFLKTVDEVIIGGNQPTLISNTKP

SEQ ID NO: 439 - protein, 231 aa, Leuconostoc mesenteroides
MNEKNFQKKQAALAALNYIQTDMIIGLGTGSTVSYFLDALAASQYNVIGVTTSTITSQRCAELNIPIVDIDAIDHIDVTVDGADEVDSYLNGIKGGGAALLMEKIVAKNSKKNIWIVDRSKVHNTLGSFPLPVEVIPYGSGQLLRQFANKGLFPKLRRHPGNNQPVITDAGHYIIDCHMTTINNPYALAEYLESQVGVVEHGLFLNICDRIIIGDNTVEIKERQQAHVEIN

SEQ ID NO: 440 - protein, 235 aa, Leuconostoc mesenteroides
MRLIMNEKNFQKKQAALAALNYIQTDMIIGLGTGSTVSYFLDVLAASQYNVIGVTTSTITSQRCAELNIPIVDIDAIDHIDVTVDGADEVDSYLNGIKGGGAALLMEKIVAKNSKKNIWIVDRGKVHNTLGSFPLPVEVIPYGSGQLLRQFANKGLFPKLRRHPGNNQPVITDAGHYIIDCHMTTINNPYALAEYLESQVGVVEHGLFLNICDRIIIGGDTVEIKERQQAHVEIN

SEQ ID NO: 441 - protein, 225 aa, Weissella paramesenteroides
MNINLQKKSAAQAAVNYIDEGMIVGLGTGSTANYFIEALSKKIKAANWHLTCVTTSTKSRQLAESLGIHVVSIDDVNHIDVTVDGVDEFDPQLNGIKGGGVALLFEKIVALSSNKNIWIVDTSKKSDKLGSFLLPVEIIPFGSVQLFTKLSQMNLKPQFRVDNQNQKVLTDSKNYIIDVDISHVSDIHKLADTLKSLTGIVEHGLFLDLCHTVIIGGEHIEKIDR

SEQ ID NO: 442 - protein, 230 aa, Lactobacillus helveticus
MAKTEQDRLKKEAAEKAASMVKSGMILGVGTGSTVAFFIDALGKRKDNDGLKLKAIVTTSNRSKKQLEGLGFKVSELADVDQVDLTVDGSDRVADNLDGIKGGGGALTLEKNVAINSKKIIWIVDESKLVHRLGGFPLPVEVLPISCEQNFKRFKQEGLKPQWRMDSDKRYITHYGNYIIDLAADPVPAPHGLADYLDHTVGVVEHGLFLDMCDEVIIAHSDGTIEDKIK

SEQ ID NO: 443 - protein, 230 aa, Lactobacillus helveticus
MAKTEQDRLKKEAAEKAASMVKSGMILGVGTGSTVAFFIDALGKRKDNDGLKLKAIVTTSNRSKNQLEGLGFKVSELADVDQVDLTVDGSDRVADNLDGIKGGGGALTLEKNVAINSKKIIWIVDESKLVHRLGGFPLPVEVLPISCEQNFKRFKQEGLKPQWRMDSDKRYITHYGNYIIDLAADPVPAPHGLADYLDHTVGVVEHGLFLDMCDEVIIAHSDGTIEDKIK

SEQ ID NO: 444 - protein, 230 aa, Lactobacillus crispatus
MNKQEQDRLKKEAAEKAAAMVKSGMVLGVGTGSTVAFFIDALGKRKDEDGLKLKAIVTTSNRSKKQLEGLGFKVSELADIDQADLTVDGADRVADNLDGIKGGGGALTLEKNVAINSKKIIWIVDESKLVHRLSGFPLPVEVLPISCEQNFKRFEQEGLKPRWRMDGNQRYVTHYGNYIIDLAADPVPAPHGLADYLDHTVGVVEHGLFLDMCDEVIIAHSDGTIEDKKK

SEQ ID NO: 445 - protein, 230 aa, Lactobacillus crispatus
MNKQEQDRLKKEAAEKAAAMVKSGMVLGVGTGSTVAFFIDALGKRKDEDGLKLKAIVTTSNRSKKQLEGLGFKVSELADIDQADLTVDGADRVTDNLDGIKGGGGALTLEKNVAINSKKIIWIVDESKLVHRLSGFPLPVEVLPISCEQNFKRFEQEGLKPRWRMDGNQRYVTHYGNYIIDLAADPVPAPHGLADYLDHTVGVVEHGLFLDMCDEVIIAHSDGTIEDKKK

SEQ ID NO: 446 - protein, 230 aa, Lactobacillus crispatus
MNKQEQDRLKKEAAEKAAAMVKSGMVLGVGTGSTVAFFIDALGKRKDEDGLKLKAIVTTSNRSKKQLEGLGFKVSELADIDQADLTVDGADRVADNLDGIKGGGGALTLEKNVAINSKKIIWIVDESKLVHRLSGFPLPVEVLPISCEQTFKRFEQEGLKPRWRMDGNQRYVTHYGNYIIDLAADPVPAPHGLADYLDHTVGVVEHGLFLDMCDEVIIAHSDGTIEDKKK

SEQ ID NO: 447 - protein, 230 aa, Lactobacillus acidophilus
MDKKEQDRLKKEAAEKAANMVQSGMILGVGTGSTVAFFIDALGKRKDEEDLKLKAIVTTSNRSKKQLESLGFEVSELADIDQADLTVDGSDRVADNLDGIKGGGGALTLEKNVAINSKKIVWIVDESKLVHRLSGFPLPVEVLPISCEQNFRRFEQEGLKPQWRTDGDKRYITHYGNYIIDLAVDPIPAPHGLADYLDHTVGVVEHGLFLDMCDEVIIAHSDGTIEDKIK

SEQ ID NO: 448 - protein, 230 aa, Lactobacillus acidophilus
MDKKEQDRLKKEAAEKAANMVQSGMILGVGTGSTVAFFIDALGKRKDEEDLKLKAIVTTSNRSKKQLESLGFEVSELADIDQADLTVDGSDRVADNLDGIKGGGGALTLEKNVAINSKKIVWIVDESKLVHRLSGFPLPVEVLPISCEQNFRRFEQEGLKPQWRTDGDKRYITHYGNYIIDLAVDPIPAPHGLADYLDHTVGVVEHGLFLDMCDEVIISHSDGTIEDKIK

SEQ ID NO: 449 - protein, 230 aa, Lactobacillus ultunensis DSM 16047
MDKQEQDRLKKEAATKAAEMVESGMTLGVGTGSTVAFFIDALGKRKDEEGLKLKAIVTTSNRSKKQLESLGFKVSELADIDQADLTVDGADRVADNLDGIKGGGGALTLEKNVAINSKKIIWIVDESKLVHRLSGFPLPVEVLPISCEQNFKRFEQEGLKPQWRMDGDKRYITHYGNYIIDLAVDPIPAPHGLADYLDHTVGVVEHGLFLDMCDEVIIAHSDGTIEDKKK

SEQ ID NO: 450 - protein, 232 aa, Lactobacillus gasseri
MDKSEQDQLKKEAATKAAMMVESDSVLGVGTGSTVAFFIDALGERKEKEGFSLKHIVTTSNRSKKQLEGLGFKVDELADIDQADLTVDGADRVDDNLDGIKGGGGALTLEKNVAINSKKIIWIVDESKLVHHLSGFPLPVEVLPVSAEQNFKRFEVEGLKPQWRLDNNGKRYVTHYGNYIIDLAADPTPVPYGLADYLDHTVGVVEHGLFLDMCDEVIIAHSDGTIEDKKRK

SEQ ID NO: 451 - protein, 232 aa, Lactobacillus gasseri
MDKSEQDQLKKEAATKAAMMVESGSVLGVGTGSTVAFFIDALGERKEKENFSLKHIVTTSNRSKKQLEGLGFQVDELADIDQADLTVDGADRVDDNLDGIKGGGGALTLEKNVAINSKKVIWIVDESKLVHHLSGFPLPVEVLPVSAEQNFKRFEEEGLKPQWRLDDNGKRYVTHYGNYIIDLAADPTPVPHGLADYLDHTVGVVEHGLFLDMCDEVIIAHSDGTIEDKKRK

SEQ ID NO: 452 - protein, 232 aa, Lactobacillus johnsonii
MNKTEQDQLKKEAATKAAKMVEPNSVLGVGTGSTVAFFIDALGERKEKEGFSLKHIVTTSNRSKKQLEGLGFKVDELADIDQADLTVDGADRVDDNLDGIKGGGGALTLEKNVAINSKKIIWIVDESKLVHHLSGFPLPVEVLPVSAEQNFKRFEAEGLKPQWRLDDEGKRYVTHYGNYIIDLATDPTPVPHGLADYLDHTVGVVEHGLFLDMCDEVIIAHSDGTIEDKKRK

SEQ ID NO: 453 - protein, 232 aa, Lactobacillus johnsonii
MNKTEQDQLKKEAATKAAKMVEPNSVLGVGTGSTVAFFIDALGERKEREGFSLKHIVTTSNRSKKQLEGLGFKVDELADIDQADLTVDGADRVDDNLDGIKGGGGALTLEKNVAINSKKIIWIVDESKLVHHLSGFPLPVEVLPVSAEQNFKRFEAEGLKPQWRLNDEGKRYVTHYGNYIIDLAADPTPVPHGLADYLDHTVGVVEHGLFLDMCDEVIIAHSDGTIEDKKRK

SEQ ID NO: 454 - protein, 231 aa, Lactobacillus iners DSM 13335
MQKTKQDELKQEAAKKAALMVEPNSVLGVGTGSTVAFFIDELAKINREKALNLKAIVTTSNRSRAQLEKQGFKVNELSEVDQIDLTVDGADRVDLNLNGIKGGGGALTLEKNVAVNSKKNIWIVDETKFVDRLKGFALPVEVLPISCEQNFRTFSQEGLLPKYRLDDNGKRYITHYGNFIIDLHVDPIPFPNVLAHYLDSVVGVVEHGLFLNICNEVIIAHSDGKIEIRKR

SEQ ID NO: 455 - protein, 230 aa, Lactobacillus jensenii JV-V16
MDKNTQDELKKEAAKVAADKVQAGSVLGVGTGSTVKFFIDWLGERKEKEGLTLKHIVTTSSRSKKQLESYGFKVDELADVDEVDLTVDGADRVDSQLNGIKGGGAALTLEKNVAVNSKKNIWIVDESKVVDHLSGFKLPVEVLPVSCMQVKKRLEKEGLNPEFRMNGNQKLTTHYGNYILDLDVSPIPVPTGLADYLDHTVGVVEHGLFLNICDEVIVAKSNGTIQEIKR

SEQ ID NO: 456 - protein, 230 aa, Lactobacillus jensenii 269-3
MDKNMQDELKKEAAKVAADKVQAGSVLGVGTGSTVKFFIDWLGERKEKEGLTLKHIVTTSSRSKKQLESYGFKVDELADVDEVDLTVDGADRVDSQLNGIKGGGAALTLEKNVAVNSKKNIWIVDESKVVDHLSGFKLPVEVLPVSCMQVKKRLEKEGLNPEFRMDGNKKLTTHYGNYILDLNISPIPVPNGLADYLDHTVGVVEHGLFLGICDEVIVAKSNGTIQEIKR

SEQ ID NO: 457 - protein, 230 aa, Lactobacillus delbrueckii
MDQAKQDELKKAAAKKAAALVEDGMVLGVGTGSTVKFFIDELGKKKAAGLTLKAVVTTSSRSQKQLEGYGFTVSPLSEVDQVDLTVDGADRVDKQLNGIKGGGAALTLEKNVAVNSKKNVWIVDESKVVDHLSGFALPVEVLPISCMQVEKRLADEGLKPEFRLTEDGQRLKTHYGNYILDLKLDRIPVPSGLADYLDHTVGVVEHGLFLNICDQVIIARDNGEIEVRSR

SEQ ID NO: 458 - protein, 227 aa, Parachlamydia acanthamoebae str. Hall's coccus
MSNAISLAKEAAGRTAAQFIESGMLVGLGTGTTTHCFIEALGKRCQEGLRIQALASSERSATLAREQKIPLLQTDQVTYLDITVDGADQIDPQKRMIKGGGGALLREKILASISKEMVVIVDSSKVVEQFGSFPLPVEMVTFAYQATIKKLNALGYTGKLREKGGIPYVSDNGNYIFDISLPKPCLTPEKENQQIRAIPGVVETGFFFGLAGRVLIGFPDGRVEIRS

SEQ ID NO: 459 - protein, 232 aa, Candidatus Protochlamydia amoebophila UWE25
MTQTNDSPSIKAKKAAALKAVEFVQDQMIIGLGTGSTIAYFIEALGKRCQAGLKITAIASSERSMRQARLVGIPIVDSDTILELDLTIDGADEIDPLKQMIKGGGGALLREKLIASASKEMIVVIDETKLVNKLGKFPVATEISIFTFRHIVKKLKDHGYCGSLRVNQDQSLYRTDNGNYIFDICFPEPIDNPIFEHNRLKSFAGVLETGLFFNLAGRVIIGYQNGMTKIVA

SEQ ID NO: 460 - protein, 242 aa, Chlamydia trachomatis
MSKQPENSFSSDKFFPIKQKLALEAVALVEPGMCVGLGSGSTAREFILALGDRVRTERLVITAVASSRISQLLAEAVGIPLLDHSLLQDVDLVVDGADEVDPCLRMIKGGGGALFREKILLQSGKRNVILVDERKLVPTLGKFSLPIEIAPFGCSSVQRILNKQGYFGEWRETSAGERFITDNGNYIYDVRTPDSYANPEEDMIRLLQIRGIIDVGFVIAKAEVWVGYADGSIVRKKEHNEY

SEQ ID NO: 461 - protein, 242 aa, Chlamydia trachomatis
MSKQPENSFSSDKFFPIKQKLALEAVALVEPGMCVGLGSGSTAREFILALGDRVRTERLVITAVASSRISQLLAEAVGIPLLDHSLLQDVDLVVDGADEVDPCLRMIKGGGGALFREKILLQSGKRNVILVDERKLVPTLGKFSLPIEIAPFGCSSVQRILNKQGYFGEWRETSAGERFITDNGNYIYDVRTPDSYANPEEDMIRLLQIRGIIDVGFVIAKAEVWVGYADGSIVRKKKHNEY

SEQ ID NO: 462 - protein, 242 aa, Chlamydia trachomatis
MSKQPENSFSSDKFFPIKQKLALEAVALVEPGMCVGLGSGSTAREFILALGDRVRTERLVITAVASSRISQLLAEAVGIPLSDHSLLQDVDLVVDGADEVDPCLRMIKGGGGALFREKILLQSGKRNVILVDERKLVPTLGKFSLPIEIAPFGCSSVQRILNKQGYFGEWRETSAGERFITDNGNYIYDVRTPDSYANPEEDMIRLLQIRGIIDVGFVIAKAEVWVGYADGSIVRKKEHNEY

SEQ ID NO: 463 - protein, 242 aa, Chlamydia trachomatis
MSKQPENSFSSDKFFPIKQKLALEAVALVEPGMCVGLGSGSTAREFILALGDRVRTERLVITAVASSRISQLLAEAVGIPLLDHSLLQDVDLVVDGADEVDPCLRMIKGGGGALFREKILLQSGKRNVILVDERKLVPTLGKFSLPIEIVPFGCSSVQRILNKQGYFGEWRETSAGERFITDNGNYIYDVRTPDSYANPEEDMIRLLQIRGIIDVGFVIAKAEVWVGYADGSIVRKKEHNEY

SEQ ID NO: 464 - protein, 239 aa, Chlamydia muridarum Nigg
MSKQVAHSFSSEDFSFIKQKLAREAVALVEPGMRVGLGSGSTAREFILALGERVRNERLAITAVASSRISHLLAQALGIPFLDPALSQELDLVVDGADEVDANLRMIKGGGGALFREKILLQSGKRNIILVDERKLVSVLGTFPLPIEISPFGCSSVEKVLNQQGYIGDWRKTSHGERFITDNGNYIYDVSSPDSYPHPEEDLIRLLQIRGIIDVGFVIAKAEVWVGYADGTVVRKEIT

SEQ ID NO: 465 - protein, 231 aa, Chlamydophila pneumoniae LPCoLN
MEKDLHLHEKKCLAHEAATQVTSGMILGLGSGSTAKEFIFALAHRIQTESLAVHAIASSQNSYVLAKQLAIPLLNPEKFSSLDLTVDGADEVDPQLRMIKGGGGAIFREKILLRAAKRSIILVDESKLVPVLGKFRVPLEISRFGRSAIVEEIRHLGYEGEWRLQDTGDLFITDSGNYIYDIFSPNSYPNPEKDLLKLIQIHGVIEVGFVIEKVEVWSSNSQGLISKKYSV

SEQ ID NO: 466 - protein, 231 aa, Chlamydophila pneumoniae CWL029
MEKDLHLHEKKCLAHEAATQVTSGMILGLGSGSTAKEFIFALAHRIQTESLAVHAIASSQNSYALAKQLAIPLLNPEKFSSLDLTVDGADEVDPQLRMIKGGGGAIFREKILLRAAKRSIILVDESKLVPVLGKFRVPLEISRFGRSAIIEEIRHLGYEGEWRLQDTGDLFITDSSNYIYDIFSPNSYPNPEKDLLKLIQIHGVIEVGFVIEKVEVWSSNSQGLISKKYSV

SEQ ID NO: 467 - protein, 233 aa, Chlamydophila felis Fe/C-56
MKEDPYLDVKKRLAREAAALVTSGMLVGLGSGSTSREFIKAIAERLAKENLDICAVASSQESYSLASSLGIPLIDDENFTSVDLVVDGADEIDPQLRMIKGGGGAIFREKILLQSSQRRLILADESKSVKVLGKFGLPVEISPYGRSSIIAALEAIGYLGNLRKNSRGGFFITNNGNYIYDIHTPNIYPHPEEDLLKLLQIHGIIEVGFVIANVEVWFGYTNGQICKENTGIV

SEQ ID NO: 468 - protein, 233 aa, Chlamydophila caviae GPIC
MKEDPYLEVKRHLAREAAALVTSGMLLGLGSGSTSREFIKAVAERKKQENLDIRAVASSKESYSLASSLGIPLIDDEEFINTDLAVDGADEIDPQLRMIKGGGGAIFREKILLQSSQRRLILADESKSVKVLGKFGLPVEISPFGRSSIIATLENFGYLGNLRKNPRGGFFITNNGNYIYDIHTPNVYPHPEEDLLKLLQIHGIIEAGFVIENVEVWLGYTNGQIGKKNTGGL

SEQ ID NO: 469 - protein, 233 aa, Chlamydophila abortus S26/3
MKKDPYLEVKKQLALEAANLVEPGMLLGLGSGSTSREFIKAVAHKHKQENLDIRAVASSKESHSLAKSLGIPLVDDEEFTEIDLAVDGADEIDPQLRMIKGGGGAIFREKILLQSSRRRLILADESKHVQVLGKFGLPIEISPFGRSSIIATLKNLGYLGNLRKNSHGGFFITNNRNYIYDIHTPNVYPHPEEDLLKLLQIHGIIEVGFVIASVEVWFGYANGQIGKKNTGRV

SEQ ID NO: 470 - protein, 218 aa, Picrophilus torridus DSM 9790
MFENEKRMAAMEALKFVRNDMRIGIGTGSTAYYFIEGLSELVKNGLRITGIPTSKKSEELCRSFNIPVDYNIKDIDIDFDGADEFDPYGNLIKGGGGALVREKIVAYNSREFYVLVDHSKYSERLHKFPLPVEVLPFMSEKTLENIERLGCRASFRDDKKFISDNGNYIIDCVFSYTDPELESQIKMIPGVVEVGIFRHLSTKIFQGTIDGCRIIDVK

SEQ ID NO: 471 - protein, 222 aa, Ferroplasma acidarmanus fer1
MYENEKRISAMEALKHVHSNMKLGLGTGSTTKYFLDGLGELVKSGKITDITGVPTSLRTADLAKSYGIKIENNLEGIEIDFDGADEFDGSGNLIKGGGGALVREKIVAYNSKEVYIMADHSKFSEKLHSFPLPVEVLPFMEDVTKKNIEKTGCKATFRDGKKFKSDNGNYILDCRFDFTDVVLETEIKMIPGVVEVGIFSGITTKVFIGENEKCRVMDFQKS

SEQ ID NO: 472 - protein, 241 aa, Thermoplasma acidophilum
MADYEKQKMNAAIKAAEYVRSGMIVGLGTGTTSYYLINEIGRRVREEGLKIRAVCTSRRTEDLAKQNGIEVIQGTKDQIDLTIDGADQVGMYGTLIKGGGGALLREKIVAYNSKEMYVIVDSRKIEAAHFGSFPLPVEIVPFMHMRTLENLRGICTQTDLRMNEKGEPFVTDNGNYIADMHMGMIDDPINLERSLKSIPGVVEVGLFNGIAKRIFEGTDEGCNIYSITNSGIKKEEVYFDP

SEQ ID NO: 473 - protein, 241 aa, Thermoplasma volcanium
MPDYEKQKRNAAVEAASYVKTGMVIGIGTGTTARYLIEELGRRVSEENLKIKGVCTSKKSEELARAAGIEISENPEQIIDLTIDGADQVNLHGTLIKGGGGALLREKIVAYNSKEMYVIVDSRKIDDENFGSFPLPVEVVPFLHRMTLENLRKICPSTDLRKNSDGTLFITDNGNYIADMKFGRIRETNELEKKIKSIPGVVDVGLFNNIADKIFEGNDDGCNIYVVSEKGRIEKEKGQFK

SEQ ID NO: 474 - protein, 225 aa, Candidatus Korarchaeum cryptofilum OPF8
MIEFEKRLVAREALKLIGDVKLLGLGSGSTVAIFVEELAKSDKAGKIKVIPSSKQIEEVARNQGLEVIYPDGERPEITVDGADEIDSNLNLLKGGGGALLREKVLAYNSSTYVIIADHTKLVEKLCSKRALPVEVLPYGVSWTLGNLIKRFNCDARIRIKDLSPFITDNGNVIVDINCPPLEDPASMESEVKGVPGVVEVGIFVGLADLVLIARGSEVKVLRQGF

SEQ ID NO: 475 - protein, 221 aa, Methanobrevibacter smithii
MNLKKEAGYKAAEYVTDGDILGLGTGSTTHYFIEAVGKRIADEGINVMGIPTSFQSLLLAKQWNIPVTSLEEHDIDLAVDGADEVDKNLNLVKGGGAAHTKEKIVDYSAKQFIVIVDESKYVEEIGNFPVPVEVIPDASRVVIQTLEDMGAECEIRMGERKDGPVITDNGNFVIDAKFEKIESPMHLEIDLNSIPGVVENGIFTQMVDKVIIGTSEGIKEL

SEQ ID NO: 476 - protein, 226 aa, Methanothermobacter thermautotrophicus str. Delta H
MEVFMNLKKMAALRAVDEIDDGDVVGLGTGSTTHYFIEELGRRVREEGLEVMGVPTSYQSMFLAAESGIKVTSLAEHDVDVAVDGADEVDPDLNLIKGGGAAHTLEKIVDSSAASFIVIVDESKLVERLGAFPLPVEVIPAACRPVKLKLESMGASVNIRSSEGKDGPVVTDNGNFVLDAAFGVIDDPGAMESRLNNIPGVVENGIFAGIADMVIAGTSEGLKILR

SEQ ID NO: 477 - protein, 231 aa, Methanosphaera stadtmanae
MVNMDILKDNVGKKAADLIKDGQIVGLGTGSTTHYFIRYLGERIKNEELNILGIPTSYQSLIKAREAGINTTTLDEYDIDIAVDGADEVNPTLDLIKGGGAAHTLEKLVDSSAKKFVVIVDESKVVEELGKFPVPLEIIPEALRVVKDTLVDLGGKPELRMGIQKDGPVITDNGNFILDTKFDKIRNPHKLEKELNIIPGVLENGIFAGLADKVIIGKMSAIEEIDREDIL

SEQ ID NO: 478 - protein, 226 aa, Thermococcus gammatolerans EJ3
MEELKKAVAREALSFVDDDMVIGLGTGSTTAYFIKFLGELIKEEELEVYGIPTSHQSRLLAIESGVPVVSLDEADAIDIAVDGADEVDPALNLIKGRGAALTMEKIIEYRAGTFIVLVDESKLVKRLGEKMPVPIEVIPAAWRAIAEELEVFNARAELRMAVKKDGPVITDNGNFILDARFERIDDPLDMEIELNTIPGVVENGIFADIADVVLVGTREGVRKLER

SEQ ID NO: 479 - protein, 226 aa, Thermococcus sp. AM4
MEELKKAVAREALSFVDDDMVIGLGTGSTTAYFIKFLGELIREEELEIYGIPTSHQSRLLAIEHGIPLLSLDEADAIDIAVDGADEVDPALNLIKGRGAALTMEKIIEYRAGTFVVLVDESKLVKRLGERMPVPIEVIPAAWRAIAEELEVFNARAELRMAVKKDGPVITDNGNFILDARFERIDDPLDMEIELNTIPGVVENGIFADIADVVLVGTREGVKKLER

SEQ ID NO: 480 - protein, 227 aa, Thermococcus sibiricus MM 739
MEELKKLAAKEALRYIDDDMIIGLGTGSTTAYFIQMLGKKLMTEELEDVYGIPTSHQSRLLALESGIPVVTLDEVDAIDIAVDGADEVDPHLNLIKGRGAALTMEKIIEYRAGTFIVLVDESKLVEYLGQRVPVPIEVIPAAWRAIKEELEVFNATAELRMGVKKDGPVITDNGNFILDAKFIKIEDPLDMEIELNNIPGVVENGIFADIADIILVGTKEGVKKLER

SEQ ID NO: 481 - protein, 229 aa, Thermococcus barophilus
MNTEEMKKLVAKEALKYIEDDMIVGLGTGSTTAYFIKMLGKMIMNEELFDVYGLPTSYQARILALESGVPVVSLDEVDAIDIAVDGADEVDPHLNLIKGRGAALTMEKIIEYRAGTFLVLVDGSKLVEYLGQKMPVPIEVIPAAWRVIKEELEVFNATAELRMGVKKDGPVVTDNGNFILDAKFERIEDPLDLEIELNNIPGVVENGIFADIADIVLVGTKEGVKKLER

SEQ ID NO: 482 - protein, 227 aa, Thermococcus onnurineus NA1
MEELKRAVAKEALKFIEDDMVVGLGTGSTTAYFIEYLGKLIMEEELEDVYGVPTSYQARLLALEYGVPVVNLDEVDAIDIAVDGADEVDPYLNLIKGRGAALTMEKIIEYRAGTFLVLVDESKLVERLGQKMPVPIEVIPAAWRAIAEELEVFNATAELRMASKKDGPVVTENGNFILDARFHRIDDPLDLEIELNNIPGVVENGIFADIADIVLVGTREGVKRMER

SEQ ID NO: 483 - protein, 229 aa, Thermococcus kodakarensis KOD1
MNVEEMKKAVAKEALKFIEDEMVVGLGTGSTTAYFINYLGKLLMEGELEDVYGVPTSHQARLLALEAGIPVVSLDEVDAIDIAVDGADEVDPHMNLIKGRGAALTMEKIIEYRAGMFIVLVDESKLVEYLGQKMPVPIEVIPAAWRAIAEELEVFNATAELRMAVKKDGPVVTDNGNFILDAKFARIEDPLDLEIELNTIPGVVENGIFADIADIILVGTPEGVKRMER

SEQ ID NO: 484 - protein, 229 aa, Pyrococcus abyssi
MNIEEMKKIAAKEALKFIEDDMVIGLGTGSTTAYFIRLLGDMIKKGEVSDIVGVPTSYQSRLLAIESGIPVATLDQVDAIDVAVDGADEVDPNLNLIKGRGAALTMEKIIESRAGMFIVLVDERKLVDYLCQKMPVPIEVIPQAWRAIVEELSIFNAEAKLRMGVNKDGPVITDNGNFIIDAKFPRIDDPLDMEIELNTIPGVVENGIFADIADIVIVGTKEGVKTLER

SEQ ID NO: 485 - protein, 229 aa, Pyrococcus furiosus
MNVEEMKKAVARAALEFIEDDMVVGLGTGSTTAYFIRYLGEMIEKGKVEDIYGVPPPIKQKFLRMESGVPVLSLDQVDAIDIAVDGADEVDPNLNLIKGRGAALTMEKIIEYRAGTFIVLVDESKLVDYLCQKMPVPIEVIPAAWKAILEELSIFNAKAELRMGVKKDGPVVTENGNFIIDAKFPRIDDPLDMEIELNTIPGVVENGIFADIADIVLVGTKEGVKRLER

SEQ ID NO: 486 - protein, 226 aa, Methanocaldococcus sp. FS406-22
MSNEDLKLKVAKEAVKLVKDGMVVGLGTGSTAALFIRELGNRIKEEELTVFGIPTSFEAKMLAMQYEIPLVTLDEYDVDIAFDGADEVEEKTLFLIKGGGGCHTQEKIVDYNADEFVVLVDESKLVKKLGEKFPIPVEVIPSAYRVVMRALSNMGGEAVIRLGDRKRGPVITDNGNMIIDVFMNIDDAIELEKEINNIPGVVENGIFTRVDKVLVGTKKGVKTLKK

SEQ ID NO: 487 - protein, 226 aa, Methanocaldococcus fervens AG86
MSNEDLKLKVAKEAVKLVKDGMVVGLGTGSTAALFIRELGNRIQGEELTVFGIPTSFEAKMLAMQYGIPLVSLDEYDVDIAFDGADEVEEKTLFLIKGGGGCHTQEKIVDYNANEFVVLVDESKLVKNLGEKFPIPVEVIPSAYRVVIRALSEMGGEAVIRLGERKRGPVITDNGNMIIDVFMKVDDAVELEKEINNIPGVVENGIFTKVDKVLVGTKKGVKTLKK

SEQ ID NO: 488 - protein, 226 aa, Methanocaldococcus vulcanius M7
MSSEDLKLKVAKEAVKLVKDGMVIGLGTGSTSALFIRELGNRIKEEELTVFGIPTSFEAKMLAMQYEIPLVSLDEYDIDIAFDGADEVEEKTLFLIKGGGGCHTQEKIVDYNAGEFVVLVDEGKLVKKLGEKFPIPVEVIPLSYRVVMRALSEMGGDAVIRLGERKRGPVITDNGNMILDTFMNIEDAVELEKEINNIPGVVENGIFTKVDKVLVGTKRGVKTLKK

SEQ ID NO: 489 - protein, 221 aa, Methanocaldococcus infernus ME
MDLKRAVAKEAAKLIKDGSVVGLGSGSTAALFIEELAKRMENEDIAIFGVPTSYEAKLLASHYGIPIVSIEDYDVDIAVDGADEVRKKDLALIKGGGGCHTWEKIVDYNAKEFVVIVDESKVKDSLSFPVPVEVIPHSYRVVMKRLKELGGESVIRLGERKRGPVITDNGNFILDVNIKVENAEELEEKINNIPGVVENGIFSRVDKVLVGTKKGVKALKK

SEQ ID NO: 490 - protein, 239 aa, Methanococcus maripaludis
MARTKKANDEVPTNSDSLKLKVAKQAAKLVKDEMVVGLGSGSTANLFIQELGKRIVEEELYIYGVPTSFDSRMVASTAGIPLISLDQCGEIDIAVDGADEVCKSTLSLIKGGGGCHTMEKIVDYHAKEFIVLADEGKLVDSLGDKTPVPLEVIPFAYSTVLNKLLKMNTAPAIRTGSGKMGPVITDSGNMIIDVFISIDDAEETENMLNNIPGVLENGVFSKCDKVLVGTSKKVEILKK

SEQ ID NO: 491 - protein, 239 aa, Methanococcus maripaludis
MARTKKANDEVPTDSDSLKLKVAKQAAKLVKDEMVVGLGSGSTANLFIQELGKRIVEEELYIYGVPTSFDSRMVASTAGIPLISLDQCGEIDIAVDGADEVCKSTLSLIKGGGGCHTMEKIVDYHAKEFIVLADEGKLVDSLGDKTPVPLEVIPFAYSTILNKLLKMNTAPVIRTGSGKMGPVITDNGNMIIDVFISIDDAEETEIMLNNIPGVLENGVFSKCDKVLIGTSKKVEILKK

SEQ ID NO: 492 - protein, 239 aa, Methanococcus maripaludis
MARTKKANDEVPTDSDSLKLKVAKQAAKLVKDEMVVGLGSGSTANLFIQELGKRIVEEELYIYGVPTSFDSRMVASTAGIPLISLDQCGEIDLAIDGADEVCKSTLALIKGGGGCHTMEKIVDYYAKEFIVLADEGKLVDSLGDKTPVPLEVIPFAYSTVLNKLLKLNTAPAIRSGSGKMGPVITDSGNMIIDVFMSIEDAEETEIMLNNIPGVLENGVFSKCDKVLVGTSKKVEILKK

SEQ ID NO: 493 - protein, 239 aa, Methanococcus maripaludis
MARTKKANDEVATDSDSLKLKVAKQAAKLVKDEMVVGLGSGSTANLFIQELGKRVVEEELYIYGVPTSFDSRMMASNSGIPLISLDQCGEIDIAIDGADEVCKKTLSLIKGGGGCHTMEKIVDYHAKEFVVLADEGKLVESLGDKTAVPLEVIPFAYSTVLNKLLDMNTAPAIRSGSGKMGPVITDNGNMIIDVFINIEDAEETETMLNNIPGVLENGIFSKCDKVLVGTSKKVEILKK

SEQ ID NO: 494 - protein, 239 aa, Methanococcus vannielii
MAKPKKSDEEVSIDSDSLKIKVAKEAAKLIKDEMVVGLGSGSTANLFIQELGKRVIEEELYIYGVPTSFDSRMMANQSGIPLISLDQCGEIDIAIDGADEIDKKTFSLIKGGGGCHTMEKIVDYYAKEFVVLADESKMVDSLGENTPVPLEVIPFSYSTVLSKLLKINAAPAIRSGSGKMGPVITDNGNMIIDVFINIEDAEETETMLNSIPGVLENGIFTKCDKVLIGTSKKVEVLKK

SEQ ID NO: 495 - protein, 235 aa, Methanococcus voltae
MAKKKSAETQDDLKLKVAQEASKLVKDEMVIGLGSGSTANMFIKELGKRIVDEELYIYGVPTSFDAKMLASQCGIPLVSLDQAGQIDLAVDGADEVEEGSLSLIKGGGGCHTMEKVIDYSAKEFVVLVDESKVVASLGENTPVPLEVLPFAYSTVLNTLLEMNTAPSIRVSGGKMGPVITDNGNMIIDVFTKIDEADVKEKELNNIVGVVENGIFSKCDKVLVGNDSKKVKVLKK

SEQ ID NO: 496 - protein, 234 aa, Methanococcus aeolicus
MARKKAVKVEADPRLNAVNEALKFIKDGMIVGLGSGTTANLFIAELGKKISEEGLNVFGVPTSFESRMMAIQYGIPLVSLDEYGELDIAVDGADEVNKETLNVIKGGGGCHTQEKIIDYCAKELIIIVDESKLVDSLGENTPVPLEVLPFAYSSVLNELLKMNSAPSIRMADKKMGPVITDNGNMIIDVFIDLNNPEEVEKQLNNIPGVVENGIFTKVDKVIVGKSDKAEILKK

SEQ ID NO: 497 - protein, 231 aa, Prochlorococcus marinus
MKQIVADSAIEEVEDGMILGLGSGSTAALMIKSLAEKIRSGKLKNIKGVPTSFQSEVLALELNIPLIDLASVPYIDLAIDGADEVDPDFQLIKGGGACHVREKLVASKANKLLIVIDESKLVQNLNQVFPLPVEVMPSAWKQVKDIISEMSGVSNLRMATKKAGPVVTDQGNLILDVLFDAGIRDPKDLEMRINNIPGVLENGLFVDLADKVLVGKIEDDVPVLFSPSRRS

SEQ ID NO: 498 - protein, 231 aa, Prochlorococcus marinus
MKQIVADAAVKEVKDGMIVGLGSGSTAALMIKSLAEQIRLGKLKNIKGVPTSFQSEVLSLELKIPLIDLASVSQIDLAIDGADEVDPDFQLIKGGGACHVREKLVASKANKLLIVVDETKLVQQLNLVFPLPVEVLPSAWKQVKDIISEMNGVSDLRMATKKAGPVVTDQGNLILDVLFNTGIKDPKDLEMRINNIPGVLENGLFVNLTDKVLVGKIENNVPVLFSPSKGS

SEQ ID NO: 499 - protein, 231 aa, Prochlorococcus marinus
MKQVVADAAIREVKSDMILGLGSGSTAALMIKSLADEMRSGKLQNIRGVATSFQSEVLALELNIPLIDLASVSQIDLAIDGADEVDPGFQLIKGGGACHVREKLVASKSDQLLIVVDETKLVQNLNLSFPLPVEVLPNAWKQVQEVISEMNGSSSLRMANKKAGPVVTDQGNLVLDVLFNDGIKNPKDIEKTINNIPGVLENGLFVDLTDKVLVGKIENNTPVVYSPSRVS

SEQ ID NO: 500 - protein, 231 aa, Prochlorococcus marinus
MKQVVADAAIREVKSDMILGLGSGSTAALMIKSLADEMRSGKLQNIKGVATSFQSEVLALELNIPLIDLASVSQIDLAIDGADEVDPGFQLIKGGGACHVREKLVASKADQLLIVVDETKLVQNLNLSFPLPVEVLPNAWKQVQEVISEMKGSSTLRMATKKAGPVVTDQGNLILDVLFDDGINNPKDIEMKINNIPGVLENGLFVDLTDKVLVGKIENNTPVVYSPSRAS

SEQ ID NO: 501 - protein, 231 aa, Prochlorococcus marinus
MKKIVADAAIKEVESDMILGLGSGSTAALMIKSLADEIRSGKLQNIRGVATSFQSEVLALELDIPLIDLASVSQIDLAIDGADEVDPRFQLIKGGGACHVREKLVASKANRLLIVVDETKLVQNLNQTFPLPVEVLPNAWKQVEEVISEMKGSSSLRMATKKAGPIVTDQGNLILDVFFDGGIKNPKDIELSLNNIPGVLENGLFVDLTDKVLVGKIENNIPVVYSPSKFG

SEQ ID NO: 502 - protein, 231 aa, Prochlorococcus marinus
MKKIVADAAIKEVENDMILGLGSGSTAALMIKSLADEIRSGKLQNIRGVATSFQSEVLALELDIPLIDLASVSQIDLAIDGADEVDPRFQLIKGGGACHVREKLVASKANRLLIVVDETKLVQNLNQSFPLPVEVLPNAWKQVEEVISEMKGSSSLRMATKKAGPIVTDQGNLILDVFFDGGIKNPKDIELSLNNIPGVLENGLFVDLTDKVLVGKIENNNPVVYSPSKFG

SEQ ID NO: 503 - protein, 237 aa, Prochlorococcus marinus
MNSQTQMKQIVAEAAIEEVKSDMILGLGSGSTAVLMIKSLADAIRSGKLQNIKGVATSFQSEVLALELDIPLIDLASVSQIDLAIDGADEVDPGFQLIKGGGACHVREKLVASKANQLLIVVDETKLVRKLNQSFPLPVEVLPNAWKQVQEVISEMNGISTLRMATKKAGPVVTDQGNLILDVLFNDGIKNPKDIEKSINNIPGVLENGLFIDLTDKVLVGKIENNIPVAYSPAKVG

SEQ ID NO: 504 - protein, 237 aa, Prochlorococcus marinus
MTDLQTQMKIAVAQEAIGEIKDGMILGLGSGSTAALMIKSLGEKLKEGSLKEIIGVPTSFQGEVLASQLGIPLRAFSAVSKIDLAIDGADEVDPNFQLIKGGGACHVQEKLVASIADRFVVVVDSTKIVEKLNLEFKLPVEVLPAAWKLVQKELNDLGAKSDLRMAEKKAGPIVTDQGNLVLDVQFADGISDPQNLEKQINNFPGVLENGLFVNLTDEVLVGEIKNGVSSVNRLKKA

SEQ ID NO: 505 - protein, 237 aa, Prochlorococcus marinus
MEDLQTQMKEAVAKAAIEQIHDGMVLGLGSGSTAALMIKALGAKISSGHLKDIVGVTTSFQGEVLATELGIPLQGLSAVSQIDLAIDGADEVDSNFQLIKGGGACHVQEKLVASLAERFVVVVDSSKIVKTLNLTFKLPVEVLPSAWQLVKNKIHEIGGVSQLRMAQKKAGPIVTDQGNLVLDVTFAGGINDPQTLEKQINNIPGVLENGLFVNLADEVLVGEIVSGTPGVKSLQKI

SEQ ID NO: 506 - protein, 236 aa, Prochlorococcus marinus
MDLQNQMKKAVAQAAVDQIQNGMILGLGSGSTAALMIEALAIKIKSGEIKDVVGVTTSFQGEVLASELGIPLKSLSSVSEIDLAIDGADEVDPKFQLIKGGGACHVQEKLVAALAKKFIVVVDSTKLVEKLNLDFKLPVEVLPSAWKQVQKTLINLGGEGNLRMAQKKAGPIVTDQGNLILDLTFRNGIDQPELLETQINNIPGVLENGLFVNLTDEVLVGKVESDVVGVESLKKI

SEQ ID NO: 507 - protein, 236 aa, Prochlorococcus marinus
MDLQNQMKKAVAQAAVDQIQNGMILGLGSGSTAALMIEALAIKIKSGEIKDVVGVTTSFQGEVLASELGIPLKSLSSVSEIDLAIDGADEVNPKFQLIKGGGACHVQEKLVAALAKKFIVVVDSTKLVEKLNLDFKLPVEVLPSAWKQVQKTLINLGGEGNLRMAQKKAGPIVTDQGNLILDLTFRNGIDKPELLESQINNIPGVLENGLFVNLTDEVLVGKVESDVVGVESLKKI

SEQ ID NO: 508 - protein, 239 aa, Synechococcus sp. WH 8109
MADLQTQMKQAVADAAVEQIKDGMVLGLGSGSTAALMIQGLGAKLASGELKEIVGVTTSFQGEVLAAELNIPLLSLNAVSRIDLAIDGADEVDPGFQLIKGGGACHVQEKLVAARADRFVVVVDSTKLVDRLNLGFLLPVEVLPGAWRQVKQQLEALGGSADLRMAQRKAGPVVTDQGNLVLDAKLDGGISDPVALEQTINNIPGVLENGLFVNITDEVLVGEITDGVAGVRSLEKRLS

SEQ ID NO: 509 - protein, 239 aa, Synechococcus sp. CC9605
MADLQTQMKQAVADAAVEQIKDGMVLGLGSGSTAALMIQGLGAKLASGELKDIVGVTTSFQGEVLAAELNIPLLSLNAVSRIDLAIDGADEVDPGFQLIKGGGACHVQEKLVAARADRFVVVVDSTKLVDRLNLGFLLPVEVLPGAWRQVKQQLEALGGSAELRMAQRKAGPVVTDQGNLVLDAKLDGGISDPVALEQTINNIPGVLENGLFVNITDEVLVGEITDGVAGVRSLQKRLS

SEQ ID NO: 510 - protein, 239 aa, Synechococcus sp. WH 8102
MADLQTQMKQAVADAAVEQIKDGMVLGLGSGSTAALMIKALGAKLASGELKDIVGVTTSFQGEVLAAELNIPLLSLNAVDRIDLAIDGADEVDPGFQLIKGGGACHVQEKLVAARADRFVVVVDSTKLVERLNLGFLLPVEVLPGAWRQVQQQLAALGGKAELRMAQRKAGPVVTDQGNLVLDVTMNGGISDPAALESTVNNIPGVLENGLFVDLVDEVLVGEITDGSAGVRSLEKRLS

SEQ ID NO: 511 - protein, 239 aa, Synechococcus sp. CC9902
MADLQTQMKHAVADAAVEQIKDGMVLGLGSGSTAALMIRALGAKLASGELKNIVGVTTSFQGEVLAAELNIPLLSLNAVDRIDLAIDGADEVDPSFQLIKGGGACHVQEKLVAAMADRFVVVVDSTKLVDRLNLDFLLPVEVLPGAWRQIQKTLAAMGGSAELRMAQRKAGPVVTDQGNLVLDVKLEGGITDPASLEKAINNVPGVLENGLFVNLTDEVLVGEISDGVAGVRSLERRLS

SEQ ID NO: 512 - protein, 239 aa, Synechococcus sp. BL107
MADLQTQMKQAVADAAVEQIKNGMVLGLGSGSTAALMIRALGAKLASGELKNIVGVTTSFQGEVLAAELNIPLLSLNAVDRIDLAIDGADEVDPSFQLIKGGGACHVQEKLVAAMADRFVVVVDSTKLVDRLNLDFLLPVEVLPGAWRQVQKTLASMGGSAELRMAQRKAGPVVTDQGNLVLDVKLNGGIDDPASLEKSINNIPGVLENGLFVNLTDEVLVGEISDGVAGVRSLDRRPS

SEQ ID NO: 513 - protein, 237 aa, Synechococcus sp. RS9916
MDLQTQMKHAVAAAAVDQIKDGMVLGLGSGSTAALMIQGLGAKLASGELKDIVGVTTSFQGEVLAAELNIPLLSLNAVDRIDLAIDGADEVDPGFQLIKGGGACHVQEKLVAARAERFVVVVDSTKLVDRLNLGFLLPVEVLPGAWRQVQQQLAAMGGTAELRMAQRKAGPVVTDQGNLVLDVKMNGGIADPAALELAINNIPGVLENGLFVNLADEVLVGEVNGDVAGVRSLERRA

SEQ ID NO: 514 - protein, 238 aa, Prochlorococcus marinus
MADLQTQMKQAVAAAAVEQIKDGMVLGLGSGSTAALMIQALGAKLASGELRDIVGVTTSFQGEVMAAELGIPLRNLTAVDRIDLAIDGADEVDPSFQLIKGGGACHVQEKLVASRADRFVVVVDSTKIVDRLNLGFLLPVEVLPGAWRQVQGRLAELGGIADLRMAQCKAGPVVTDQGNLVLDVSMAGGIGDPEDLECRINNLPGVLENGLFVNLTDEVLVGQISDGVAGVRRLQRRE

SEQ ID NO: 515 - protein, 238 aa, Prochlorococcus marinus
MADLQTQMKQAVAAAAVEQIKDGMVLGLGSGSTAALMIQALGAKLASGELREIVGVTTSFQGEVMAAELGIPLRNLTAVDRIDLAIDGADEVDPSFQLIKGGGACHVQEKLVASRADRFVVVVDSTKIVDRLNLGFLLPVEVLPGAWRQVQGRLAELGGIADLRMAQCKAGPVVTDQGNLVLDVSMAGGIGDPEDLECRINNLPGVLENGLFVNLTDEVLVGQISDGVAGVRRLQRRE

SEQ ID NO: 516 - protein, 237 aa, Synechococcus sp. RCC307
MADLQTQMKQAVALAATDQVKNGMVLGLGSGSTAALMIQEVGARLRDGRLTDIVGVTTSFQGEVLAAELGIPLQSLNAIDRIDLAIDGADEVDPAFELIKGGGACHVQEKLVARRAERFVVVVDSTKLVERLNLGFLLPVEVLAGAWRQVQAELQQLGGSAELRMAQRKAGPVVTDQGNLVLDVSFAGGINDPAGLETTINNIPGVLENGLFVGLADQVLVGEINDGVAGVRDLVKS

SEQ ID NO: 517 - protein, 238 aa, Synechococcus WH7803
MSDLQNQMKQAVADAAVQQFRDGMVVGLGSGSTAALMIKGLGERLAAGQLSDIVGVTTSFQGEVLAAELGIPLRSLNAVDRIDLAIDGADEVDPAFQLIKGGGACHVQEKLVAARADRFIVVVDSTKLVERLNLGFLLPVEVLPGAWVQISQQLKAMGGDAELRMATRKAGPVVTDQGNLVLDVRFEGGIADPASLEKEINNIPGVLENGLFVNLADEVLVGQIDGGVASARSLEKAG

SEQ ID NO: 518 - protein, 238 aa, Synechococcus WH7805
MSELQNQMKQAVADAAVEQFQDGMVVGLGSGSTAALMIKGLGERLAAGQLNDIVGVTTSFQGEVLAAELGIPLRSLNAVDRIDLAIDGADEVDPSFQLIKGGGACHVQEKLVAARADRFIVVVDSTKLVERLNLGFLLPVEVLPGAWVQIRQQLNAMGGEAELRMATRKAGPVVTDQGNLVLDVRFEGGIADPVSLEKDINNIPGVLENGLFVNLADEVLVGQVDDGVASARSLERAR

SEQ ID NO: 519 - protein, 238 aa, Synechococcus sp. CC9311
MSDLQTQMKQAVAEAAVAQIRDGMVVGLGSGSTAALMIEGLGARLAAGQLRDIVGVTTSFQGEVLAAELGIPLRALNATDRIDLAIDGADEVDPSFQLIKGGGACHVQEKLVADRAERFIVVVDSTKLVRCLNLDFLLPVEVLPGAWVQVQSRLKSMGGVAELRMATRKAGPVVTDQGNLVLDVRFENGISDPIALERDINNLPGVLENGLFVNLADEVLVGEIKDGVAGVRSLDRVG

SEQ ID NO: 520 - protein, 231 aa, Synechococcus sp. RS9917
MKQAVAAAAVDAIQDGMVLGLGSGSTAALMIQGLGAKLAAGELRDIVGVTTSFQGEVLAAELGIPLRSLNAVERIDLAIDGADEVDPAFQLIKGGGACHVQEKLVAARAERFIVVVDATKLVDRLNLGFLLPVEVLPGAWRQVQARLASLGGAAELRMATRKAGPVVTDQGNLVLDVRFGEGIADPRALEQTINNIPGVLENGLFVDLADEVLVGEVTDGVAGVRRLERQG

SEQ ID NO: 521 - protein, 237 aa, Synechococcus sp. WH 5701
MAELQDRMKLAVATAAVDQIRDGMVLGLGSGSTAALMIRELGARLRRGELSAITGVTTSFQGEVLAAELGIPLQSLNAVSRIDLAIDGADEVDPAFQLIKGGGACHVQEKLVARRADRFVVVVDSSKLVKRLNLEFLLPVEVLPGAWRQVKAELEAMGATADLRMAVKKAGPVVTDQGNLVLDLKFAGGITDPAALEQAINNLPGVLENGLFVGLTDQVLVGEIVDGEPRVRDLERI

SEQ ID NO: 522 - protein, 237 aa, Cyanobium sp. PCC 7001
MSDLQDRMKQAVALAATEQIQSGMVVGLGSGSTAALMIQALGARLRSGALTDITGVTTSFQGEVLAAELGIPLKSLNAISRIDLAIDGADEVDPSFQLIKGGGACHVQEKLVARRADRFVVVVDATKLVDTLNLGFLLPVEVLPGAWRQVQADLEALGGEAQLRMAVRKAGPVVTDQGNLVLDARFAGGITDPVALEQQINNLPGVLENGLFVNLTDQVLVGEIEADQPRVRDLARR

SEQ ID NO: 523 - protein, 237 aa, Paulinella chromatophora
MLSLQDQMKHAVAEAAVEQIRDGMILGLGSGSTAALMIKSLGKRIKNKELRDIVGVTTSFQGEVLAAELGIPLKSLNAIGHIDLAIDGADEVDPNFQLIKGGGACHVQEKLVAARANRFVVVVDSTKLVNRLNLAFLLPIEVLPGAWHQVKIELEAMGAKAELRMAQRKAGPIVTDQGNLIIDASFKDGIIDPINLELQINNIPGVLENGLFVNLVDQVLVGEINNDEVSVRDLVKA

SEQ ID NO: 524 - protein, 236 aa, Thermosynechococcus elongatus BP-1
MSDDAVKQMKQVVAKAAADRVQSGMVVGLGTGSTTAFVIQFLGDRLRKGELSNIVGVPTSFQASVLAKKYGIPLVTLDDVEKLDIAIDGADEVDPAKNLIKGGGAAHTREKIVDSLAEQFLVVVDSSKLVQKLGSTFPVPVEVLPFAVAPVTRALKALGGEPELRMGVKKDGPVVTDQGNFVLDVRFDDIPDPAELEKAINNIPGVVENGLFVNVADVILVGEIVDGQPQVREIFH

SEQ ID NO: 525 - protein, 237 aa, Cyanothece sp. PCC 7425
MTTAPDPVKLMKQAVAQTAAARVTSGAVVGLGTGSTTALMIQCLGERLAKGELANIKGVPTSFQASVLAKQYGIPLVTLDEVEKIDLAIDGADEVDPQKNLIKGGGAAHTREKVVDALADLFIVVVDSSKLVDQLGSTFPVPVEVLPMALTPVMRAVTRLGGEPQLRMGVKKDGPVITDQGNMVLDVKFAAIPDPAELEKTLNNIPGVVENGIFVNLAKVILVGELKDGQPSVREIS

SEQ ID NO: 526 - protein, 236 aa, Lyngbya sp. PCC 8106
MSEQDPVKLMKQQVGKAAADRVQSGSIVGLGTGSTTAYTLQYLGERLQSGELKDIKGVPTSFQSSVLAKQYGIPLTTLDEIDHMDIAIDGADEVDPNKNLIKGGGAAHTREKIVDSLADQFIVVVDSSKLVDKLGSTFLLPVEVIPLAITPVMNKIEKLGGKPTLRMGVKKAGPVITDQGNMVIDVKFDSIDNPAELEKTLNNIPGVLENGLFVGVADVILVGEIKDGKPLIREIS

SEQ ID NO: 527 - protein, 237 aa, Arthrospira maxima CS-328
MSPEQDPVKLMKQQVGKAAADRVKSGSIVGLGTGSTTAYTIQFLGERLKSGEIKDIKGVPTSFQASVLAKEYGIPLTTLDEIDHIDIAIDGADEVDPHKNLIKGGGAAHTREKIVDCLADQFIVVVDGSKIVDRLGSTFLLPVEVMPMAMTPVMAAITKLGGKPTLRMGVKKAGPVITDQGNMVIDVKFDAIDNPAELEKTLNNIPGVLENGLFVGVADVILVGEIKDGQPVVREIS

SEQ ID NO: 528 - protein, 236 aa, Microcoleus chthonoplastes PCC 7420
MSAETDPVKVMKQEVGKAAAQRVQSGTIVGLGTGSTTAYAIQYIGDRIKKGDLKDIKGIPTSFQAEVLAKEHGIPLTSLDAVDHIDVAIDGADEVDPQKNLIKGGGAAHTREKVVDSLADQFIVVVDSGKLVERLGSTFKLPVEVIPMAYAPVMRAIEKLGGKPELRMGVKKAGPVVTDQGNMVIDVTFDSIDNPGELEKTINNIPGVLENGLFVGVANVVLVGEVKDGQPLVREM

SEQ ID NO: 529 - protein, 237 aa, Trichodesmium erythraeum
MVTEQDPTTLMKQQVGKAAAEEVKSGMIVGLGTGSTTAYMIQFLGELLQRGELKDIKGIPTSFQSTVLAKKYGVPLTTLDEVDYMDIAIDGADEVDPQKNLIKGGGAAHTREKIVDCLAEKFVVVVDSSKLVDKLGSTFLLPVEVIPMAMNPVIRAIEKLGGQPEVRMGVKKAGPIVTDQGNLVIDVKFDSIDNPGELEKSLNNIPGVLENGLFVGVADVILVGEIDNGKPIVRTIS

SEQ ID NO: 530 - protein, 236 aa, Cylindrospermopsis raciborskii CS-505
MSVSADPVKLMKQEVGKAAASLVKSGSIVGLGTGSTTAYTIQFLGDRLKSGELKDIVGIPTSFQSEVLAKHYGVPLTTLDAVDHIDIAIDGADEVDPNKNLIKGGGAAHTREKVVDYLASQFIVVVDSGKLVDHLGSTFAVPVEVIPMAITPVINAIKKLGGNPELRMGVKKAGPVITDQGNMVVDVRFDSIEDPVNLEKTLNNIPGVLENGIFVNCVDLVLIGEVIDGKPSVRQM

SEQ ID NO: 531 - protein, 236 aa, Raphidiopsis brookii D9
MSVSADPVKLMKQEVGKAAASLVKSGSIVGLGTGSTTAYTIQFLGDRLKSGELKDIVGIPTSFQSEVLAKHYGVPLTTLDAVDHIDIAIDGADEVDPNKNLIKGGGAAHTREKVVDYLASQFIVVVDSGKLVDHLGSTFAVPVEVIPMAITPVVNAIKKLGGNPELRMGVKKAGPVITDQGNMVVDVKFDTIEDPVNLEKTLNNIPGILENGIFVNCVDLVLIGEVIDGKPSVRQM

SEQ ID NO: 532 - protein, 236 aa, Nostoc sp. PCC 7120
MTVTADPVTLMKQEVGKAAAALVKSGSIVGLGTGSTTAYTIQYLGDRLKSGELTDIVGIPTSFQSEVLSKQYGVPLTTLDAVDHIDIAIDGADEVDPHKNLIKGGGAAHTREKVVDYLANQFIVVVDSGKLVDRLGSVFAVPVEVIPMAITPVTNAIKQLGGKPELRMGVKKAGPVITDQGNFVLDVRFDSIDDPVNLEKILNNIPGVLENGIFVNCADIVLVGEVKDGQPLVRRL

SEQ ID NO: 533 - protein, 236 aa, Anabaena variabilis
MTVTADPVTLMKQEVGKAAAALVKSGSIVGLGTGSTTAYTIQYLGDRLKSGELTDIVGIPTSFQSEVLSKQYGVPLTTLDAVDHIDIAIDGADEVDPQKNLIKGGGAAHTREKVVDYLANQFIVVVDSGKLVDRLGSVFAVPVEVIPMAITPVTNAIKQLGGKPELRMGVKKAGPVITDQGNFVLDVRFDSIDDPVNLEKILNNIPGVLENGIFVNCADIVLVGEVKDGQPLVRQL

SEQ ID NO: 534 - protein, 236 aa, Nodularia spumigena CCY9414
MSATADPVKLMKQEVGKAAAALVKSGSIVGLGTGSTTAYTIQFLGDRIKSGELKDIVGIPTSFQSEVLAKEYGVPLTTLDAVDHIDIAIDGADEVDPQKNLIKGGGAAHTREKVVDYLAEQFIVVVDSGKLVERLGSTFAVPVEVIPMAITPVTNAIKKLGGKPELRMGVRKAGPVITDQGNFVLDVRFDSIDDPVNLEKTLNNIPGVLENGIFVNCVDVVLVGEVIDGQPLVRQL

SEQ ID NO: 535 - protein, 235 aa, Nostoc punctiforme PCC 73102
MTGTDPVKLMKQEVGKAAAALVKSGSIVGLGTGSTTAYTIQFLGDRLKSGELKDIIGIPTSFQSEVLAKQYGVPLATLDSIDHIDIAIDGADEVDPQKNLIKGGGAAHTREKVVDYLAEQFIVVVDSGKLVDRLGSSFAVPVEVIPMAITPVTNAIKKLGGKPELRMGVKKAGPVITDQGNFVLDVRFDSIEDPVSLEKTLNNIPGVLENGIFVNCVDLVLIGEVKDGQPLVRQL

SEQ ID NO: 536 - protein, 233 aa, Cyanothece ATCC51142
MSDPIVMMKQEVGKAAAARVKSDSIVGLGTGSTTAYAIQYIGERLQSGELKNIVGVTTSFQAEVLARKYNIPLSTLDVVDRIDIAIDGADEVDPQKNLIKGGGAAHTQEKIVDSLAEQFIVVVDGGKLVDKLGSTFLLPVEVIPKAVVPVMRKLEQLGGKPELRMGVKKAGPVVTDQGNLVIDVKFDSIDDPATLEKTINNIPGVLENGLFVGVTDVVLVGEIIDNKPVVREI

SEQ ID NO: 537 - protein, 233 aa, Crocosphaera watsonii WH 8501
MSDPVVMMKQEVGKAAAARVKSDSIVGLGTGSTTAYAIQYIGERLQSGDLKNIIGVTTSFQAEVLARKYNIPLSTLDVVDRIDIAIDGADEVDPQKNLIKGGGAAHTQEKIVDSLAEQFIVVVDGGKLVDKLGSTFLLPVEVIPKAVVPVMRKLEQLGGKPDLRMGVKKAGPVVTDQGNLVVDVKFDSIDDPATLEKTINNIPGVLENGLFVGVTDVVLVGEIIDNKPVVREI

SEQ ID NO: 538 - protein, 233 aa, Cyanothece sp. CCY0110
MSDPIVMMKQEVGKAAAARVKSDSIVGLGTGSTTAYAIQYIGERLQSGDLKNIVGVTTSFQAEVLARKYNIPLSTLDVVDRIDMAIDGADEVDPQKNLIKGGGAAHTQEKIVDSLAEQFIVVVDGGKLVDKLGSTFLLPVEVIPKAVVPVMRKLEQLGGKPELRMGVKKAGPVVTDQGNLVVDVKFDSIDDPATLEKTINNIPGVLENGLFVGVTDIVLVGEVIDNKPVVREL

SEQ ID NO: 539 - protein, 237 aa, Cyanothece sp. PCC 8801
MTMTNDPVVIMKQEVGKAAASRVKSDSIVGLGTGSTTAYAIEYIGERLKSGDLKNIVGVTTSFQAEVLARKYGIPLTTLDVIDRIDVAIDGADEVDPNKNLIKGGGAAHTQEKIVDSLAEVFIVVVDSNKLVDKLGSTFLLPVEVIPKAVTPVMRQLEQLGGKPELRMGVRKAGPVVTDQGNLVIDVKFEGIDDPATLEKTINNIPGVLENGLFVGVTDIVLVGEIIDGKPSVREIC

SEQ ID NO: 540 - protein, 237 aa, Cyanothece sp. PCC 7424
MTVTNDPVVLMKQEVGKAAAQRVHSDTIIGLGTGSTTAYAIQYIGERIQTGELKNVVGVPTSFGAEVLARKYGVPLTTLDVIDKMDLAIDGADEVDPQKNLIKGGGAAHTREKIVDSLADVFIVVVDSGKLVDKLGSTFLLPVEVIPMAVTPVIKALEKLGGKTDLRMGVKKAGPVVTDQGNLVIDVKFDNIEDPANLEKTINNIPGVLENGLFVGVADLILVGEIIDGKPRVREIS

SEQ ID NO: 541 - protein, 236 aa, Microcystis aeruginosa
MTAIDPVIIMKQEVGKAAANLVQSNSVVGLGTGSTTAYAIEYLGARLQSGEISNIVGVPTSFQAQVLARKYGIPLTTLDVIAKMDIAIDGADEVDPQKNLIKGGGAAHTQEKIVDSLADIFVVVVDGNKLVDKLGSTFLLPVEVLPMAMTPVMRKLEALGGKPSLRMGVKKAGPVVTDQGNLVIDVKFDSIDDPADLERTINNMPGVLENGLFVGVADLILVGEIIDGKPVVREIR

SEQ ID NO: 542 - protein, 236 aa, Microcystis aeruginosa
MTAIDPVIIMKQEVGKAAANLVQSNSVVGLGTGSTTAYAIEYLGARLQSGEISNIVGVPTSFQAQVLARKYGIPLTTLDVIVKMDIAIDGADEVDPQKNLIKGGGAAHTQEKIVDSLADIFVVVVDGNKLVDKLGSTFLLPVEVLPMAMTPVMLKLEALGGKPSLRMGVKKAGPVVTDQGNLVIDVKFDSIDDPADLERTINNMPGVLENGLFVGVADLILVGEIIDGKPVVREIK

SEQ ID NO: 543 - protein, 235 aa, Synechocystis PCC6803
MAELDAANLMKQAVGKAAADRVKSNTIVGLGTGSTTAYALEFIGDRLKKGELENVVGIPTSFQAEVLARKYGIPLTTLDVADRIDIAIDGADEVDPQKNLIKGGGAAHTREKIVDALAETFLVVVDSGKLVDKLGSTFLLPVEVIPMALTPVMRALAKLGGKPELRMGVKKAGPVVTDQGNLVIDVKFDAITNPAELEKTINNLPGVLENGLFVGVADVILVGEIIDGQPTVREF

SEQ ID NO: 544 - protein, 233 aa, Synechococcus PCC7002
MDAVTVMKQEVGKVAAALVQSNSVVGLGTGSTTAYAIQYIGERLAAGELENIVGIPTSFQAEVLAKQYKIPLSSLDAVDHIDVAIDGADEVDPQKNLIKGGGAAHTREKVVDALANKFVVVVDSGKLVDRLGSTFLLPVEVIPMAITPVMRQLEALGGKPELRMGVKKAGPVVTDEGNLVVDLKFAGIDDPATLEQKINNIPGVLENGLFVGVADVILVGEIIDGQPRVREIQ

SEQ ID NO: 545 - protein, 235 aa, Acaryochloris marina MBIC11017
MSAVDPVKLMKQQVGKAAADRVQSGSIVGLGTGSTTAFAIQFLGDRIKSGALTDIKGIPTSFQASVLAKQYGIPLTTLDEVDRIHIGIDGADEVDPQKNLIKGGGAAHTREKVVDSLAEQFIVVVDQSKIVDKLGSTFPVPVEVLPMAIAPVVKALEKLGGKPELRMGIKKDGPVITDQGNMVLDVTFSDIPNPPELEKTINNIPGVLENGIFVGMTDIVLIGEIKDGNPTVREM

SEQ ID NO: 546 - protein, 232 aa, Synechococcus sp. PCC 7335
MDPVKLMKQEVGRAAAAQVKSGTIVGLGTGSTTAYAIQFIGERIASGELTDIKGIPTSFQASVLAKQHGIPLTTLDEVDHIDIAIDGADEVDPQMNLIKGGGAAHTREKVVDGLAERFVVVVDSSKLSDKIGTIFALPVEVLPMAVSPVTRALEKLGGKVEMRMGIQKDGPVITDQGNMVLDVRFGGIDNPAEMEVTINNIPGVLENGLFVGLASEVLVGEVKDGEATVRSM

SEQ ID NO: 547 - protein, 232 aa, Synechococcus elongatus
MDPVTHMKHEVAKAAASRVQSGMVVGLGSGSTAALMIQYLGDRVRNGELTNIQAVPTSFQSSVLANEYGIPLTTLNEVDRIDIAIDGADEVDPQRNLIKGGGACHTREKLVDARAEQFIVVVDSSKLVEALGTTFLLPVEVLPEAYIQVGKALEKLGGKPELRMAVKKAGPVVTDQGNLVLDVKFDRIDQPAELEKAINNIPGVLENGLFVGLTDLVLVGEVDGDRVSVREF

SEQ ID NO: 548 - protein, 241 aa, Synechococcus elongatus
MLLNTRKPVMDPVTHMKHEVAKAAASRVQSGMVVGLGSGSTAALMIQYLGDRVRNGELTNIQAVPTSFQSSVLANEYGIPLTTLNEVDRIDIAIDGADEVDPQRNLIKGGGACHTREKLVDARAEQFIVVVDSSKLVEALGTTFLLPVEVLPEAYIQVGKALEKLGGKPELRMAVKKAGPVVTDQGNLVLDVKFDRIDQPAELEKAINNIPGVLENGLFVGLTDLVLVGEVDGDRVSVREF

SEQ ID NO: 549 - protein, 226 aa, Physcomitrella patens
MVVGLGTGSTSSMAIEELGKLAQNKLKDVQFVATSYQSRVLSRQFGVKTMDLNDVNHIDIAFDGADEVDSNMNLIKGGGAAHTMEKVVDSIAKHCVILVDETKVVKTLGLTFPVPVEVLPFALAPVLRALAALGGQPEIRTALRKDGPVMSDLGNMIVDVRFPDGVKNPAELERKINMIPGVVENGLFVNVAHTVLVGTKDGEETSVVTFADFVQTLRNSELEVSS

SEQ ID NO: 550 - protein, 237 aa, Candidatus Methanoregula boonei 6A8
MAGTADAVAAAKRAAGYQAAEMVEDGMVIGLGTGSTVFYAIECLSGRIRDGLSVVGVPTSYQTAMKAREYGIPLTTLDDNPVLDLAIDGADQADPQFRLIKGRGAAITREKCVASAAFRFIVVVDEAKMVKKLAGVVPVETLPFATKTALAQLRGLGCRPFIREAVKKDGPVITDNGNFIVDCQFEEIPDPALLEAGIAAIPGVIESGLFTRLTGNTTIIVGNEKKCSVLTSPDVVP

SEQ ID NO: 551 - protein, 237 aa, Candidatus Methanosphaerula palustris E1-9c
MVDASAQAVGKREAGYRAADMVADGMVVGLGTGSTVFFAMERLAARIREGLVITGIPTSFQTAIRARGCGIPLATLNDYPVIDLAIDGADQVDPGFALIKGRGAAQTQEKCVAFAAKSLVIVADPSKLTRKLDAVVPIEVLSSAYVPVIRYLKTIGGVPVLREGIKKDGPVITDNGNMVIDCGFGTIGDPTALDIHLSSIPGVVTCGLFTTFADKTTVVVGDSNGCQVLSRNGQFPL

SEQ ID NO: 552 - protein, 227 aa, Methanoculleus marisnigri
MSAEKRNAGYRAAEEVEDGMVVGLGTGSTVFFAMERLGKRIAEDRLSIAGVPTSYQAAIRARRYGIPLTSLDEYPELDIAIDGADQVDPALCLIKGRGAALLREKCVCDAAQRAVIVVDGTKMVEALNAPVPVEVLPFAVEAVSRRLAALGADPVLREAVKKDGPVVTDNGNFILDCSFGTIADPGRLETAIASIPGTLECGLFSAYTEKITVIVGEEKGCSVVSLH

SEQ ID NO: 553 - protein, 222 aa, Methanocorpusculum labreanum Z
MDAVTEAKRNAGYRAADLVKDGMIVGLGTGSTVFFAMERLGERIASEGIRIFGVPTSNQTAMRAEEYGIPLTTLSLHPVLDIAIDGADQVTPSKQMIKGRGAAHLREKIVADAAKQFVVVIDSAKEVSVLDAAVPIEILPFAYGSVCRKLASLGGEPVMRNGVKKDGPVISDNGNYIFDCAFGKVDDPSGLESAINAIPGVLENGIFAKMTEKTLIIVGKSA

SEQ ID NO: 554 - protein, 235 aa, Methanospirillum hungatei
MNTSGLSPQEQAKKRAGYKAADYITNGMTVGLGTGSTVAFTMARLKERMTEEGLLIVGIPTSIQTTMRAGALGIPLIGLEQAEKIDITVDGADQIDPEMRLIKGRGAAHVRERIVADASTRLIIVADPSKICSHLTGPIPIEIIPFSFSHVIRRLNEMGGMVTVREGVKKDGPVISDNGNIILDYTPVSIPDPSALETAINMIPGVVSCGIFAEFTSKTTVIIGEESGPRIIGLP

SEQ ID NO: 555 - protein, 236 aa, Rhodothermus marinus
MQETLSAADRAKKAAGEKVAAMVEPGMRLGLGTGSTAAWAIRALGRRVREEGLRVVGVPTSYAAEQLARAEGIPLVTLADVEALDLAFDGADEVSPELNLIKGRGAAHTREKVVASLARRFVVLVDESKLVDRLGTRWPVPIEVLPMAAEPVLRQLRRMGAEPVLRMGKCKDGPVVTDQGFWVIDARFPGGIDDPHALAVTLSTMPGVLDHGLFLGLATDVLVGQADGQVRHIRRP

SEQ ID NO: 556 - protein, 274 aa, Salinibacter ruber DSM 13855
MRGPSTRHDVRADQGPRRRCQNAIDGCPPQHISDTLPSLTRSSMDRDTAKQAAAEAAAQLVRDGMCVGLGSGSTTAYALEFLGRRIQAEDLDVQGVPTSFATERRARTHGIPLTSLDDTPSLDLALDGADEVDDAFRLIKGAGGAHAREKVVAHQADRFVVLVDPTKEVSRLGTQFPVPVEVLPMAATPVMNALDAAGATPTLRTADAKDGPVVTDQGLWIIDARFPDGIENPDALNRRLCDRPGVLDHGLFLDMATDVLVGRPDESVDHRSAS

SEQ ID NO: 557 - protein, 234 aa, Methanosarcina mazei Go1
MTERNTSTDSPEKRAAGIAAAGLVSSGMVVGLGTGSTVAYTIKELGRRVKEEGLDILGVVTSYQSEMLAIDAGIRLTTLSQDPELDIAIDGADQIDSNLYTIKGGGAAHTREKIVSVSAKRFVVVADDSKTSTQLDKPVPVEVLPFAKEPAVNRIRKLGGEPRLRSAVKKDGPVITDNGNFVLDVEFGVIKDPEALALQLSAVPGVVEHGIFSNVDELYIGKKDGSVKIISRQK

SEQ ID NO: 558 - protein, 234 aa, Methanosarcina acetivorans
MTERNTSTDSPEKRAAGIAAAGLVSSGMLVGLGTGSTVAYTIKELGRRVREEGLDILGVVTSYQSEMLAIEAGIRLTTLAQHPELDLAIDGADQIDSELRAIKGGGAAHTREKIVSVSARRFVVVADESKTSKQLDKLVPVEVLPFAKEPVVKKIRELGGKPQLRSAVKKDGPVITDNGNFVLDVEFGVIKDPEALALQLSSIPGVVEHGIFCNVSELYIGNKDGAIKIITRQK

SEQ ID NO: 559 - protein, 232 aa, Methanosarcina barkeri
MTERNISTDSPEKRAAGIAASRMVESGMVVGLGTGSTVAYTIKELGRRVRDEGLEILGVVTSYQSETLAIEAGIPLTTLAQHSELDIAIDGADQVDSKLHAIKGGGAAHTREKIVSASARRFLVVADESKTSTQLDKPIPVEVLPFAKTLVIKKIKQLGGKPEPRLALRKDGPVITDNGNFVLDANFGVINDPEGLALQLSSIPGVVEHGIFSNVDELYIGKKDGSVEIVKK

SEQ ID NO: 560 - protein, 231 aa, Methanococcoides burtonii
MKERNANASSSEKEAAGNAAASLVEDGMIIGLGTGSTTAFAIAEVGRRVREEGLNVLAVVTSYQAEMLAIEAGVPLTSLAEHPVLDLAIDGADQVDAKLNVIKGGGAAHTHEKVVAHSAKRFIVVVDESKISEELDHFVPIEVLPYARELAKKQFIELGGKPQIRLASRKDGPVISDNGNVIIDVEFGVIEDAAELSQKLSTCVGVVEHGIFLNTDEVYVGMKDGSVKIIN

SEQ ID NO: 561 - protein, 239 aa, unknown
  unclutured
MKDRSSHDTDGSKSREKEASALSAVTLVADGMIVGIGTGSTAGYAIVELGRLVARGIDILCVPTSYQSEMLAAQQKIPITTLSEHPKLDIVLDGADQIDRNLVAIKGGGAAHTREKVIAHAASRVVLMADHEKVVPGLDHAVPIEVLPYARTLVEREVRALGGIPELRMAARKDGPVVTDNGNFVIDADFGAIDDPARLSGELSALVGAIEHGIFLNVDEVHIGTADGVKVLKRQGLRK

SEQ ID NO: 562 - protein, 228 aa, unknown
  uncultured archaeon
MKGDNKRREKEKAAESASSLISDGMVVGLGTGSTAEIVIREIGNRIKTEEFEIFGVPTSLRTEMVAIECGIPITTLSEHPSLDICIDGADQVDSELNLIKGGWGSHTREKIVSYAAKKLVICVEEEKIMEQLTKPVPLEVLPYAVKIVEKQVKKLGGEPALRSEGTRGGYSVTEHGNLVIDADFGVIHNPEEMSTALSSVVGSLEHGIFTNAAEVHVGNEKGVRVLKR

SEQ ID NO: 563 - protein, 230 aa, Methanocella paludicola SANAE
MKDHSGSDLARKNAAVKACELVEDGMAVGLGTGSTTAYAIRELGRRVDEGLDIVGVPTSYASEALAIECNIPLSTLAECPELDIDIDGADQVDSSLNVIKGGGAAHTKEKIVSCSSKMFAVVIDGNKLKDVLNRGVPIEVLPYARRLVEKKIAGLGGKCTVRTGSGKDGPTISDNGNFIMDCDFGVINKPAALAEALAQIPGLVEHGIFTNADFVYVGYEDRVERLERKK

SEQ ID NO: 564 - protein, 234 aa, unknown
  uncultured methanogenic archaeon RC-1
MASMKNLSGSDAAKKNAAEKACELVTDGMIVGLGTGSTVAHSIRLLGRWVKEEGLNIVGVPTSYSTEALAIECGIPLTSLAASPVLDIAIDGADQVDASLNAIKGGGAAHTREKIVASSAKQFVIVADDKKFSSILDRSVPTEVLPYAVKLVEREILKLGGTCTVRTGTGKDGPIITDNGNFVLDCAFGQIKEPALLGDKLSRIPGLVEHGIFTNAAMVYVGYENRVEVLRRKM

SEQ ID NO: 565 - protein, 206 aa, Methanosaeta thermophila PT
MVVGLGTGSTVAWTIRAIGRMVAEGLDILAVPTSYQSEALAIECGIPLTTLSQNPVLDLAIDGVDQIDIRMNAIKGGGAAHTREKVVSIAARRFVVVADGSKRVEVLNRPVPVEVLPFAAMVVERELVRIGGYPVVRQARMKDGPVITDNGNFVMDVSFGEIRDPATLAQEISQIPGVVDHGIFTKIDELHIAHNGTVEVIRRNDL

SEQ ID NO: 566 - protein, 225 aa, Natronomonas pharaonis DSM 2160
MKQSGGTEAQKRRAGKQAADAVEDGMVVGLGTGSTAAASIRELGQRVEEGLDIRGIPTSYQSRQLAREADIPLTTLEEATPDVAIDGADQVAAGDLIKGGGAAHAREKLVDAAADRFLVVADETKLSPTLDIPVPVEVLPDAAPVVQRQVAALGGEPTLRAAERKDGPVVTDNGNLVIDCAFGEIAEPAALAEELSALPGAVEHGLFVGLADEILVGTDDGVDVR

SEQ ID NO: 567 - protein, 250 aa, Natrialba magadii ATCC 43099
MYNVFLLAARLTNQTMKTEGGSDTAKQHAGERAADAVEDGTVVGLGTGSTAAYAIEAIGQAVADGLDVRAIPTSFQSRQLALEYDIPLTTLDAVDGVDLAIDGADQVVDDPESAAHGALIKGGGGAHAREKLVDAAADRFLVVADPSKLTTDLDRSVPLEVLPDAHTVVTERVRALDGEPTLRDAEHKDGPVVTDNGNLLLDCEFGTIADPDALATTLASIPGVVEHGLFVGLADVTYIGTADGVDVRTY

SEQ ID NO: 568 - protein, 228 aa, Halogeometricum borinquense DSM 11551
MKTTGGTDDQKRRAAERAADLVETGATVGLGTGSTAAFAIRALGRAVEDGLDIRGVPTSFASRELAREEGIPLVAVDEVETIDVAIDGADQLDGDLNLIKGGGAAHAREKIVDAMADRFVVVADPSKVTETLERAVPLEVLPDARTAAAARVSELDGEATLRRAERKDGPVVTDNGNLVLDCEFGQISDPESLAADLSATPGVVEHGLFVGLADEAYIGTDDGVDVQS

SEQ ID NO: 569 - protein, 240 aa, Halorubrum lacusprofundi
MKTSGGSDAAKRRAGESAAETVTDGEVVGLGTGSTAAHAIRRLGDRVDSGLDIRGVATSFASRELAAECGIPLLDLDEAVGSDATGIDIAIDGADQVAVGEGESEVGPLIKGGGAAHAREKLVDASADRFLVVADPSKETPVLNRSVPVEVLPAGRSAVAEAVRAAGGEPTLRRAERKDGPVVTDNGNLVLDCAFGEIADPDALSTTLSTTPGVVEHGIFVGLADEVHVGTETGVRVARR

SEQ ID NO: 570 - protein, 228 aa, Haloarcula marismortui
MKQGGSDAAKQAAGESAAEAVEDATVVGLGTGSTAAYAIRAIGQAVDAGLDVVGVPTSFQSRQLARDCGIPLADLDDVSVDLAIDGADEVASGNLIKGGGAAHAREKIVDASADRFLVVADPTKEAAVLSYPVPVEVLPMARSTVVTAVEELGGDPTLRRAERKDGPVVTDNGNLVLDCDFNSIHDPAALASDLAALPGVVEHGLFVGMADEIHVGTADGVTVRTLSK

SEQ ID NO: 571 - protein, 226 aa, Halomicrobium mukohataei DSM 12286
MKQGGSDDAKRAAGESAAEAVEDGMVVGLGTGSTAAHAIRAIGAAVDAGLDVTGVPTSFQSRELAREAGIPLTDLDAAEIDLAIDGADQVAGGCLVKGGGAAHAREKIVDTAADRLLVVVDPTKEADVLDHPVPLELLPAARRPVAAAVERLGGEPELRRAERKDGPVVTDNGNLVFDCAFGAIADPAALAADLATIPGVVEHGLFVDVADEIHGGTADGVTVTEL

SEQ ID NO: 572 - protein, 228 aa, Halorhabdus utahensis DSM 12940
MDEQTRDAAKRRASESAVEAVSDGDVVGLGSGSTAEHAIRILGDRVEEGLDIVGVTTSFQAREIAIEKGIDLTTLDETDGHIDVTIDGADQFAGSDLIKGGGAAHAREKIVASATDSLQIVADPTKETDVLDTVVPVEVLPDARTTVANAIRELGGEPELRWAKRKSGPVVTDNGNLLFDADFGAIDDPETLATEIATIPSVVEHGIFPGYADAVHMGTEDGVTVFEY

SEQ ID NO: 573 - protein, 225 aa, Halobacterium sp. NRC-1
MKQAGGSAEQKRRAGEAAVAEEVTEGAVVGLGTGSTVAHAIRALGAEASDVSGVATSFESRRRAVDAGVTVTSLEAASVDVAIDGADQVADGVLVKGGGAAHTREKYVAASADRFVVVADPSKESDVVDVPVPVAVVPDAWPVVVDRVEALGGTATLRDAERKDGPVVTDTGSLVVDCDFGAIETPEAVAASLSAVPGVVEHGLFVGMADAVYVGTDDGVRVRDP

SEQ ID NO: 574 - protein, 236 aa, Haloquadratum walsbyi DSM 16790
MKTTGGSEEQKRRAGEKAVEYVNDGDIVGLGTGSTAAAAIDALGDAVAAGYDIHGVPTSFATRDRAIEAGIPLTRIEAVDHIDVAIDGSDEINNNLTLIKGGGAAHAREKVIDATADQFIVVADESKLVETLSEPVPVSTLPMAQKPVKHRLDSLGATTTLRSATMKDGPVITDNGNIVFDCAFGHIENAEALAKSLAEIPGTVAHGLFVNLADVACIGTENGTNVYHGDQDQGQN

SEQ ID NO: 575 - protein, 224 aa, unknown
  uncultured marine crenarchaeote HF400_APKG3H9
MTYDDAIKALSNDALKLVKNHQTIGLGSGRAATAFVKSLSLFVKKKKLSIKCIPTSLQIKLEAEKGKLHLIDTVLDKIDIVFDGADQIDKGKNLIKGGGGALLRENILINAAKKVVIMADDSKFVTNFNRDVPVEVHHLARNTVAKHISKIGGRSRIRTLDRGYPFITENGNIILDCNFGVIKKPKLLQEKIKKISGVLEVGIFTRKPDIIYKARSTGKFDVIK

SEQ ID NO: 576 - protein, 224 aa, unknown
  uncultured marine crenarchaeote HF4000_APKG7F11
MTYDDAIKALSNDALKLVKNHQTIGLGSGRAATAFVKSLSLFVKKKKLSIKCIPTSLQIKLEAEKGKLHLIDTVLDKIDIVFDGADQIDKGKNLIKGGGGALLRENILINAAKKVVIMADDSKFVTNFNRDVPVEVHHLARNTVAKHILKIGGRSRIRTLDRGYPFITENGNIILDCNFGVIKKPKLLQEKIKKISGVLEVGIFTRKPDIIYKARSTGKFDVIK

SEQ ID NO: 577 - protein, 224 aa, Nitrosopumilus maritimus SCM1
MSYDGAITALSNNALKFVKDDYVVGLGSGRAATVLVKSLGKLIKLKNYNIKGVPTSLQIKLIAEKVGIPLIEADQVEHIDVVFDGADQIDSQKFVIKGGGGALLRENILFSLAKKVVVMADKTKFVKNFTRTVPVEVHPLARNSVSKSMKKLGGKAELRSLDRGYPFFTENGNIILDCDFGTIKNPKALTQKIKATTGVLESGIFLRKPDVIYRAKTGEKFDIL

SEQ ID NO: 578 - protein, 225 aa, Cenarchaeum symbiosum
MTALEDAFRAISADALNMVKDGQVIGLGSGRAAAVLVRELASRARSERMNITGVPTSLQIRLVAEECGISLRDPGDTDKIDIVFDGADQVDRQGNLIKGGGGALLTESILIGMADKVVIIADESKFAEHLDAPVPVEVHPAARRSAAESVMRLGGKPVLRLLDRGFPLFTENRNLVLDCSFGTITDPSTLRDKLTDIPGVAEAGIITRRPDTTYRAKTDGGFDAI

SEQ ID NO: 579 - protein, 230 aa, unknown
  uncultured crenarchaeote 31-F-01
MNTITMTRMLESAVYEHVRDGMIIGLGSGRTVAALLDVLARMSRSMGIDMASIRFIPTSLQIKMKAEELKMSIGDESLIPSVDLVFDGADQIDANSLVMIKGGGGALLREKVLMYAAKKVVILADESKYVDKLTLPIPIEVVPYARAYVSNMLRSMYAEPSVRVNDRGYPIMTENGNIIIDTVFSSIEDPYNLEHRLKCIPGVVEVGLFSKAADLYYKARGDGRFDVIGR

SEQ ID NO: 580 - protein, 262 aa, Ricinus communis
MVIGLGSGHASGMAIQYLGRQLRIGVLKDIVGIPMSIASASEAAKAGIRLDRYQDGSQIDFAFDDADVLEEDTLIAVVGRQKMQGEESFIQEKSILNAASRHVFMISEKQYKSRLDGSIPVLIQPLSWMETAEQIDDLFLGDAEIWRRPSIGQAGPLGGDFPLVTREGHNVLDVIFTSPIQSLAEVAESLDKVDGVVDHGIISKFPCTAVIASDSGLYIVNNPSTDAETVVLIWMSDKETCLIWIPLSPAAVASISQLENSV

SEQ ID NO: 581 - protein, 232 aa, Physcomitrella patens
MSVGLGTGHASGMAIAYIGERLRDGTLRDIICVPMSSASAAAAAQAGVPLTTFEDQPQLDVAFDDADMVQEGTLFAVIGRKGVEGRQSILKEKAIMQAAKQLVFIIDEKQFVGKLEGAVPVLIQQEDWLDVAEEIDDMFLGDAEVWRRPSFGEAGPLGGDNPLITPEGHFLLDVIFTTPITTAADVVENLETVPGVMGHGLVMDVAYAAAVASPTGMKLRTSLFKTAFTAME

SEQ ID NO: 582 - protein, 294 aa, Vitis vinifera
MASSAIPFSHLNLHLPLSRASLARADCLATTRCRFPSVTRSCLADASSALLQAAKHTVDTYIKSGMVIGLGSGHASDMAIQYLGRQLRTGALKDITGIPMSVASASEAAKVGIPLGHYQDCSQIDFAFDDADVIEEGTLVAIIGRRRLQGNESIIQEKSILKAADKLVFIIQEKQYKCDLEGLIPVLVQSLNWMETAEEIDDLFLGDAEVWRRPSIGHAGPLGGDFPLVTSEGHNILDVIFTSPILKLAEVAESLDKIDGVVEHGVISKIPCIAVITSDSGMYTVDNLQAVRER

SEQ ID NO: 583 - protein, 285 aa, unknown
  Populus trichocarpa x Populus deltoides
MASLATSTLVYSTPVRIKTSSKPRSSSRTCKKTVPFLVTRADSSSLLLHAAKHTVDKHIQSGMVVGLGSGQASGMAIQYLGRLLRTGALKDIVGVPMSVTSASEAAKAGIPLDVYQDSSQIDFAFDDADIIEEETLVAIIGRQKSQSDESIIQEKSILKAANKLVFMITENQYVGGLEGSIPVLVQALNWMETAEEIDDLFLGDAEVWRRSSIGQAGPTGGDYPFITREGHNVLDVIFTSPVQSLAEVAESLDKVDGVVDHGVFSKFPCTVVIAAESGGLNIVDR

SEQ ID NO: 584 - protein, 285 aa, Populus trichocarpa
MASLATSTLVYSTPVRIKTSSKPRSSSRTCKKTVPFLVTRADSSSLLLHAAKHTVDKHIQSGMVVGLGSGQASGLAIQYLGRLLRTGALKDIVGVPMSVTSASEAAKAGIPLDVYQDSSQIDFAFDDADIIEEETLVAIIGRQKSQSDESIIQEKSILKAANKLVFMITENQYVGGLEGSIPVLVQALNWMETAEEIDDLFLGDAEVWRRSSIGQAGPTGGDYPFITREGHNVLDVIFTSPVQSLAEVAESLDKVDGVVDHGVFSKFPCTVVIAAESGGLNIVDR

SEQ ID NO: 585 - protein, 224 aa, Oceanobacillus iheyensis HTE831
MEYSDKQIAAQEAVRYIKDGMVIGIGSGSTVNEFLYCLAARMRKERLQVVGIPASKKSERLATELGIPLTTFATYQNVDIAIDGTDEIDDQLYLVKGGGGSLVREKMIDLVAETFIVIASGKKKIKKLGSFPVPVEVVPFGWQATEQRLQQFGCQTNLRMVEEDIFVSDNQNYIIDCDFKEIDDAEALHRSLKQIVGVIETGIFINMVDKAIVADNGELSILEK

SEQ ID NO: 586 - protein, 231 aa, Candidatus Liberibacter asiaticus str. psy62
MDALQMKRNAARRAIQYVVDGMTLGMGTGSTAKEFMILLADKIANGFRVQVIPSSRNTENFCKIHHIPLHSPEDVSSVDLSIDGFDEIDSRLRLIKGYGGALLREKIIAHAASRFIVIGDESKRVDFLGRGMLPIEIDQFGVNKTLSALKEVASCFGLNEELRLRRNGSGLFVSDGGNYIVDAFFGFIPDPQIISGELCNIPGVIEHGLFINMVDCAIIGTSDGECLVLQK

SEQ ID NO: 587 - protein, 227 aa, Thermus thermophilus
MERPLESYKKEAAHAAIAYVQDGMVVGLGTGSTARYAVLELARRLREGELKGVVGVPTSRATEELAKREGIPLVDLPPEGVDLAIDGADEIAPGLALIKGMGGALLREKIVERAAKEFIVIADHTKKVPVLGRGPVPVEIVPFGYRATLKAIADLGGEPELRMDGDEFYFTDGGHLIADCRFGPIGDPLGLHRALLEIPGVVETGLFVGMATRALVAGPFGVEELLP

SEQ ID NO: 588 - protein, 227 aa, Thermus aquaticus
MERPLEAYKKEAAHAAVAYVEDGMVVGLGTGSTARYAVLELARRLREGELKAVRGVPTSEATRDLALKEGIPLVDLPPEGVDLAIDGADEIAPDLSLIKGLGGALLREKIVEATAREFIVVADHTKKVPVLGRGVVPVEIVPFGHQATLRAIAHLGGEPALRMDGDEFYFTDNGHLIADCRFGPIGDPLGLHKALLEIPGVVETGIFVGLATRALIGGPMGVEELLP

SEQ ID NO: 589 - protein, 230 aa, Meiothermus silvanus DSM 9946
MNDLETYKRQAALEAVRHVQSGMVVGLGTGSTARYAVMELGRRIREGEVKNIRAVPTSEATALLARDAGIELLELGPEGVDLAIDGADEVAPDLALIKGLGGALLREKIVESNARRFLVVADYTKRVEQLGRGVVPVEIVPFGYRATLAKLAQLGEPSLRMAGEEPFYSDGGNLIADVRFGPISDPQGLEARLKSIPGVVESGLFVGIATEAVLAGPDGVQVLGRGGVGG

SEQ ID NO: 590 - protein, 228 aa, Meiothermus ruber DSM 1279
MNDQENFKQQAALEAVKFVRSGMVVGLGTGSTARYAVLELGRRLREGELSDVVAVPTSEATARLAQSQGIPLVELEARGVDLAIDGADEIAPDLSLIKGLGGALLREKIVEANARQFIVIADHSKKVGQLGRGVVPVEIVRFGYRATLQALGRMGKATLRMNGEEFFYSDGGNLIADIDFGPIPKPGDLEVELKRIPGVVESGLFIGLATLAIVAGPEGLEYLGTPPQ

SEQ ID NO: 591 - protein, 231 aa, Rubrobacter xylanophilus
MSPDGMERLKRAAAREAVDRYVESGMVVGLGTGTTASWAVRRIGERLLEGSLSGVRGVPTSEYTAALARECGVPLVSLSERRPELTIDGADEIAPDLSVIKGRGGALLREKIVAAASRRGVVIVADGSKQVSLLGNGPLPVEVEPFGWEATAEALAALGCEPELRRVKTQPFVTDGGHYTLDCRFPGIPDPPGLACKIKRVPGALECGLFVGLARAAVIARPEGVEVLEAA

SEQ ID NO: 592 - protein, 228 aa, Deinococcus deserti VCD115
MSDLEALKKEAAVRAAALVESGMRVGLGTGSTAKYAIEELGRRIASGELKDIVGVATSEASDQLARQLGIPVEPLDPRPLDIAIDGADEIDPKLNLIKGLGGALLREKLTEVQARRFIVIADHTKTVTHLGEKAPVPVEIAKFGFLSTIERLRAMGLGGRLRQPGAQPYVTDNGNHIFDAQLPESFDPATLERQLKGTLGVVETGFFLGMAERAFVASPDEVRELTPV

SEQ ID NO: 593 - protein, 228 aa, Deinococcus geothermalis DSM 11300
MPDLEALKKEAALRAVTLVRSGMRVGLGTGSTAKYAILAIGERLASGDLRGVVGVATSDASEVLARQVGIPVEPLDPRPLDLAIDGADEIDPALNLIKGLGGALLREKLTEVQARQLVIIADHTKLVTRLGEQAPLPVEIARFGFLSTIERLRALVPGGRLRQPGAQPFVTDNGNYIYDAQLPQSFDPVALERQLKGTLGVVETGFFLGMADLAFVAAPEGVRELRRP

SEQ ID NO: 594 - protein, 226 aa, Deinococcus radiodurans
MDLEALKKEAALRSVALVQSGQRVGLGTGSTAKYAIEELGRKLAAGELSGIVGVSTSEASEKLAREVGIPTEPLDPRPLDIAIDGADEIAPNLDLVKGLGGALVREKMTEVQAKRLIIIADHTKLVTRLGEKAPLPIEIVPFGFLSTIERLREFLPGGRLRQPGAQPYVTDNGNYIFDAQLPAEFDARELERRIKGTLGVVDTGLFLGMAERAFVAAPDGVQELTR

SEQ ID NO: 595 - protein, 239 aa, Chloroflexus aurantiacus
MNTTSTETRKAMAAAAAVALVRPGMVIGLGFGSTAAYATRMIAERLHQGDLNDIVGVPCAEGTAQLARELGIPLTTLDEVAAVDLTIDGADEVDPQLSLIKGGGGALLREKMVAQASRRVAIIVDDSKLSPALGTRFALPLEVVDFGWRATARWLEAQGGTVQLRLRADGQPFRTDQGNLILDWKCGPLNDPAALAAQLSARAGIVEHGLFIGLATDLFVAGPDGVQHVTTSDCGTIAW

SEQ ID NO: 596 - protein, 237 aa, Chloroflexus aggregans DSM 9485
MSSVETLKAMAAAAAVALIQPGMVIGLGFGSTAAYATRMIGERLANGELREIVGVPCAEGTAALARELGIPLTTLDDVERVDITIDGADEVDPYMALIKGGGGALLREKMVAQASRRVAIIVDESKLSPALGTRFALPIEVVDFGYRATARWLAAQGGSVRLRLRSDGQPFRTDQGHLILDWACGPIADPTVLADRLAARAGIVEHGLFIGLATDLFVAGATGVRHIVRPDCGRIAP

SEQ ID NO: 597 - protein, 236 aa, Myxococcus xanthus
MSQQGDGAATARYKQAAAEWAVDGFLQPGMVVGLGTGSTAAFAVQRLAALRAQGRLLDIVGVPTSRATEALARSLGVPVSTLDAHPVLDVTLDGADEVAPDLSLIKGGGGALLREKIVAQASRRVVIVVDAGKLSPVLGTHWPVPVEVMSFGWRSQARFLESLGARVTVRQGAGGEPFLTDQGNLVLDCAFGPIDAPAALAASLGARAGIMGHGLFLNLATDLVVAGPEGVEHRAR

SEQ ID NO: 598 - protein, 235 aa, Desulfovibrio magneticus RS-1
MTNADSFDARKRAAAQAAAHLVGPGMAVGLGHGSTAVAVVPFLAARAGRGELAGTAFVPAARYMAQALRAAGLPVACLDDFPRLALAIDGADEIAPNLDCIKGGGGALLYEKIVAQAAERFVLVADDGKCSPALGTRHALPVEVTPFALAPTVDFLAAIGGAPTLRRRPDGDPMRTQRGNCICDCAFGPLADPAGLAALLDARAGVAGHGLFVGLAQAAFIAGPDGVQELSRPAG

SEQ ID NO: 599 - protein, 234 aa, Roseiflexus castenholzii DSM 13941
MDDHLYRRRAAERALDYVESGMAIGLGTGSTASFMLRGLAARLADGRLQRVVGVPTSEQTAVLARELGIPLTTLDRHPSLDLALDGADEIDPHLRLIKGLGGAMLREKIVAASAARFVVMASVSKRVERLGERSPLPVEVVTFGMPLCIRRLAALGGEPVLRCDHSGAPFVTDEGNLILDCHFGVIADPEALAAAICAIPGVVAHGLFLGMASLAVIAGPDGIVELECPDASRR

SEQ ID NO: 600 - protein, 233 aa, Roseiflexus sp. RS-1
MDDNLYRQRAAEHALRHVESGMTIGLGTGSTATFMLYGLAARLADGRLQRVTGVPTSEVTAALARELGIPLTTLDRQPHLDLALDGADEIDPQLRLIKGLGGAMLREKIVAASAARFVVMAAVSKCVERLGERSPLPVEVVAFGLPLCARRLKALGGAPALRRDRSGAPFVTDEGNLILDCNFGIIADPEALAASICAIPGVVAHGLFLGMASLAVIAGPDGIVELHAPSARQ

SEQ ID NO: 601 - protein, 253 aa, Physcomitrella patens
MNAIVPDGFASESDAGTKLTQDELKKIAAEKAVEYVKSGMVLGLGTGSTAAFAVAKIGELLKEGKLTDIVGVPTSKRTAEQAASLGIPLSVLDDHPKIDLAIDGADEVDPDLNLVKGRGGALLREKMVEAASAKFVVIVDETKLVKGLGGSKLAMPVEVVQFCWKYNAERLKNLPELAGCEVKLRMDGDKPYVTDNSNYIIDLYFEEPIVDANAAAQAISALEGVVDHGLFLNMASAVIIAGSDGVTVQTKDT

SEQ ID NO: 602 - protein, 295 aa, Picea sitchensis
MAKPIAAGAALSTLPSLSSSCSELNKWKPLNSNTHFHFNCNRSLNTARLSVRAMSSSTSVLTQDQLKKLAAEKAVEYVESGMVLGLGTGSTAAFAVARIGELMKAGELKDIVGVPTSKRTAEQAESLGIPLSVLDEHPKIDLAIDGADEVDPELNLVKGRGGALLREKMVEAASAKFVVIVDESKLVNGLGGSGLAMPVEVVPFCWKYNASRLQSLFQAEGCEAKLRMDGDGDKPYITDNANYIVDLYFKTPIKDSRAAAKAILGFEGVVEHGLFLDMATAVIIAGAEGVRVTTK

SEQ ID NO: 603 - protein, 295 aa, Picea sitchensis
MAMPIAAGAALSTLPSLSSSCSELNKWKPLNSNTHFHFNCNRSLNTARLSVRAMSSSTSVLTQDQLKKLAAEKAVEYVESGMVLGLGTGSTAAFAVARIGELMKAGELKDIVGVPTSKRTAEQAESLGIPLSVLDEHPKIDLAIDGADEVDPELNLVKGRGGALLREKMVEAASAKFVVIVDESKLVNGLGGSGLAMPVEVVPFCWKYNASRLQSLFQAEGCEAKLRMDGDGDKPYITDNANYIVDLYFKTPIKDSRAAAKAILGFEGVVEHGLFLDMATAVIIAGAEGVRVTTK

SEQ ID NO: 604 - protein, 287 aa, Populus trichocarpa
MASLSFLSPPSSSSLSSLHNTTPSSSRLFLRTPSLNLRAPTKIFSLKAQSAPVLTQDELKKIAADKAVEYVKSGMVLGLGTGSTAAFVVAKLGELLKTGELTNIIGVPTSKRTEEQARSLNIPLSILDDHPHIDLAIDGADEVDPLLNLVKGRGGALLREKMVEAASDEFVVVADETKLVDGLGGSKLAMPVEVVQFCWKFNLVRLQELFKDEGVEAKLRVGEDGKPYVTDNFNYIVDLYFENPIKDGYAAGKEISGLEGVVEHGLFLDMATAVIIAGKTGVEVKSK

SEQ ID NO: 605 - protein, 290 aa, Populus trichocarpa
MASLSLLPSPSSSSSSSLSSLHHTTPSSSRLTLCTPSLNVRTRTKISSIKAQSAPVLTQDDLKKLAADKAVEYVKSGMVLGLGTGSTAAFVVAKLGELLKTGELKDIIGVPTSKRTEEQARSLNIPLSVLDDHPHIDLAIDGADEVDPLLNLVKGRGGALLREKMVEAASDEFVVVADDTKVVDGLGGSKLAMPVEVVQFCWKYNLLRLQEMFKDEGVEAKLRAGEDGKPYVTDNFNYIVDLYFENPIKDGYAAGKEISGLEGVVEHGLFLDMATAVIIAGKTGVEVKSK

SEQ ID NO: 606 - protein, 284 aa, Ricinus communis
MVSLSSTTTSTSLSSLHHRSASFHINLRTRSLSLRTPTKTFSIKAQSAPVLTQDDLKKLAADKAVDYVKSGMILGLGTGSTAAFVVAKIGELLKSGELKDIIGIPTSKRTEEQALSLGIPLSVLDEHPKLDLAIDGADEVDPDLNLVKGRGGALLREKMVEAASDKFVVVADETKLVDGLGGSKLAMPVEVVQFCWKYNLIRLKELFKDEGVDAKLRLNEDGKPYVTDNSNYIVDLYFENPIKDGYAAGKEISSLEGVVEHGLFLDMATAVIIAGKTGIDVKTK

SEQ ID NO: 607 - protein, 283 aa, Vitis vinifera
MATLSLLSPPKSHSLSSLHHRNALSLRTSSTLTPRTRPLLSIRAFSAPALTQDDLKKLAADKAVDYVKSGMVLGLGTGSTAAFVVAKLGHLLKTGQLSDIVGVPTSKRTEEQALSLGIPLSVLDHHPSIDLAIDGADEVDPDLNLVKGRGGALLREKMVEAASDKFVVVVDDTKLVNGLGGSGLAMPVEVVQFCWKYNLVRLQELFKEEGCEAKLRLNPDGKPYVTDNSNYIVDLYFKTPIKDSIAAGKEISSFEGVVEHGLFLDMATAVIIAGKDGVTVKTK

SEQ ID NO: 608 - protein, 281 aa, Glycine max
MASLSLSSPPSLSSAHHNASTRLILRTPNSLKLRTPPHSLPAIRAITLTQDDLKRLAADKAVESVKSGMVLGLGTGSTAAFVVAKLGALLASGQLSDIVGVPTSKRTEEQARSLGIPLSVLDDNPRLDLAIDGADEVDPDLNLVKGRGGALLREKMVEAASDKFVVVVDDTKLVDGLGGSELAMPVEVVQFCWKYNLDRLQELFKEEGVEAKLRLEESGKPYVTDNSNYIVDLYFKTPIRDALAAGAEISALEGVVEHGLFLNMATSVIIAGKSGVEVKAK

SEQ ID NO: 609 - protein, 280 aa, Oryza sativa
MAAATVSVRFHPAASAARCGGGSRRSRRLSGVIRAQSAPASAAAAALTQDDLKRLAAVRAVEQVESGMVLGLGTGSTAAFAVAEIGALLASGKLSGIVGVPTSKRTFEQAQSLGIPLSTLDDHPRIDLAIDGADEVDPDLNLVKGRGGALLREKMVEAASDKFIVVVDETKLVTGLGGSGLAMPVEVVQFCWKYNQVRLQDLFNDEGCEAKLRLDEGGKPYVTDNSNYIVDLYFKTPIKDALAAGKEISALEGVVEHGLFLDMATSVIIAGTDGVSVKTK

SEQ ID NO: 610 - protein, 258 aa, Oryza sativa
MAAATVSVRFHPAASAARSAAAAALTQDDLKRLAAVRAVEQVESGMVLGLGTGSTAAFAVAEIGALLASGKLSGIVGVPTSKRTFEQAQSLGIPLSTLDDHPRIDLAIDGADEVDPDLNLVKGRGGALLREKMVEAASDKFIVVVDETKLVTGLGGSGLAMPVEVVQFCWKYNQVRLQDLFNDEGCEAKLRLDEGGKPYVTDNSNYIVDLYFKTPIKDALAAGKEISALEGVVEHGLFLDMATSVIIAGTDGVSVKTK

SEQ ID NO: 611 - protein, 274 aa, Zea mays
MAATAISVRLHPTAARHVASARRARLGAVRAQSAPAAAAAALTQDDLKRLAAVRAVEQVKSGMVLGLGTGSTAAFAVAEIGALLAAGKLEKIVGVPTSKRTFEQAQSLGIPLSTLDDNPLIDLAIDGADEVDPDLNLVKGRGGALLREKMVEAASDKFIVIVDETKLVDGLGGSGLAMPVEVVQFCWKYNLVRLQELFKEEGVEAKLRFEGDKPYVTDNSNYIVDLYFKTPIKDALAAGQEIAALEGVVDHGLFLNMASSVIIAGTDGVSVKTK

SEQ ID NO: 612 - protein, 276 aa, Arabidopsis thaliana
MASLSFVSSSHLTLRTPSIALRSTGSSPRTSVSFSVKAQSVALSQDDLKKLAAEKAVEAIKPGMVLGLGTGSTAAFAVDQIGKLLSSGELYDIVGIPTSKRTEEQARSLGIPLVGLDTHPRIDLAIDGADEVDPNLDLVKGRGGALLREKMVEAVADKFIVVADDTKLVTGLGGSGLAMPVEVVQFCWNFNLIRLQDLFKEFGCESKLRVDGDGKPYVTDNSNYIIDLYFKTPLKDGFAAAKEIGKFQGVVEHGLFLGMATSVIIAGKNGVEVMTK

SEQ ID NO: 613 - protein, 276 aa, Arabidopsis thaliana
MASLSFVSSSHLTLRTPSIALRSTGSSPRTSVSFSVKAQSVALSQDDLKKLAAEKAVEAIKPGMVLGLGTGSTAAFAVDQIGKLLSSGELYDIVGIPTSKRTEEQARSLGIPLVGLDTHPRIDLAIDGADEVDPNLDLVKGRGGALLREKMVEAVADKFIVVADDTKLVTGLGGSGLAMPVEVVQFCWNFNLIRLQELFKEFGCESKLRVDGDGKPYVTDNSNYIIDLYFKTPLKDGFAAAKEIGKFQGVVEHGLFLGMATSVIIAGKNGVEVMTK

SEQ ID NO: 614 - protein, 265 aa, Populus trichocarpa
MAIPCPSIFGSEMVPIESGAMSPPPSPLILTQDELKKIAAYKAVEFVQSGMVLGLGTGSTAKHAVDRIADLLHQGKLKNIIGIPTSKKTHQQAVSLGIPLSDLDSHPIVDLAIDGADEVDSNLNLVKGRGGSLLREKMIESACKKFIVIVDESKLVPHVGACGAMPVEVVPFCWKFTQDKLQSLFDYAGCVAKLRSNNGGEDGEIFVTDNGNYIVDLFFKKDVGDLKIASDAILRLAGAVEHGMFLDMATTVIVAGELGITIKNK

SEQ ID NO: 615 - protein, 264 aa, Populus trichocarpa
MAIPCPPFIGSEKLSIESGAMSPSSPSPLILTQDELKKIAAYKAVEFVQSGMVLGLGTGSTAKHAVDRIADLLHQGKLKNIIGIPTSTKTHQQAVSLGIPLSDLDSHPVVDLAIDGADEVDSNLNLVKGRGGSLLREKMIESACKKFIVIVDQSKLVAHVGASGAMPVEVVPFCWKFSQDRLQNLFDYAGCVAKLRTDNGGEKIFVTDNGNYIVDLFFKKDIGDLKVASDAILRLAGVVEHGMFLDMATTVIVAGELGITIKDK

SEQ ID NO: 616 - protein, 264 aa, Ricinus communis
MAIPCPPFIASEKLASMESSPLSPPLLSQDELKKIAAYKAVEFVQSGMVLGLGTGSTAKHAVDRIADLLHQGKLTNIVGIPTSKKTQKQALSLGIPLSDLDSHPVVDLAIDGADEVDSHLNLVKGRGGSLLREKMIESACKKFIVIVDETKLVPHIGANGGAMPVEVVPFCWKFTQEKLQSLFDYAGCVAKLRTDNGGKEEPFVTDNGNYIVDLFFKKEIGDLEVASDKILRLAGVVEHGMFLDMATTVIVAGELGITIKNKFD

SEQ ID NO: 617 - protein, 269 aa, Vitis vinifera
MAIAYPHFIGSEKSAMETGIILSPSSPSPSLPHVILTQDELKKIAAYKAVEYVESGMVLGLGTGSTAKHAVDRIGELLRQGKLKNIVGIPTSKKTHEQAVSLGIPLSDLDSHPILDLAIDGADEVDPYLNLVKGRGGSLLREKMVEGACKKFIVIVDESKLVNHLGGSGLAMPVEIVPFCWKFTAQRLQMFFEESGCVAKLRTYENGEPFVTDNRNYVVDLYFKREIGDLKVASDAILRLAGVVEHGMFLGMATTLIVAGECGVVVKDK

SEQ ID NO: 618 - protein, 271 aa, Populus trichocarpa
MAIPYHHFNLVTSEKPDMEMLFPSPVVLTQDELKRIAAYKAVEMVESGMVVGLGTGSTAKHAVDRIGELLHQGKLKNIIGIPTSTKTHEQALSLGIPLSDLDSHPVLDIAIDGADEIDPNLNLVKGRGGSLLREKMVEGVCKKFVVIVDESKLVKYIGGSGLAMPVEIVPFCWKFTAKRLQELFEYAGCVAKLRTFASCNGMENGGLPFVTDNGNYVVDLYFKRDIGDLKAASDAILRLAGVVEHGMFLDMATTVIVAGDLGVTIKNKIIK

SEQ ID NO: 619 - protein, 267 aa, Arabidopsis thaliana
MGSAFDPLVTATEDLAAVNSAPPLSNLTQEELKKIAAYKAVEFVESGMVIGLGTGSTAKHAVARISELLREGKLKDIIGIPTSTTTHEQAVSLGIPLSDLDSHPVVDLSIDGADEVDPALNLVKGRGGSLLREKMIEGASKKFVVIVDESKLVKYIGGSGLAVPVEVVPFCCDFTRGKLEELFRDSGCVAKLRMKIGSNGEEAAPAVTDNRNYVVDLYLERDIGDLEVASEAILRFPGVVKHGMFLGMATTLIVAGKFGVTVKDRFG

SEQ ID NO: 620 - protein, 267 aa, Arabidopsis thaliana
MGSAFDPLVTATEDLAAVNSAPPLSNLTQEELKKIAAYKAVEFVESGMVIGLGTGSTAKHAVARISELLREGKLKDIIGIPTSTTTHEQAVSLGIPLSDLDSHPVVDLSIDGADEVDPALNLVKGRGGSLLREKMIEGASKKFVVIVDESKLVKYIGGSGLAVPVEVVPFCCDFTRGKLEELFRDSGCVAKLRMKIGSNGEEAAPAVTDNGNYVVDLYLERDIGDLEVASEAILRFPGVVEHGMFLGMATTLIVAGKFGVTVKDRFG

SEQ ID NO: 621 - protein, 259 aa, Zea mays
MGSAATSPQPSGNLTQDELKRVAAHRALEFVESGMTLGLGTGSTAAHALDRLGDLLRAGALPGVAGVPTSLKTEAHAARVGIPLLPLDAASGASIRLSIDGADEVDPDLNLVKGRGGSLLREKMIEGAGDRFVVIVDESKLVPRLGCTGAVPVEVIPFGAPHTLGLIRKVFDGVPGFHARLRTVPAANGEDSDAPFLTDNGNYIVEMFFEDGIRGDLLDISDRLLRITGVIEHGMFLGMATTVIVANKDGTVTVINKKK

SEQ ID NO: 622 - protein, 261 aa, Sorghum bicolor
MGSAAADASPPPPSGNLTQDELKRVAAHRAVEFVEPGMTLGLGTGSTAAHALDRLGDLLRAGALPGVAGVPTSLKTEAHAARVGIPLLPLAGAGIRLSIDGADEVDPDLNLVKGRGGSLLREKMVEGAGDRFVVIVDESKLVPRLGCTGAVPVEVIPFGASHTLGLIRKVFDGVPGFHARLRTVPAAAKGDGDGSDAPFRTDNGNYIVEMFFEDGIRGDLRDISDRLLRITGVVEHGMFLGLATTVIVANKDGTVTVINKK

SEQ ID NO: 623 - protein, 263 aa, Zea mays
  misc_feature (55)..(55): Xaa can be any naturally occurring amino acid
MGSAAASPPPSGKLTQEELKRVAAHRAVEFVEPGMTLGLGTGSTAAHALDRLGDXLRAGALPGVAGVPTSLKTEAHAARAGIPLLPLPGARIALSIDGADEVDPDLNLVKGRGGSLLREKMIEGAGARFVVIVDESKLVPRLGCTGAIPVEVIPFGALHTLGLIRGLFDGLPGFHARLRTVPAAPAKGGEDSDSESEQPFVTDNGNYIVEMFFEDGIRGDLRDISDRLLRITGVVEHGMFLGMATTVIVANKDGTVSVMDRKK

SEQ ID NO: 624 - protein, 263 aa, Zea mays
MGSAAASPPPSGKLTQEELKRVAAHRAVEFVEPGMTLGLGTGSTAAHALDRLGDLLRAGALPGVAGVPTSLKTEAHAARAGIPLLPLPGARIALSIDGADEVDPDLNLVKGRGGSLLREKMIEGAGARFVVIVDESKLVPRLGCTGAIPVEVIPFGALHTLGLIRGLFDGLPGFHARLRTVPAAPAKGGEDSDSESEQPFVTDNGNYIVEMFFEDGIRGDLRDISDRLLRITGVVEHGMFLGMATTVIVANKDGTVSVMDRKK

SEQ ID NO: 625 - protein, 260 aa, Sorghum bicolor
MGSAAATSPPPSGKLTQDELKRVAAHRAVEFVEPGMTLGLGTGSTAAHALDRLGDLLRAGALPGVAGVPTSLKTEAHASAVGIPLLPLDAASGARIALSIDGADEVDPDLNLVKGRGGSLLREKMIEGAGDRFVVIVDESKLVPRLGCTGAIPVEVIPFGAPHTLGLIRNLFDGVSGFHARLRTAPAAKGEDLEAPFVTDNGNYIVEMFFEDGIRGDLRDISDRLLRITGVVEHGMFLGMATTVIVANKDGTVAVMGRKK

SEQ ID NO: 626 - protein, 257 aa, Zea mays
MVSAAASPPPSGKPTQDELKRLAAHRAVELVEPCMTLGLGTGSTAAHALDRLGDLLRAGALPGVSGVPTSLKTEAHAARVGIPLLPLDAASIALSIDGADEVDPDLNLVKGRGGSLLREKMVEGAGARFAVIVDESKLVPRLGCTGAVPVEVVPFGAPHTLGLIRGLFHGLPGFHARLRTTTVPEGEQGSEQQPFVTDNGNYIVEMFFDGGIRGDLRDISDRLLRITGVVEHGMFLGMATVAIVAKKDGTVAVMERK

SEQ ID NO: 627 - protein, 275 aa, Oryza sativa
MGSFASPLDAAPAPPTAKPSPPPAPAPANGLVTQEELKRVAAHRAVEMVEPGMTLGLGTGSTAAHALDRLGDLLRSGELAAVAGVPTSLKTEAHAARVGIPMLPLGEAGGIDLSIDGADEVDPELNLVKGRGGSLLREKMIEGSGGRFVVIVDESKLVPRLGCTGAVPVEVVPFGCDHTLGLVRKVFDGLPGFSARLRTVASKDGEGKEEMFVTDNGNYIVEMFFEDGIRGDLNEISDRLLRITGVVEHGMFLGMATSVVVAKKDGTVALLHKKK

SEQ ID NO: 628 - protein, 215 aa, Populus trichocarpa
MVLGLGTGSTAKHAVDRIADLLHQGKLKNIIGIPTSKKTHQQAVSLGIPLSDLDSHPIVDLAIDGADEVDSNLNLVKGRGGSLLREKMIESACKKFIVIVDESKLVPHVGASGAMPVEVVPFCWKFTQDKLQSLFDYAGCVAKLRSNNGGEDGEIFVTDNGNYIVDLFFKKDVGDLKIASDAILRLAGVVEHGMFLDMATTVIVAGELGITIKNK

SEQ ID NO: 629 - protein, 242 aa, Thalassiosira pseudonana
MTSQEELKKQTGYKAIDDYVTSGMKVGLGTGSTAYYAVERLGQKLKSGELRDIVAVPTSIRTKEQAESLGIPLVTLNEHSKLDVAIDGADNVDPEFNLVKGGGGALLREKMVELAADKFIVIVDESKLCEGMGPGFPIPVEITPFCMNHTIRTIEALPSCAGCKPVLRMGSSSNNKVDGDEIAVTDNGNYIVDLHFTENIKDVPKMASDLKATCGVVDHGLFCGMTTACIIAGADGIVVKEA

SEQ ID NO: 630 - protein, 276 aa, Thalassiosira pseudonana
MKFIAAAFAAVATQNVAAFAPMTQRSRVSTSIRMALSQDELKKMVGYKSVDDYVKSGMVVGLGTGSTAYFAVERLGEKLKSGELKDIVAIPTSVRTKEQAEELGIPLVTLDTHSKLDVAIDGADEVDPDLNLVKGGGGALLREKMVEVCADKFIVIVDESKLCDGLGPGFPLPVEITPFCHIHTLNTIAALPSCAGCKAVLRMGSSSTNKPDGDEIAVTDNGNYIVDLHFTEPIKDAPTMAKELKNTVGVVDHGLFCGMTTAVIIAGSDGISVKEA

SEQ ID NO: 631 - protein, 287 aa, Phaeodactylum tricornutum
MRLTAGASILLASSAHAFTNPAFFPRTATFASTSSYTSALILKMGVDQDELKKQVGYKAVDDYVKSGMVVGLGTGSTAYYAVERVGEKLKSGELKDVLAIPTSIRTKEQAESLGIPLVTLDTHSKLDVAIDGADGVDPELNLTKGGGGALFREKIVEICADKFIVIVDESKLCDGLGPGFPIPVEILPFCHEHTMRVIGELPSCKGCKPVLRMGSSTNNQVDGDEIAISDNGNYLVDLHFEDPIKDPAKMAQELKNVVGVVEHGLFCGMSTAVIIAGADGISVKEAK

SEQ ID NO: 632 - protein, 277 aa, Pavlova lutheri
TRLVLTSALFAFSPQSVTSRLNRSALRTPAQQVVMATQDELKKLAGYKAVDDYVRSGMVVGLGTGSTAAFAVERVGMKLKSGELKDIIAIPTSVRTKEQAEALGIPLVTLGTHSDLDVAIDGADAVDPRLNLIKGGGGALLREKMVEVCAKKFIVIVDDTKLCAGLGPSFPLPVEITPFCWEHTLRKVAACPAAAGCEAKLRLGSAATGSKVDGTDPAVTDNDNYIVDLFFKQPIADPVALAAQLKATVGVVDHGLFCGMTTACIIAGKDGISVQTP

SEQ ID NO: 633 - protein, 298 aa, Ostreococcus tauri
MRATSSVTRGTFVPRARTLGKGRGGARRTRSRVMSTRAAMTQDELKKLVGYKSVDDHVESGMVVGLGTGSTAYFAVERVGQKLASGELKNVICIPTSERTREQAESLKIPLCTLNEKSELDVAIDGADEVDPALALVKGGGGALLREKMVEVMAKKFVVIVDESKLCKGLGPGFPLPVEITPFCHMHTLRTIAKLPALAGCEAILRMGSSSNNKIDGDNIAVTDNGNYIVDLHFKSPIKDPVAAASQLKNCVGVVDHGLFVDMAYQVIVAGSDGIRVAGTDGEKPWCLLIRNNDESTS

SEQ ID NO: 634 - protein, 250 aa, Ostreococcus lucimarinus CCE9901
MALSQDELKKLVGYKSVDDHVTSGMVVGLGTGSTAYYAVERVGQKLASGELKDVICIPTSERTREQAESLNIPLCTLNEKSELDVAIDGADEVDPALALVKGGGGALLREKMVEVMAKKFVVIVDESKLCKGLGPGFPLPVEITPFCHMHTLRTIGKLPALAGCEPILRMGSSSNNKNDGDNIAVTDNGNYIVDLHFKTPLADPVAAANQLKNTVGVVDHGLFVGMAYQVIVAGSDGIRVAGTDGEKAWW

SEQ ID NO: 635 - protein, 250 aa, Micromonas pusilla
MAPTQDELKKLVGYKSVDDHVESGMVVGLGTGSTAYFAVERLGQKIASGELTDIVAIPTSVRTKEQAESLKIPLCTLNEKSILDVAIDGADEVDPDLALVKGGGGALLREKMVEVMAKKFVVIVDESKLCKGLGPGFPLPVEITPFCHMHTLRTIADLPSVKGCEAVLRMGSSSTNKPDGDEIAVTDNGNYIVDLHFKEPIKDVNAAASELKNTVGVVDHGLFVGMSYQVIVAGSDGIKVAGTGGEKAWW

SEQ ID NO: 636 - protein, 226 aa, Micromonas sp. RCC299
MVVGLGTGSTAYFAVERLGEKLKSGELKDIIAIPTSERTREQAESLGIPLCTLNEKSVLDVAIDGADEVDPDLALVKGGGGALLREKMVEVMAKKFVVIVDESKLCKGLGPGFPLPVEITPFCHMHTLRTIAALPSVAGCEAVLRMGSSSTNKPDGDNIAVTDNGNYIVDLHFKEPIKDVNKAAEELKNTVGVVDHGLFVGMSYQVIVAGKDGIKVAGTDGEPAWW

SEQ ID NO: 637 - protein, 261 aa, Oxyrrhis marina
RKAVFPACFTVPWLRVDLEALKKQTGYRAVDDFVKSGMIVGLGTGSTAKYAVDRVAEKLKSGELKDVVGIPTSERTKQQAEELGVPLTTLNDITSQVDVAIDGADAVDPGFNLVKGGGGAHLREKLVEAFAKQFVVIVDQTKVQEGLGPSFPLPVEIVPFGSEHIMRQVAQLPAFKDTGCRAQLRKGSASTGSKEDGPDVAVTDNGNYIVDLFFEKYIPDPGAAAQQLQGVVGVVEHGLFCGMATDVLVAYPDGVRPLKRV

SEQ ID NO: 638 - protein, 259 aa, Toxoplasma gondii
MNPQDKAKQAVGYFAVDTYVRSGMKVGLGTGTTAKFVVERIGQRMQEGSLKDLLCVPTSEATRKQAESLGIPLTTLDGIADCLDVAIDGADEILPPTLGLVKGRGGALLREKMIAAAAKTFIVAADETKLVSNGIGSTGALPVEVVVFSGSHTKRLLSALPSVKRHGGRAEFRKRAGAATGEKNGGQEDIREEDRFVTDNGNYIVDLYFTETVPDLHEMDKELKSIPGVVETGFFLDLASVCLIGKADGSVATLTAERK

SEQ ID NO: 639 - protein, 259 aa, Toxoplasma gondii
MNPQDKAKQAVGYFAVDTYVRSGMKVGLGTGTTAKFVVERIGQRMQEGSLKDLLCVPTSEATRKQAESLGIPLTTLDGIADCLDVAIDGADEILPPTLGLVKGRGGALLREKMIAAAAKTFIVAADETKLVSNGIGSTGALPVEVVVFSSSHTKRLLSALPSVKRHGGRAEFRKRAGAATGEKNGGQEDIREEDRFVTDNGNYIVDLYFTETVPDLHEMDKELKSIPGVVETGFFLDLASVCLIGKADGSVATLTAERK

SEQ ID NO: 640 - protein, 259 aa, Toxoplasma gondii
MNPQDKAKQAVGYFAVDTYVRSGMKVGLGTGTTAKFVVERIGQRMQEGSLKDLLCVPTSEATRKQAESLGIPLTTLDGIADCLDVAIDGADEILPPTLGLVKGRGGALLREKMIAAAAKTFIVAADETKLVSNGIGSTGALPVEVVVFSSSHTKRLLSALPSVKRHGGRAEFRKRAGAATGEKNGGQEDIPEEDRFVTDNGNYIVDLYFTETVPDLHEMDKELKSIPGVVETGFFLDLASVCLIGKADGSVATLTAERK

SEQ ID NO: 641 - protein, 237 aa, Plasmodium knowlesi
MDDLKRRVAYKAVDDYVQSNMTIGLGTGTTVFYVLERIENLMRNGKIKDVVCIPTSIDTEIKAQKLGIPLTTLEKNSHIDIAIDGADEIDMDLNLVKGRGGALVREKLVASCASFLIIIADESKLCTNGLGTKGSVPIEILSFGHEKIIQSLLKISSLKNCKYNLRQKNGEVYITDNKNYIVDFYFSNPIQDLRDTCDKIKMITGVVDHGIFVNMTSVALISKQDGTVLKLDKNANS

SEQ ID NO: 642 - protein, 237 aa, Plasmodium vivax
MDDLKRRVAYKAVDDYVQSNMTIGLGTGTTVFYVLERIEKLMRNGKITNVVCIPTSIDTEIKARNLGIPLTTLKKNSHIDIAIDGADEIDMDLNLVKGRGGALVREKLVAASASVFIIIVDESKLCTNGLGTTGAVPIEILAFGHEKIIQNLLKISSLENCQYKLREKNGEVYITDNKNYIVDFYFANPIEDLQDTCHKIKMTTGVVDHGIFVNMTSVALISKHDGTVLKLDKHAGS

SEQ ID NO: 643 - protein, 238 aa, Plasmodium yoelii
MDSLKKIVAYKAVDEYVQSNMTIGLGTGSTVFYVIERIDALMKSGKIKNLICVPTSIDTEIKAKSLGIPLTSLTKNLKIDIAIDGADEIDSDLNLIKGRGGALVREKLVAGNASCFIIIVDESKMCEDGLGTTGAVPIEILSFGYEIIIENLLKISALKNCIYRLREKNGEIFITDNNNYIVDFFFDNPIENLAQTCEQIKMTTGVIDHGIFVNMASIALISKINGTILTLKKNKGIN

SEQ ID NO: 644 - protein, 237 aa, Plasmodium berghei
MDSLKKIVAYKAVDEYVQSNMTIGLGTGSTVFYVIERIEALMKSGKIKNLICVPTSIDTEMKAKSLGIPLAGLTKNLKIDIAIDGADEIDADLNLIKGRGGALVREKLVAANASCFIIIVDESKMCKDGLGTTGAVPIEILSFGYEMIIENLLKISALKNCIYLREKNGEIFITDNNNYIVDFFFDNPIENLVQTCEQIKMTTGVIDHGIFVNMASIALISKINGTILTLKKNKGIN

SEQ ID NO: 645 - protein, 227 aa, Plasmodium chabaudi
AYKAVDEYVQSNTTIGLGTGSTVFYVLERIETLMKSGKIKNLVCVPTSIDTEMKAKSLGIPLTGLTKNLKIDIAIDGADEVDSDLNLIKGRGGALVREKLVAANTACFIVIVDESKMCEDGLGTTGAVPIEILSFGYEMIIESLLKISALKNCTYKLREKDGEIFITDNHNYIVDFFFETPIENLVKTCEQIKMTTGVVDHGIFANMASIALISKSNGTILTLNKNK

SEQ ID NO: 646 - protein, 240 aa, Theileria annulata
MSGTNQLSLMKLVAEKAVDTYVKSNSIIALGTGRTSTFSLERLAERIKTKAITNVFGIPTSQSTHLKAEELEIPLLTLDDLISTGRKINIAIDGADSVDSNLNLIKGGGGALFTEFMVEQFSDQLIIMIDESKLCNGHLLESHYLPIEIVKGCHLTTCNQIYSKFKSQIVNWNVRKNSDGSLFLTDNGNLIIIQLFVLINLMCKLIYHQIHGVVCSGLFLNMATKCLVAKSDNTIVTLER

SEQ ID NO: 647 - protein, 240 aa, Babesia bovis
MDRQECMRRAAEFAVDTYIQNGMIVGLGTGSTASYAVRYLAKQLSAAKLRDVTAVATSVATFRLMSELGIPSLEFDDSVSIDVAIDGADAIDGDLNLIKGGGGALFREKLVELGARKVIIIADGTKKVKGHLLQAFHVPVEIVQFGHVVTISRILSRVGPHVRSWTKRMNADGSLYLTDNNNVIMDIEFGPTDLPNLDFELRSVHGVVCTGLFLGIASTVVIAHSDGNLEVLSPDTASNS

SEQ ID NO: 648 - protein, 283 aa, Acyrthosiphon pisum
MQLLLSKSIIFTVIDKFRLSSGKYFKMSAVSFTVGRKNCSTAGVDVSKMCAAHRAIDKHVKDGMILGIGSGSTIVYGVQRLAQRTKDENLSVVCVPTSYQARQLIIDYKLTLGNLDTHPKIDCTIDGADEIEKGTLTCIKGGGGCLTQEKIVASCSEKLIIVADGAKEVDHLGQKWKKGIPIEVIPMSCKPIQQKIEGKYGGEAILRMSADKAGPLVTDNGNFLLDWVFPETKYCWSSVHNYLKLIPGVVETGLFIDMTDECLVGDSQGNVRQLKKTEQTLEL

SEQ ID NO: 649 - protein, 257 aa, Acyrthosiphon pisum
MSAVSFTVGRKNCSTAGVDVSKMCAAHRAIDKHVKDGMILGIGSGSTIVYGVQRLAQRTKDENLSVVCVPTSYQARQLIIDYKLTLGNLDTHPKIDCTIDGADEIEKGTLTCIKGGGGCLTQEKIVASCSEKLIIVADGAKEVDHLGQKWKKGIPIEVIPMSCKPIQQKIEGKYGGEAILRMSADKAGPLVTDNGNFLLDWVFPETKYCWSSVHNYLKLIPGVVETGLFIDMTDECLVGDSQGNVRQLKKTEQTLEL

SEQ ID NO: 650 - protein, 300 aa, Pediculus humanus corporis
MNNFQVHLIIFLFRLMTLNSLGLANGFLLIFSVTPFFKKSNNLSHNKFFFNYNFNRFLTLKQIRKMSTVEEAKKCAAHSAVVNHVKNNSIVGIGSGSTVVYAVEKLADRIKNEKLHIICIPTSFQAEQLITENKLNLGSLSQYPEIDVVIDGADEVDENLTLIKGGGGCLLQEKIIASCSKEMIVIADFNKKSKKLGEKWKKGVPIEVIPFCYVPIKNKIQLKFGGEAVLRMAKMKAGPVVTDNGNFILDWKFPENKDYNWEKISVDLKLIPGVVETGLFVNMAKKAYFGMSDGSVVMTP

SEQ ID NO: 651 - protein, 271 aa, Aedes aegypti
MFQRFFGTVSLFSGSRSINPLLSSIVASRASSSAAAKMSLDLAKKIAAFKAVDEYVRDNTVVGVGSGSTVVYAVQRLAERVKTEGLKLVCIPTSFQARQLIIESGLVLGDLEQHPKIHCAIDGADEVDADMVLIKGGGGCLLQEKIVASCADQLVVIADYTKNSKKLGEQYKKGIPIEVVPMAYVPIRNKVAAKYGGSLKLRMAVAKAGPVVTDNGNFILDWHFPEEKFDWDVVNRDIMMIPGVVETGLFVKMATKAYFGLADGSVTERSA

SEQ ID NO: 652 - protein, 278 aa, Anopheles gambiae
ILVGHMFRQLLHSLSPSLVQSGRRSSLACSTNLALFSTQTTAKMSLEEAKKCAAYKAVDEYVKDNTVVGVGSGSTVVYAVHRIAERVKAEGLKLVCIPTSFQARQLIIEHGLVLGDLECNPRLDCAIDGADEVDAKMVLIKGGGGCLLQEKIVASCADRLVVIADYTKDSAKLGQQYRKGIPIEVAPMAYVPIKGKVESRFGGTLKLRMAVAKAGPVVTDNGNFILDWSFPADKEHDWDAVNREIMMIPGVVDTGLFVGMATKAYFGQQDGSVTERSA

SEQ ID NO: 653 - protein, 272 aa, Monosiga brevicollis MX1
MRGYACRRSPRKFSLKLFSVVDVKMAEISQEVLQGLDTVAQAKLRAAYAAVDNHVKDGQVVGIGSGSTVVFAVQRLAQRVRDENLRVICIPTSFQARQLILENKLVLGDLNANPVLDVAIDGADEVSAQLDCIKGGGGCLLQEKIVASNADQLIIIADYSKIADYLGSVWKKGVPLEVIADCYVPIMRKLEKMGGKPVLRMAKAKAGPCVTDNGNFIVDCDFGVMQEPAKLEQQLLSIPGLVETGFFLQMAVKAYFGMQDGSVKTLDAPARQ

SEQ ID NO: 654 - protein, 263 aa, Ciona intestinalis
MKFGSICRSIYSVVRMSTTNSSLTNGVENAKRVAAFTAANNFVQNGYVIGVGSGSTIEYAVERIAERVEAENLKVTCVPTSFQARELILKYKLSLSDLDRHSKLDVAIDGADEVDEQFTLIKGGGGCLTQEKIVAAAAKKFVVIADFRKKSTNLGENWKKGIPIEVVPMAILQIQNKIKEKYGGICTIRLAKSKAGPVITDNGMMIVDWQFDKSHNWSEVHQFIKLIPGVVETGIFFNMADIVIYGTENGQSDIKANTTVLTK

SEQ ID NO: 655 - protein, 259 aa, Schistosoma japonicum
MAESNALECAKQKACQSAVSDWLKDNQIIGLGSGTTIKYAVEFIAEKVESENLQIQCIPTSFQARQLLINHKLPVTDLDIHEKIDVTFDGADEVDEDLHLIKGGGGCLLQEKIVASCTANFIAIVDERKHSKRLGSYWTKGLPIEVIPMAFKPIQTRIEKLFGGKVILREAVSKMGPVVTDNGNFLLDWKFDTNKQYYWPEVNIELSNIPGVVDTGLFINMARRIYVGNMNGTVCKLEGKPSNTLCYNQHLLNSTDSSL

SEQ ID NO: 656 - protein, 235 aa, Culex quinquefasciatus
MSLEQAKKIAAFKAVDEYVRNDTVVGVGSGSTVVYAVQRLAERVKAEGLRLVCIPTSFQARQLIIDAGLVLGDLEQNPRIDCAIDGADEVDADMVLIKGGGGCLLQEKIVASCAAQLIVIADYTKDSKRLGEQYKKGIPVEVVPMAYVPIRDRIAAKYGGKLQLRMAVAKAGPVVTDNGNFILDWHFPDTIVNGWDEINRDIMMIPGVVETGLFVKMATKAYFGLADGSVIERSA

SEQ ID NO: 657 - protein, 237 aa, Apis mellifera
MGELLTLESAKQIAAYKAVDEYVKNNSIIGIGSGSTVIYAVHRLVERVKEENLNVICVPTSFQARQLILNNHLKLGDLETYPKLDCAIDGADEVDSDMNLIKGGGGCLLQEKIVASCANQLIIVADYTKNSQKLGEQYKKGIPIEVVPMAYVAILRRIEDNYGGLVKVRMALAKAGPVITDNGNFILDWHFPRDISNWDKINIEISMIPGVVETGLFIKMAKKVYFGMPDGSVKEQF

SEQ ID NO: 658 - protein, 233 aa, Tribolium castaneum
MASLESAKKLAAYKAVDLHVQNNSIVGVGSGSTVVYAVERLAERVKNEKLNVQCVPTSFQARQLIIQHRLHLTDLEIHPRLDVCIDGADEVDSTLTLIKGGGGCLLQEKIVASCAKELIIIADYTKNSQKLGEQYKKGIPIEVVPMAYLPIKTQIENQLGGTVELRMAKAKAGPVVTDNGNFILDWKNFQDYKWDTINTKLNLIPGVVETGLFVNMAKKAYFGLADGSVKEQI

SEQ ID NO: 659 - protein, 242 aa, Drosophila mojavensis
MNDIIELDAAKRLAAETAVDQYVTEDTKVLGIGSGSTIVFVVQRLAERVWKEGTLPELICVPSSFQARQLILDHNLTLGDLDRNYKIDVYIDGADEVDSSLVLIKGGGGCLMQEKIVASCAKTVVIVADYTKRSLRLGEQWCKGIPIEVAPIAHVPVKHKIEELFGGEAQLRIALKKAGPIVTDNGNFLLDWRFVAKREYDWDEVNKAISMIPGVLETGLFVNMAHKCYFGMANGTLKVQSK

SEQ ID NO: 660 - protein, 242 aa, Drosophila virilis
MDSKIALDAAKKLAARAAVDQWVTEETKVVGIGSGSTIVFVVDRIAERVWKEGALSDMICVPSSYQARKLILDHNLTLGDLDRNCRIDVYIDGADEVDSGMVLIKGGGGCLMQEKIVASCAKSVIIIADYTKKSLRLGEQWCKGIPIEVAPMAYVPIKHKIEELFGGEAQLRIALKKAGPIVTDNGNFLLDWRFVAKREYNWYEVNLAISMIPGVLETGLFVDMATKCYFGMADGTVKVQSR

SEQ ID NO: 661 - protein, 242 aa, Drosophila grimshawi
MTDKIALDAAKKLAAITAVDQWVTEETKVVGIGSGSTVVFAVERIAERVWKDGALADIICVPSSYQARLLILDHNLTLGDLDRHSKIDVYIDGADEVDNAMVLIKGGGGCLLQEKIVASCAKKMIVIADYTKKSLRLGEQWCRGIPIEVSPQAHVPVKLKIEELFGGHAELRVALMKAGPIVTDNGNFLIDWKFVAKREYNWDEVNRAITMIPGVMETGLFVDMAIKCYFGMADGTVKVQNK

SEQ ID NO: 662 - protein, 280 aa, Drosophila sechellia
MLSGFLRRGVQRARFTFTQQLGEDLLSGAAAALHTQIRKMDDIALDAAKKTAARTAVDQWVTEDTKILGIGSGSTVVYAVQRIAERVWKEGELTDLICVPSSYQARHLILDYNLNLGDLDRNPNIDVAIDGADEVDRHMVLIKGGGGCLLQEKVVASCAKHFIVVADYTKNSIRLGEQWCRGVPIEVAPMAYVPIKLHIEALFGGEASLRMAKVKAGPIVTDNGNFLLDWKFIANREYDWDEVNRAITLIPGVLETGLFVNMAHKCYYGMANGTVKVQNK

SEQ ID NO: 663 - protein, 280 aa, Drosophila simulans
MLSGFLRRGVQRARFTFTKQLGEDLLSGAAAALHTQIRKMDDIALDAAKKTAARTAVDQWVTEDTKILGIGSGSTVVYAVQRIAERVWKEGELTDLICVPSSYQARHLILDYNLNLGDLDRNPNIDVAIDGADEVDRHMVLIKGGGGCLLQEKVVASCAKHFIVVADYTKNSIRLGEQWCRGVPIEVAPMAYVPIKLHIEALFGGEASLRMAKVKAGPIVTDNGNFLLDWKFIANREYDWDEVNRAITLIPGVLETGLFVNMAHKCYYGMANGTVKVQNK

SEQ ID NO: 664 - protein, 280 aa, Drosophila melanogaster
MLSGFLRRGVQRARFTFTQQLGEDLLSGAAATLHTQIRMMDDIALDAAKKTAARTAVDQWVTEDTKILGIGSGSTVVYAVQRIAERVWKEGELTDLICVPSSYQARHLILDYNLNLGDLDRNPNIDVAIDGADEVDRHMVLIKGGGGCLLQEKVVASCAKHFIVVADYTKNSIRLGEQWCRGVPIEVAPMAYVPIKLHIEALFGGEASLRMAKVKAGPIVTDNGNFLLDWKFIANREYDWDEVNRAITLIPGVLETGLFVNMAHKCYYGMANGSVKVQNK

SEQ ID NO: 665 - protein, 241 aa, Drosophila melanogaster
MDDIALDAAKKTAARTAVDQWVTEDTKILGIGSGSTVVYAVQRIAERVWKEGELTDLICVPSSYQARHLILDYNLNLGDLDRNPNIDVAIDGADEVDRHMVLIKGGGGCLLQEKVVASCAKHFIVVADYTKNSIRLGEQWCRGVPIEVAPMAYVPIKLHIEALFGGEASLRMAKVKAGPIVTDNGNFLLDWKFIANREYDWDEVNRAITLIPGVLETGLFVNMAHKCYYGMANGSVKVQNK

SEQ ID NO: 666 - protein, 241 aa, Drosophila yakuba
MDDIALDAAKKTAARTAVDQWVTEDTKILGIGSGSTVVYAVQRIAERVWKEGELTDLICVPSSYQARHLILDYNLNLGDLDRNPNIDVAIDGADEVDRHMVLIKGGGGCLLQEKVVASCAKHFIVVADYTKNSIRLGEQWCRGVPIEVAPMAYVPIKLHIEALFGGEASLRMAKVKAGPIVTDNGNFLLDWKFIANREYDWDEVNRAITLIPGVLETGLFVNMATKCYYGMADGKVKVQNK

SEQ ID NO: 667 - protein, 241 aa, Drosophila erecta
MEDIALDAAKKTAARTAVDQWVTEDTKILGIGSGSTVVFAVQRIAERVWKEGELTDLICVPSSYQARHLILDYNLNLGDLDRNPNIDVAIDGADEVDRHMVLIKGGGGCLLQEKVVASCAKNFIVVADYTKNSIRLGEQWCRGVPIEVAPMAYVPIKLHIEALFGGEASLRMAKVKAGPIVTDNGNFLLDWKFIANREYDWDEVNRAITLIPGVLETGLFVNMATKCYYGMADGQVKVQNK

SEQ ID NO: 668 - protein, 241 aa, Drosophila ananassae
MEDIAVDASKKRAARTAVDEWVTEDTKILGIGSGSTIVYAVQRIAERVWKEGELTDLICVPSSYQAHHLILDYNLNLGDLDRNPNIDVAIDGADEVDRHMVLIKGGGGCLLQEKVVASCAKHFIVVADYTKNSIRLGEQWCRGVPIEVAPMAYVPVKLQIEALFGGEASLRMAKVKAGPIVTDNGNFLLDWKFIANREYDWDEVNRAITLIPGVLETGLFVNMAHKCYFGMADGNVKVQNK

SEQ ID NO: 669 - protein, 242 aa, Drosophila persimilis
MGDEISLDEAKKKAARTAVDEWVKEDTKIVGIGSGSTVVYAVQRIAERVWKDGELTDLICVPSSYQAQHLILDYNLNLGSVDRNPIIDVAIDGADEVDSNMVLIKGGGGCLLQEKVVAACSKKFIVVADYTKKSLHLGEQWCRGVPIEVAPMAQVPIKLQIEAMFGGEVVLRMAKVKAGPIITDNGNFLLDWKFVGKREYNWDEVNRTITMIPGVLETGLFVDMAHKCYFGMADGSVKAQSK

SEQ ID NO: 670 - protein, 245 aa, Drosophila willistoni
MSETISLDQAKKLAARAAVEEWIIEGETKIVGIGSGSTIVYAVERLAERVWKDGELSDLICVPTSFQARSLILDHNLNLGDLDRYPILDVAIDGADEVDSRMVCIKGGGGCLMQEKIVAACAKRFVVVADYTKKSLRLGEQWCKGVPIEVAPIAHVPIKLKIEAMFGGEAHLRMAKAKAGPIVTDNGNFLLDWKFVAKREYDWDEVNHAIKMIPGVMETGLFVGMAHKCYFGMADGNVKAQVNSK

SEQ ID NO: 671 - protein, 275 aa, Danio rerio
MRRVVFAQISYRFRSLLHFFSPPGKHVRLINSSRRLYCSRMAEEAKKLAAYAAVDNHIQNNQVIGVGSGSTIVYAVDRLAEKVRQEKLNIVCVPTSFQARQLILQHGLPLSDLDRHPELDVAIDGADEVDTALTLIKGGGGCLTQEKIVAGCAKHFIVIADYRKDSKALGQQWKKGVPVEVIPMAYVPVSRAIARCFGGEAVLRMAVSKAGPVVTDNSNFILDWKFEHAQNWKEVNTAIKMIPGVVETGLFVGMAERVYFGMEDGSVKTRDPPVN

SEQ ID NO: 672 - protein, 275 aa, Danio rerio
MRRVVFAQISYRFRSLLHFFSPPGKHVRLINSSRRLYCSRMAEEAKKLAAYAAVDNHIQNNQVIGVGSGSTIVYAVDRLAEKVRQEKLNIVCVPTSFQARQLILQHGLPLSDLDRHPELDVAIDGADEVDTALTLIKGGGGCLTQEKIVAGCAKHFIVIADYRKDSKALGQQWKKGVPVEVIPMAYVPVSRAIARRFGGEAVLRMAVSKAGPVVTDNSNFILDWKFEHAQNWKEVNTAIKMIPGVVETGLFVGMAERVYFGMEDGSVKTRDPPVN

SEQ ID NO: 673 - protein, 241 aa, Danio rerio
RLYCSRMAEEAKKLAAYAAVDNHIQNNQVIGVGSGSTIVYAVDRLAEKVRQEKLNIVCVPTSFQARQLILQHGLPLSDLDRHPELDVAIDGADEVDTALTLIKGGGGCLTQEKIVAGCAKHFIVIADYRKDSKALGQQWKKGVPVEVIPMAYVPVSRAIAHRFGGEAVLRMAVSKAGPVVTDNSNFILDWKFEHAQNWKEVNTAIKMIPGVVETGLFVGMAERVYFGMEDGSVKTRDPPVN

SEQ ID NO: 674 - protein, 235 aa, Osmerus mordax
MAEEAKKLAGYAAVDNHVQNNQVLGVGSGSTIVYAVDRLAERVRQEKLNIVCVPTSFQARQLILQHGLPLSDLDRHPELDVAIDGADEVDSALTLIKGGGGCLAQEKIVAGCAKHFIVIADYRKDSRCLGQQWKKGVPIEVLPVAYVPVSRTIAQRFGGEAVLRMAVSKAGPVVTDNSNFILDWKFEHAQNWKEVNTAIKMIPGVVETGLFVGMAERVYFGMEDGSVKTRDPPVN

SEQ ID NO: 675 - protein, 231 aa, Tetraodon nigroviridis
MAEEAKKLAAYAAVDNHVQNNQAVGVGSGSTIVYAVDRLAARVRQEKLNIVCVPTSFQARQLILQHSLALSDLDRHPQLDVAIDGADEVDADLTLIKGGGGCLTHEKIVASCAKHFIVIADYRKDSKVLGQQWKKGVPIEVIPMAYVPVCRTIVRRFGGEAHLRMAVSKAGPVVTDNSNFLLDWKFDGAQNWREVNAAIKMIPGVVDTGLFVDMAERAYFGMEDGSVQVRD

SEQ ID NO: 676 - protein, 235 aa, Xenopus laevis
MTEEAKRLAGCAAVDNHVKNNQALGIGSGSTIVHAVNRLAERVKQENLKVVCVPTSFQARQLILQNGLVLTDLDRHPELDVAIDGADEVDSDLNLIKGGGGCLAQEKIVAGCAKSFIVIADYRKDSKNFGEQWKKGVPIEVIPMAYVPVIKALQSRFGGVAELRMAVSKAGPVVTDNGNFLLDWKFDKVHDWRTVNTEIKMIPGVVDTGLFINMAERVYFGMEDGTVTIRDKPMN

SEQ ID NO: 677 - protein, 235 aa, Gallus gallus
MAEEAKRLAACAAVDKHVQNNQVLGIGSGSTIVHAVHRLAERVKQENLSIVCIPTSFQARQLILQNGLTLSDLDRHPELDVAIDGADEVDSDLNLIKGGGGCLTQEKIVAGYAKCFIVIADYRKKSENLGEQWKKGIPIEVIPMAYVPVTRALTKNFGGAAELRMAVSKAGPVVTDNGNFILDWKFDKVHEWSEVNTAIKMIPGVVETGLFIDMAEVVYFGMEDGSVSVREKQPR

SEQ ID NO: 678 - protein, 237 aa, Macaca mulatta
MSKAEEAKKLAGRAAVENHVRNNQVLGIGSGSTIVHAVQRIAERVKQENLNLVCIPTSFQARQLILQYGLTLSDLDRHPEIDLAIDGADEVDADLNLIKGGGGCLTQEKIVAGYASRFIVIADFRKDSKNLGDQWHKGIPIEVIPMAYVPVSRAVSQKFGGVVELRMAVNKAGPVVTDNGNFILDWKFDRVHKWSEVNTAIKMIPGVVDTGLFINMAERVYFGMQDGSVNMREKPFC

SEQ ID NO: 679 - protein, 264 aa, Bos taurus
LPGRSQFGAGSTSTGVRETNIVCPGPSAMSKAEEAKKLAGRAAVENHVRNNQVLGIGSGSTIVHAVQRIAERVEQENLKLVCIPTSFQARQLILQYGLTLSDLDRHPEIDLAIDGADEVDADLNLIKGGGGCLTQEKIVAGNASRFIVIADFRKDSKNLGDQWHKGIPIEVIPMAYVPVSRTVTQKFGGVIELRMAVNKAGPVVTDNGNFILDWKFDRVHKWSEVNIAIKMIPGVVDTGLFINMAERVYFGMQDGSVNMREKPF

SEQ ID NO: 680 - protein, 252 aa, Mus musculus
RGDKGGSSAGGPAPSTMSKAEEAKKLASHTAVENHVKNNQVLGIGSGSTIVHAVQRIAERVKQENLDLICIPTSFQARQLILQYGLTLSDLDQHPEIDLAIDGADEVDAELNLIKGGGGCLTQEKIVAGYASRFIVIADFRKDSKNLGDRWHKGIPIEVIPMAYVPVSRAVAQKFGGEVELRMAVNKAGPVVTDNGNFILDWKFDRVHKWSEVNTAIKMTPGVVDTGLFINMAERVYFGMQDGSVNVREKPF

SEQ ID NO: 681 - protein, 236 aa, Mus musculus
MSKAEEAKKLASHTAVENHVKNNQVLGIGSGSTIVHAVQRIAERVKQENLDLICIPTSFQARQLILQYGLTLSDLDQHPEIDLAIDGADEVDAELNLIKGGGGCLTQEKIVAGYASRFIVIADFRKDSKNLGDRWHKGIPIEVIPMAYVPVSRAVAQKFGGEVELRMAVNKAGPVVTDNGNFILDWKFDRVHKWSEVNTAIKMTPGVVDTGLFINMAERVYFGMQDGSVNVREKPF

SEQ ID NO: 682 - protein, 236 aa, Mus musculus
MSKAEEAKKLASHTAVDNHVKNNQVLGIGSGSTIVHAVQRIAERVKQENLDLICIPTSFQARQLILQYGLTLSDLDQHPEIDLAIDGADEVDAELNLIKGGGGCLTQEKIVAGYASRFIVIADFRKDSKNLGDRWHKGIPIEVIPMAYVPVSRAVAQKFGGEVELRMAVNKAGPVVTDNGNFILDWKFDRVHKWSEVNTAIKMTPGVVDTGLFINMAERVYFGMQDGSVNVREKPF

SEQ ID NO: 683 - protein, 248 aa, Branchiostoma floridae
MDLITQAKQSAAYQAIDNHVKNGQALGIGSGSTIVFAINRLAERVQEENLNVVCVPTSFQSKQLLTEKGLAVSDLERTPSLDVAIDGADEVDKDLNLIKGGGAACTQEKIVASCAKYFVVIADHRKDSKLLGEQWKKGVPIEVIPMGYVPVIRAIEKKLGGKAELRMGANKAGPVVTDNGNFILDWKFDETKDWKKVNMEISMIPGVVETGLFIDMAQRAYFGMPDGSVTFREKLSRNGTPECDESEK

SEQ ID NO: 684 - protein, 236 aa, Caligus rogercresseyi
MSNLIEDSKKLAAISSVDNHVQNGHVVGIGSGSTIVYAVQRLAERVEAEKMSVSCIPTSFQARQLIMEHGLPMTSFEAVESCDVTIDGCDEADASLTLIKGGGGCLAQEKVVAQFSKTFVVIADYRKKSQKLGTSWKYVPIEVLPLAYKPVTKWISDHHGGEAILRMAKAKAGPLVTDNGNLILDWYFDLNKTYDWKKVNGELCSLAGIVDTGLFIDMTKTAYFGQKDGTVETVLI

SEQ ID NO: 685 - protein, 231 aa, Nematostella vectensis
MEAGKKAAAVYAVNKFVKNGHVLGIGSGSTVVYAVERLAKRVMKEKLEVVCVPTSFQAQQLITENKLVLSDLERNPELDVAIDGADEVDANLTLIKGGGGCLTQEKIVASCAKTLVIIADDRKDSKQLGEKWSKGVPVEVVPFAYRPVMLKMEKMGLSPVLRMAKAKAGPVVTDNGNFIIDVGFSKPQDWNKLNTDLNLIPGVLETGLFVNMTNHVVFGKEDGSIATRDAR

SEQ ID NO: 686 - protein, 232 aa, Hydra magnipapillata
MEAAKKAAAYEAVNKYVTKETKYLGVGSGSTIVYAVERLAQRVKEEDLNIKCIPTSFQSRQLILDNGLVLSDIQQHPELDIVIDGADEVDVNLNCIKGGGGCLTQEKIVASCAKNFVIIADSTKRSQHLGDSWKNGVAVEVIPMAYSLVIMKLKQLGFYPSLRMAKAKTGPLVTDNGNFIIDFKFDKLTDCKIVNDSLISIPGIVETGLFIEMANSVIFGFSDGTTEEIFRQ

SEQ ID NO: 687 - protein, 240 aa, Phytophthora infestans
MSSPIEQSKRTAARQAVDEYVKSGYVVGVGSGSTVVYAAERLGELVKEKKLTDIKCIPTSFQAKQLIVQHKLTLSSLDENPVIDVTIDGADEVDLQLNCIKGGGGCQLQEKIVAFAANKFVVIADYRKESKQLGEQWTQGVPVEVVPMAYVPLMNKMEQDFGGKSVLRMAKSKAGPVVTDNGNFVLDVNFGVINDPKTLCDRLKLLPGVVEVGLFCGMAEKAFFGQTDGSFTTRVADKSA

SEQ ID NO: 688 - protein, 251 aa, Caenorhabditis briggsae
MVTSTAPEAELAPIEQAKKRAAFACGEKYVQSGCRLGVGSGSTVKYLVEYLKQGYQNGQLKDIICVPTSFLTKQWLIESGLPVSDLDAHPELDVCIDGADEVDGQFTCIKGGGGCLAQEKIVQTAAKHFYVIADYLKDSKHLGDRYPAVPIEVLPPASQPLLRSIPRAEGGSCQLRQATKKCGPVVTDNGNFIIDWQFEKNVSGRDWLAIQQRLANTPGIVETGLFIGCVDAVFFAYSDGSVKEIVNTKKH

SEQ ID NO: 689 - protein, 260 aa, Brugia malayi
MKTHSTLDLAKRAAAFAAGEQHVKSGCRIGVGSGTTAKFLVEFLAEKVNDGTVKDIICVPSSFSTRQWLIDYGLQVIDLEKILDLDLCIDGADEVDINLNCIKGSGGGCLTQEKIVQTCAKKFYIIADASKQSEKLGDRNFPIPIEVVPFGYAPVLNWIKRQEGGEVELRTNSKEKLDPFITDNNNFILDWNFPKNKYVTTEDLSALHTRLKSLPGVVETGLFIGVAEKAYFATADGNVTERLRPDPSLHFSLNQKSSLH

SEQ ID NO: 690 - protein, 232 aa, Dictyostelium discoideum
MSLDNCKKVAAYKAVDDFVKDGCKIGIGSGSTIKYAVDRIKELGLKNVICVPTSFQSTQLIVEAGLELSDLSRTPELDITIDGADEVDKDFNLIKGGGGCQLQEKIVAYSSKKLVIVADHTKESTELGENWKKGIPIEVVPMAYVPVMKKLESSSFSLTPKLRMAVNKAGPVVTDNGNFIIDAQFSKPLSNIPQLAIDIKMIPGVVETGLFVNMTKIAYFGQTDGTCKVKSI

SEQ ID NO: 691 - protein, 264 aa, Polysphondylium pallidum
MFKLGVVHLGLRNLNFTTKTATNVKCYTVSSVKMDKEILEKAKKLAGYKAVDDNLKSGLRVGIGSGSTIKYVVDRIKELGLDVICVPTSFQSTQLIVNAGLTLSDLSRTPELDITIDGADEVDSQLNCIKGGGACQLQEKIVAAASKRLVIVADFTKDSQAFGQQWKRGIPIEVVPMAYVPVMNKLSSMSLKPVLRMAVNKAGPVVSDNANFIIDAQFESISNVAELATKIKMIPGVVETGLFVNMASRAYFGQQDGTVKERTI

SEQ ID NO: 692 - protein, 251 aa, Malassezia globosa CBS 7966
MASSSQSVSTVESAKRAAAYAAVDAYVKPHHQLIGIGSGSTVPYVVERIYERGEKVNNSCRFVPTSFQAKNLIIERNLNLGDMDTGLQLDVTIDGADEVDASLNLIKGGGACHLREKVLAEAAKEFVVVADFRKMSMVLGENWRKGVPVEVAPFAAKHVLKSLERLGSTDAKLRMAVAKAGPVVTDNGNLCIDAVFPESIMRNPDHLLKQIKLLTGVVEVGIFTNICKAAYFGNEDGSITRQLPDGSRVRM

SEQ ID NO: 693 - protein, 286 aa, Ustilago maydis
MASSNATNSTSAASAANTNSSAFKSAELAALSGVEAAKRAAAYAAVDNHVKPQHEIIGIGSGSTVPYVVERIAQQGPAVNAKRWFVPTGFQSRELIINAGLRLGDVDSFPSIDVTIDGADEVDNALNCIKGGGACHLREKVLAEAANEFVVVADYRKNGSQLGTKWLQGVPIEVAPFAYAKVLQNLKKMGSDKAVLRMGKAKAGPVVTDNGNFCIDAPFPEAQMKDPSDLLKRIKLLTGVLEVGLFCNICKSAYFGNDDGTITIKTAAGDVQEGVHFDVSKAPATA

SEQ ID NO: 694 - protein, 295 aa, Coprinopsis cinerea okayama7#130
MSPSTTYSKSSATTAGRGYLNGSPLKSKSLASGVDGKAAGGMETLSLIEASKRLAAYTAVDQHVKPEHRIIGIGSGSTVPYVVDRIVQQGVELNAGRVFIPTGFQSRQLIVAAGLTLGDVDQYPTIDITIDGADEVDHNLNCVKGGGACHLREKVLAEAAHTFILVADYRKNVQFLGTNYLSGVPIEVVPFAYNKVLHNLHHSLGSPKAALRMAIKKAGPVVSDNGNFIIDAPFTQEQLADPYTVLAQIKMLTGVVEVGLFCKMAKAAYFGNEDGSVTVRWDDGRVEVVPSATSA

SEQ ID NO: 695 - protein, 249 aa, Laccaria bicolor
MDIIESSKRLAAYTAVDNHVKPEHKVIGIGSGSTVPYVVERIVQQGVEANKGRVFIPTGFQSKELIVSSGLGLGDVDQYPTIDVTLDGADEVDSQLNCVKGGGACHLREKVLAEAARTFILVADYRKNVQYLGTNFLQGVPIEVVPFAYAKVLQNLHQVLGSPKATLRMAVKKAGPVVSDNGNFIIDAPFDREKMIDPFTIMAQIKMLTGVVEVGLFCRMAKAAYFGNEDGTVTVRWDDGKIDQVAAPV

SEQ ID NO: 696 - protein, 240 aa, Candida albicans
MSSTSKVESAKKLAAYKAVDENFPKDAKVIGIGSGSTVIYAAERIGQLDNKDSFICIPTGFQSKQLIIDNGLRLGTIEQYPDIDIAFDGADEVDPQLNLIKGGGACLFQEKLVAASAKKFVVVADYRKKSDKLGQSWRQGVPIEIVPNSYSKIIQELSKKLGAKNVDLRQGGKAKAGPIITDNNNFLLDADFGEIEIDNVGKLHEQIKLLVGVVETGLFTNMANKAYFGEEDGSVSVWSK

SEQ ID NO: 697 - protein, 263 aa, Candida albicans
MFIRSLYHRISNTKTITNLIIRNMSSTSKVESAKKLAAYKAVDENFPKDAKVIGIGSGSTVIYAAERIGQLDNKDSFICIPTGFQSKQLIIDNGLRLGTIEQYPDIDIAFDGADEVDPQLNLIKGGGACLFQEKLVAASAKKFVVVADYRKKSDKLGQSWRQGVPIEIVPNSYSKIIQELSKKLGAKNVDLRQGGKAKAGPIITDNNNFLLDADFGEIEIDNVGKLHEQIKLLVGVVETGLFTNMANKAYFGEEDGSVSVWSK

SEQ ID NO: 698 - protein, 263 aa, Candida dubliniensis
MFKRNLYHQITNKITFTQLIIRNMSSTSKVESAKKLAAYKAVDENFPKDAKVIGIGSGSTVIYAAERIGQLSNKDSFICIPTGFQSKQLIIDNGLKLGTIEQYPDIDIAFDGADEVDPHLNLIKGGGACLFQEKLVATSAKKFIVVADYRKKSDKLGQLWRQGVPIEIVPNSYSKIIQELSKKLAAKNVDLRQGGKAKAGPIITDNNNFLLDADFGEIEIEKVEKLHEQIKLLVGVVETGLFTNMADKAYFGEEDGSVSVWSK

SEQ ID NO: 699 - protein, 252 aa, Candida tropicalis
MIKSFVRQLSRTSPRLTMSSSVESAKKLAAYRAVDENFPPKAKVIGIGSGSTVIYVAERIGQLENKDSFICIPTGFQSKQLIIDNGLNLGAIEQYPELDIAFDGADEVDPQLNLIKGGGACLFQEKLVASAAKKFIVVADYRKESKKLGESWRQGVPIEIVPNSYAKVTKQLYDMGAKKVDLRQGGKAKAGPVITDNNNFLLDADFGEIEDPEELHKQIKLLVGVVETGLFTDMADKSYFGEEDGSVVVWGQ

SEQ ID NO: 700 - protein, 284 aa, Lodderomyces elongisporus
MLFHRILPQYKTAISTYLTPTHCRLYIANLVTSRRMTNIEAAKKLAAYRAVDENLPPHAKVIGIGSGSTVVYVAERIGQLPNKDDFVCISTGFQSKQLIIDNGLKLGQIEQHPSIDIAFDGADEVDPQLNLIKGGGACLFQEKLVASASDKLIIVADFRKQSKHLGQNWRQGVPIEVVPIAFTKLINDLKRLGAKSVDLRQGGKAKAGPVITDNNNFILDADFGIIEDPKSLHLQLKQLVGVVDTGLFTGITEKVYFGEESGEVTTWDGVVTGSTTEEVIAESK

SEQ ID NO: 701 - protein, 251 aa, Clavispora lusitaniae
MRSFFLSSIRQTRSFSMTSLVEKAKRAAAHRAVDENLSAHAKVVGVGSGSTVVYVAERLGQLPQKASFVCIPTGFQSKQLIIDNGLTLGTIEQFPQIDIAFDGADEVDGKLGLIKGGGACLFQEKLVATAAEKFVVVADYRKESRVLGSQWTKGVPIEIVPNSYAKVTLDLKALGARTVVLRQGGSAKAGPVVTDNNNFLLDADFGDISDPEALHAQIKMLVGVVETGLFTGMATKAYFGQENGEVSVWEA

SEQ ID NO: 702 - protein, 247 aa, Pichia guilliermondii
MLPTFVRFSRIMSSGIEHAKRMAAYKAVDANFPPHAKVVGIGSGSTVVYVAERIGQLKNKHDFVCISTGFQSKQLIIDNGLTLGAIEQFPKVDIAFDGADEVDTNLNLIKGGGACLFQEKLVASSADKFIVVADTRKKSPSDLGIAWRKGVPIEVVPNSYAVVTRQLKELGAKSVVLRQGGGAKAGPVVTDNNNFLIDADFGSISDPGSLHQQIKLLVGVVETGLFVDMAHTAYFGDESGEVSEQSR

SEQ ID NO: 703 - protein, 247 aa, Pichia guilliermondii
MLPTFVRFSRIMSSGIEHAKRMAAYKAVDANFPPHAKVVGIGSGSTVVYVAERIGQLKNKHDFVCISTGFQSKQLIIDNGLTLGAIEQFPKVDIAFDGADEVDTNLNLIKGGGACLFQEKLVASSADKFIVVADTRKKSPSDLGIAWRKGVPIEVVPNSYAVVTRQLKELGAKSVVLRQGGGAKAGPVVTDNNNFLIDADFGSISDPGSLHQQIKLLVGVVETGLFVDMAHTAYFGDESGEVSEQLR

SEQ ID NO: 704 - protein, 237 aa, Pichia stipitis
MSSLSLVEQAKKSAAYQAVDENFPVSAKVVGIGSGSTVVYVAERIGQLANKDSFVCIPTGFQSKQLIIDNGLKLGAIEQFPEIDIAFDGADEVDPALNLIKGGGACLFQEKLVAASAKTFVVVADYRKKSDNLGIQWKQGVPIEIVPNSYAKVIQDLKKLGAITVNLRQGGSAKAGPIITDNNNFLLDADFGAIKDPKALHDQIKALVGVVETGLFTSMAAKSYFGEQDGQVNIWSI

SEQ ID NO: 705 - protein, 252 aa, Debaryomyces hansenii
MLKRIISARYIRNMSSGASLVEKAKKSAAYQAVDENFPEGAKVVGVGSGSTVIYVAERISQLKNKESFVCVPTGFQSKQLIIDAGLRLGTIEQYPEVDIAFDGADEVDTELNLIKGGGACLFQEKLVAAAASKFVIVADFRKRSPSKLGIQWRKGVPIEIVPCAYAKVSKDLEAMGAKKVELRQGGSAKAGPVVTDNNNFLIDADFGEIEDPAKLHTDIKQLVGVVETGLFVQMAYKTYFGEESGEVKCWSK

SEQ ID NO: 706 - protein, 239 aa, Debaryomyces hansenii
MSSGASLVEKAKKSAAYQAVDENFPEGAKVVGVGSGSTVIYVAERISQLKNKESFVCVPTGFQSKQLIIDAGLRLGTIEQYPEVDIAFDGADEVDTELNLIKGGGACLFQEKLVAAAASKFVIVADFRKRSPSKLGIQWRKGVPIEIVPCAYAKVSKDLEAMGAKKVELRQGGSAKAGPVVTDNNNFLIDADFGEIEDPAKLHTDIKQLVGVVETGLFVQMAYKTYFGEESGEVKCWSK

SEQ ID NO: 707 - protein, 252 aa, Pichia pastoris
MYRRFLSKATTRTMSSLVEQSKKLAAYKAVDENLKDSHSVVGVGSGSTVVYVAERLGQLEHKSSFVCIPTGFQSKELILSNGLRLGSVEEYSSIDIAFDGADEIDSQLNLIKGGGACLMQEKLVASCSKQLFIVADYRKRSPEKLGHAWRQGVPIEVVPAAYNKVLNDLKNLEGYKSAKVRYGGTFKAGPVVTDNSMFIIDADFGEIPVEKVSTLHSQIKGLVGVLETGLFANMTTAAYIGNEDGSVATLTL

SEQ ID NO: 708 - protein, 258 aa, Saccharomyces cerevisiae
MAAGVPKIDALESLGNPLEDAKRAAAYRAVDENLKFDDHKIIGIGSGSTVVYVAERIGQYLHDPKFYEVASKFICIPTGFQSRNLILDNKLQLGSIEQYPRIDIAFDGADEVDENLQLIKGGGACLFQEKLVSTSAKTFIVVADSRKKSPKHLGKNWRQGVPIEIVPSSYVKVKNDLLEQLHAEKVDIRQGGSAKAGPVVTDNNNFIIDADFGEISDPRKLHREIKLLVGVVETGLFIDNASKAYFGNSDGSVEVTEK

SEQ ID NO: 709 - protein, 260 aa, Candida glabrata
MSYTPLPNINDFPTLGNPLEDAKRAAAYRAVDENLNFDEHRIIGVGSGSTVVYVAERIGQYLKDEKYHDKVSKFICIPTGYQSRNLIQDNGLILGSIEQHPHVDIAFDGADEVDHNLQLIKGGGACLFQEKLVSTSAKIFIVVADSRKKSDTNLGINWKRGVPIEIVPSAWSRVQHDLTSILHANSAPVRQGGSAKAGPVVTDNMNFLIDADFGEIQDPKALHEQIKMLVGVVETGLFIDNAHRAYFGKPDGSVEVIDKK

SEQ ID NO: 710 - protein, 259 aa, Vanderwaltozyma polyspora DSM 70294
MSSVPDIKTLPKLSNPLEDAKRLAAYRAVDENVDFQNERVIGIGSGSTVVYVAERLGQYLKDPKYTKYVSQFVCIPTGFQSRALILDNGLQLDSIDHHPIIDIAFDGADEVDVNLQLIKGGGACLFQEKLVSTSAKRFIVVADHRKQSPQYLGKNWRQGVPIEVVPSAYVRVQHDLLNKLHAQTAVVRQGGSAKAGPVVTDNNNFIIDADFGEIKDPKSLYVSIEMLIGVVEVGLFIDNAEKVYFGNADGSVNVLDKKN

SEQ ID NO: 711 - protein, 275 aa, Lachancea thermotolerans
MFRNLKSLVHTSVRRFAAKMTSIPDVKNLPTLHSTLEEAKRVAAYRAVDENLDYANHRVIGVGSGSTVIYVAERLGQYLLDPQFSIYASQFICIPTGFQSKELILTNGLRLGSVEQYPVIDIVFDGADEVDVNLQLIKGGGGCLFQEKLVSTSASKFVVVADYRKRSPKYLGTNWVKGVPIEVVPTSYIRVLNDLKTKLKCKNAVLRQGAPAKAGPVVTDNCNFIIDAHFGEIEHPEKLHQDIKMLVGVVETGLFIDNASKAYFGNPDGSVEMLV

SEQ ID NO: 712 - protein, 274 aa, Kluyveromyces lactis
MYRVFDKLASRPFVSLPGIQLIAKMPLSDLNKLPPLADQLEQAKRIAAYRAVDENFDAKTHKVVGVGSGTTVVYVAERLGEYMDEKTNFVCIPTGFQSKQLILSNKLQLGVIEQFPEVDIAFDGADEVDAGLQLIKGGGACLFQEKLVSTSAKKFIVVADSRKKSPKYLGTNWKKGVPIEVVPSSYVRVLSDLKNKLNCKSAMVRQGGSAKAGPVVTDNCNFIIDADFGEITDPRKLHQDIKLLVGVVETGLFIDNAEKAYFGYPDGSVDLQEL

SEQ ID NO: 713 - protein, 255 aa, Ashbya gossypii ATCC 10895
MSVTPIEELPSLGDALEDAKRAASYRAVDENLDPAKHRVVGIGSGSTVVYVAERIGKYQASPELKAKVEFICIPTGFQSRQLILDNGLRLGSIEQYPEVDIAFDGADEVDPELNLIKGGGACLFQEKLVSTSSAQFIVVADSRKRSPQRLGTSWTRGVPVEVVPSAYVRVLRDLHGIPGCRSAQLRLGEPGKAGPVVTDNNNLLIDADFGPLEDPAALHARIKALVGVVETGIFAGNAAKAYFGSADGSTQTLAR

SEQ ID NO: 714 - protein, 274 aa, Schizosaccharomyces pombe
MDSAEKKLDLSPIELAKRLACHMAVDENYPENPKVIGIGSGSTVVYVVERLLTKPGVDSVVFIPTGFQSKQLIVNNGLRLGDPDCYPNVDVSFDGADEVDDNLQCIKGGGACLFQEKLIAFLAKRLVIVADSRKNSHVLGEYWKKGVPIEVMPMAYASILPQLVELGAIEPKLRMGAPGKAGPVVTDNGNFIIDAHFGLIKNPKELFAKIKLLVGVVEVGLFCDMISAVYFGSKDGSVTVKKASGEKHIIPAPVTAAANEVDAKVAETNAKPLN

SEQ ID NO: 715 - protein, 276 aa, Schizosaccharomyces japonicus
MSRTLDLDSEDLSPIELAKRQACHMAVDENLPKSAKVIGIGSGSTVVYVVERLLKKPGIENVVFLPTGFQSKELIVSNGLRLGDPDCYPDVDVAFDGADEVDANLNCIKGGGACLFQEKLIAVLTKRLVIVADSRKNSEKLGAYWVKGVPIEVVPMAYTFVLRELKRLGCKEPKLRMGAPGKAGPLVTDNGNFIIDANFGLIDKPEELFKQIKLIIGVVEVGIFSQMIQSAYFGNPDGSVTVKKNDGTQRIIPAEVTVASAVQQKITGENPNVITV

SEQ ID NO: 716 - protein, 243 aa, Yarrowia lipolytica
MSSELPPLEQAKRIAAHQAVEQHYPKDAKVVGIGSGSTVVYVAEKIASLPKELTKDTVFISTGFQSKQLIQNAGLRLGCIDQYSNGDLDVAFDGADETDPQLNCIKGGGACLFQEKIVAECARKFVVVADYRKQSKALGTVWIQGIPIEVVPDAYNKVIADLKKMGAQSAVLRPGSPGKAGPIITDNGNFIVDAYFGEIQPDAVKDLHIKIKLLLGVVETGLFTNADVAYFGNADGTISTITK

SEQ ID NO: 717 - protein, 272 aa, Neosartorya fischeri
MASVIEAAKRAAGKAAVANHYPKDAKFVGIGSGSTIVYVVEAIKESGIDTSMTRYVPTGFQSKQLILSAGLTAVEFDSLPEGTVLDVAFDGADEVDDELNLIKGGGACLFQEKIVALQAKEFICVADSRKLQSRLLTNWKYIPIEVAPIAAPRVLTKLRELGSIQPAIRLSGTSKGPLKTDQDFYIIDAPFPPLLTKADVAAGNDGNGKGGIWEVDALAQAIKMIAGVLEVGIFSGVTGPQAQALGGIGGQKPIAAYFGMPDGTVSVRKAIS

SEQ ID NO: 718 - protein, 272 aa, Aspergillus fumigatus
MASVIEAAKRAAGKAAVANHYPKDAKFVGIGSGSTIVYVVEAIKESGIDTSMTRYVPTGFQSKQLILSAGLTAVDFDSLPEGTVLDVAFDGADEVDDELNLIKGGGACLFQEKIVALQAKEFICVADSRKLQSRLLTNWKYIPIEVAPIAAPRVLTKLRELGSIQPAIRPSGTSKGPLKTDQDFYIIDAPFPPLLTKADVAAGKDGSGKGGIWEVDALAQAIKMIAGVLEVGIFSGVTGPQAQALGGVGGQKPIAAYFGMPDGTVSVRKAIS

SEQ ID NO: 719 - protein, 272 aa, Aspergillus clavatus
MASLIEAAKRAAGQAAVANHYPTNPKFVGIGSGSTIVYVVEAIKESGIDTSQTKYVPTGFQSKQLILSAGLTAVEFDSLPEGTVLDVAFDGADEVDDELNLIKGGGACLFQEKIVALQAKEFICVADSRKLQSRLLTNWKYIPIEVAPIAAPRVLTKLRELGSIQPAIRLSGTSKGPLKTDQDFYLIDAPFPPLLTKADVAAGKDGSGKAGVWEANALAQAIKMIAGVLEVGIFSGVTGPQAQALGGIGGQKPIAAYFGMPDGSVSVRKALA

SEQ ID NO: 720 - protein, 273 aa, Aspergillus niger
MASVVEAAKRAAGKAAVENHYPKDAKYVGIGSGSTIVYVVEAIKESGVDTSATKYVPTGFQSKQLIVNAGLTAVDFDALPEGTVLDVAFDGADEVDDELNLIKGGGACLFQEKIVALQAKEFICVADSRKLQSRLLTGWKYIPIEVAPIAARRVLGALKEIGSIDPAVRVNSDAKQGPLKTDQAFFIIDAPFKTLLTQADVAAGKDGSGKDGVWEVHALSQAIKQIPGVLDVGIFSGMTGPQAQALGGVGGQKPIAAYFGMPDGSVSVRKAAA

SEQ ID NO: 721 - protein, 278 aa, Aspergillus oryzae
MADLIESAKRAAGQAAVKNHYPKDAKYVGIGSGSTIVYVVEAIKESGVDTSQTKYVPTGYLSKQLIVSNGLTAVDFDSLPEGTVLDIAFDGADEVDDDLNLIKGGGACLFQEKIVALQAKEFVCVADSRKLQSRLLSNWKYIPIEVAPIAASRVLGELRELGSISPALRLNTTAPEGAPKPTPLKTDQAFNIIDAPFKSLLTKADIAAGQDGTGKDGVWEVEALSRAIKQIPGVLDVGIFSGETGPQAQARGGTGGQKPIAAYFGMPDGSVSVRKASA

SEQ ID NO: 722 - protein, 277 aa, Aspergillus terreus
MSNAIEEAKRAAGKAAVDNHYPKDAKFVGIGSGSTIVYVVKAIKESGIDTSKTKYVPTGFQSKQLIVSNDLTAIDFDSLPEGTVLDVAFDGADEVDDELNLIKGGGACLFQEKIVALQAKEFIVVADSRKLQSRLLSNWKYIPIEVAPIAAHRVLSALKELGSINPVVRVPPGSSPELPKPGPLKTDQGFFIIDAPFQTLLTQGDVAAGKDGSGKGGVWEVDALSRAIKQIPGVLDVGIFSGVTGPQAQAAGGIGGQKPIAAYFGMPDGSVSVRKAA

SEQ ID NO: 723 - protein, 273 aa, Aspergillus nidulans FGSC A4
MAELIEKAKRAAGKAAVENHYPKDAKFVGIGSGSTIVYVVEAIKELGIDTSGTCYVPTGFQSKQLIVSAGLTAVDFDAIPEGTVLDIAFDGADEVDDELNLIKGGGACLFQEKIVALQAKEFICVADSRKLQSRLLSNWKYIPIEVAPIAAKRVLPALRQLGSINPVLRPQTGSKLGPLKTDQDFYIIDAPFPTLLTKADVAAGKDGSGKDGIWEVDALSLAIKQIPGVLDVGIFSGVTGPQAQALGGIGGQKPVAAYFGMPDGSVQVRKADA

SEQ ID NO: 724 - protein, 271 aa, Penicillium chrysogenum
MSAVEEAKRTAAKVAVEKHYPKDARWVGIGSGSTIVYVVEAITNLGVDTSNTKYIPTGYQSKQLIVNAGLMAVEYDALPLGTVLDVAFDGADEVDEDLNCIKGGGACLFQEKIVALQAKEFICVADHRKLQPRLLTSWKSIPIEVAPIAAYRVIQKLKELGSINPAVRPSASVKEGPLKTDQDFFIVDAPFKPMLIKADIEAGQDGNGKDGVWAVEVLARKIKEIIGVLEVGIFHGQTGPQAAAAGGLGGQRPVAAYFGMSDGTVAVRKAE

SEQ ID NO: 725 - protein, 274 aa, Ajellomyces capsulatus
MSTIEDAKRNAAKQAVAKHYPPNPKFVGIGSGTTIVYVVEAIKALGVDTTTTGFVPTGHQSNQLVANAGLTSISLDALPEGAVLDVAFDGADEVDDDLNCIKGGGACLFQEKLVALQAKEFICVADSRKLQRRLLTNWPSIPIEVAPLAVRRVISELQKLGSPLPKLRNAPIKEGEHTQPVKTDQDFFLVDAPFPKLLLPSDVAQGEDGSGKNGVWEVTALAERIKLIPGVLEVGLFCGLTGPQAQAAGGIGGQKPTAAYFGMLDGSVSVRKAN

SEQ ID NO: 726 - protein, 274 aa, Ajellomyces capsulatus
MSTIEDAKRNAAKQAVAKHYPPNPKFVGIGSGTTIVYVVEAIKALGVDTTTTGFVPTGYQSNQLVVNAGLTSISLDALPEGAVLDVAFDGADEVDDDLNCIKGGGACLFQEKLVALQAKEFICVADSRKLQRRLLTNWPSIPIEVAPLAVRRVISELQKLGSPLPKLRNAPIKEGEHTQPLKTDQDFFLVDAPFPKLLLPSDVAQGEDGSGKNGVWEVTALAERIKLIPGVLEVGLFCGLTGPQAQAAGGIGGQKPTAAYFGMPDGSVSVRKAN

SEQ ID NO: 727 - protein, 292 aa, Ajellomyces capsulatus
MSTIEDAKRNASKLAVAKHYPPNPKFVGIGSGTTIVYVVEAIKALGVDTTATGFVPTGYQSNQLVVNAGLTSISLDALPEGAVLDVAFDGADEVDDDLNCIKGGGACLFQEKLVALQAKEFVCVADSRKLQRRLLTNWPSIPIEVAPLAVRRVISELQKLGSPLPKLRNAPIKEGEHTQPVKTDQDFFLVDAPFPKLLLPSDVAQGEDGSGKNGVWEVTALAERIKLIPGVLEVGLFCGPTGPQAQAAGGIGGQKPTAAYFGMPDGSVSTYSATSCVCYKRYCYRNDCRAIE

SEQ ID NO: 728 - protein, 274 aa, Ajellomyces dermatitidis
MSTIEDAKRNAAKEAVAKHYPPNPKFVGIGSGTTIVYVVEAIKALGVDTSSTGFVPTGYQSNQLVANAGLTPVAFDALPEGTVLDVAFDGADEVDDDLNCIKGGGACLFQEKLVALQAKEFICVADSRKLQPRLLTNWPSIPIEVAPMAVGRVTSELKKLGSPLPKLRTAPVNAGEQTQPVKTDQDFFLIDAPFPKLLLSSDVVQGQDGSGKNGVWEVTALAERIKLIPGVLEVGLFCGLTGPQAQATGGIGGQKPVAVYFGMPDGSVSVRKAS

SEQ ID NO: 729 - protein, 274 aa, Paracoccidioides brasiliensis
MSTIEDAKRNAAKEAVDKHYPPNAKFVGIGSGTTIVYVVEAIKALGVDTSTTGFVPTGYQSNQLVVNAGLTPVAFDALPDGAVLDVAFDGADEVDDDLNCIKGGGACLFQEKLVALQAKEFICVADSRKLQSRLLTNWPSIPIEVAPIAVRRVIAELQKIGSPLPKLRITAPEVGEHATPVKTDQGFFLIDAPFPKLLLPSDVAQGQDGSGKNGVWEVTALAERINMIPGVLEVGLFCGLTARQAQAVGGIGGQKPVAAYFGMPDGSVSVRTTK

SEQ ID NO: 730 - protein, 274 aa, Paracoccidioides brasiliensis
MSTIEDAKRNAAKEAVDKHYPPNAKFVGIGSGTTIVYVVEAIKALGVDTSTTGFVPTGYQSNQLVVNAGLTPVAFDALPDGAVLDVAFDGADEVDDDLNCIKGGGACLFQEKLVALQAKEFICVADSRKLQSRLLTNWPSIPIEVAPIAVRRVIAELQKIGSPLPKLRITAPEVGEHAAPVKTDQGFFLIDAPFPKLLLPSDVAQGQDGSGKNGVWEVTALAERINMIPGVLEVGLFCGLTGPQAQAVGGIGGQKPVAAYFGMPDGSVSVRTTK

SEQ ID NO: 731 - protein, 274 aa, Paracoccidioides brasiliensis
MSTIEDAKRNAAKEAVDKHYPPNAKFVGIGSGTTIVYVVEAIKALGVDTSTTGFVPTGYQSNQLVVNAGLTPVAFDALPEGAVLDVAFDGADEVDDDLNCIKGGGACLFQEKLVALQAKEFICVADSRKLQSRLLTNWPSIPIEVAPIAVRRVITELQKIGSPLPKLRITAPEVGEHATPVKTDQGFFLIDAPFPKLLLPSDVAQGQDGSGKNGVWEVTALADRINMIPGVLEVGLFCGLTGPQAQAVGGIGGQKPVAAYFGMPDGSVSVRTTK

SEQ ID NO: 732 - protein, 271 aa, Coccidioides posadasii C735 delta SOWgp
MSAIEDAKRAAAREAVANHYPQNPKFVGIGSGTTIVYVVEAIKALGIDTSSTSFVPTGFQSNQLIVNAGLTPIAFDALPEGAVLDIAFDGADEVDDDLNCIKGGGACLFQEKVVALQAKEFIVVADYRKLQPRLLTAWPSIPIEVAPLASRRVITALQALGSPEPKLRQSLISQEGPVKTDQSFFLIDAPFPQLLTSSDIQSGKTASAKEGIWEVETLAKEIKQIPGVLEVGLFYGPTGPQAQATGGVGGQKPIAAYFGMADGSVSVRKVK

SEQ ID NO: 733 - protein, 271 aa, Coccidioides immitis
MSAIEDAKRAAAREAVANHYPQNPKFVGIGSGTTIVYVVEAIKALGIDTSSTSFVPTGFQSNQLIVNAGLTPIAFDALPEGAVLDIAFDGSDEVDDDLNCIKGGGACLFQEKLVALQAKEFIVVADYRKLQPRLLTAWPSIPIEVAPLASRRVITALQALGSPEPKLRQSLISQEGPVKTDQSFFLIDAPFPQLLTSSDIQSGKTASAKEGIWEVETLAKEIKQIPGVLEVGLFYGPTGPQAQATGGVGGQKPIAAYFGMADGSVSVRKVK

SEQ ID NO: 734 - protein, 269 aa, Microsporum canis
MADIEAAKRAAATEAVKNHYPKDAKFIGIGSGTTIVYVVEAIKELGIDTSATSFVPTGYQSNQLIVDAGLTAIAFDALPEGTVLDAAFDGADEVDDDLNCIKGGGACLFQEKLVALQAKEFICVADWRKNQSRLLTSWPSIPIEVAPLAARRVIDELKLLGSPNPLLRQNPREKSGPVKTDQSFFIVDAPFPKLLLPSDIAAGQKAEGGAWEVEKLANAINAITGVLEVGLFCGPTGPQAQASRRVGGQKPVAAYFGYTDGTVVSKRAK

SEQ ID NO: 735 - protein, 284 aa, Pyrenophora tritici-repentis
MTDTNVEAAKRAAAHQAVADHFDPAATHVGIGSGTTIVYVVEAIKERSTNPNILFVPTGFQSRQLVINAGLTAISFDSLPDRVMLDVAFDGADEVDSELNCIKGGGACLFQEKLVAERAKKFVCVADYRKRQDRLLTNWPTIPIEVAPLSQLKVAAALKMLGSTGPKLRTTLLEKSGPLKTDQDFYILDAPFPPLLTSADVAAGKGKGDGSDGTWEVNNISRAIKGLTGVLEVGIFAGLNGIDAQALREKDQSTKAVKGGQKPVAVYFGMQDGSIKVRTAEGEK

SEQ ID NO: 736 - protein, 284 aa, Phaeosphaeria nodorum
MTDTAVEAAKRAAAQQAVKDHFDPSSTHVGIGSGTTIVYVVEAIKERSTNPNILFVPTGYQSRQLVINAGLTPISFDSLPDHIMLDVAFDGADEVDAELNCIKGGGACLFQEKLVAERAKKFVCVADYRKRQDRLLTIWPTIPIEVAPLSQRKVVAALKLLGSPNPTLRTTLLEKSGPLKTDQDFYIVDAPFKTLLTAADVKAGKGKGDGTDGTWEVKAISKAIKGLTGVLEVGIFAGLNGVEAQELRAQDKSVSAVMGGQKPIAVYFGMADGSVKLRTAEGEQ

SEQ ID NO: 737 - protein, 275 aa, Chaetomium globosum
MSTTAEEQAKLVETSKRLAAYQAVKDHLLPEYTRIGIGSGSTVVYVVEAIAALGPAATSKMAFYPTGSQSEELIEAAGLTLQYISKLPAGQQLDVAFDGADEVDDDMNLIKGGGACLWQEKIVAASAKQFVCVADFRKLSPRLGTAWKKGIPIEVLPMAAPRVLDELQRMGSQNPRIRPGLPGKAGAIVTDNGLWIIDAPFAPLLLPKDTETDRGTDGAWTVDALADGLIKIPGVAEIGLFYGKNGLQVASGAQKPVAAYFGMADGSVEVKTPSS

SEQ ID NO: 738 - protein, 283 aa, Neurospora crassa
MSTAPDASAAQQLIEKSKFLAANRAVTEHLSPTYRHIGIGSGSTVIHVVDVISKLGTTITGPMTFYPTGDQSRDLIQAAGFRLGYLSDLSPGHALDVCFDGADEVDPALNLIKGGGACLLQEKLVATAARKFVCVADSRKISNHLGTQWKKGIPIEVFPMAVPQVLGELERLGRLSAQVRSGLPGKAGACVTDNGLRIVDAVFKPLLTELPEGKQEGEEGVWTVDGLARRLIEIPGVAEHGLFYGKSGLEVESGGAQKPVAAYFGMEDGSVMVQTLENGLVKA

SEQ ID NO: 739 - protein, 297 aa, Magnaporthe grisea
MASSGSAVSAVEQAQLIEMAKKAAAFTAVKDHLDPRYTHVGIGSGSTVVYVVEAIKELHPEASKDMTFYPTGDQSKGLIKAGGLRAAPIEDRPQGSLLDVYFDGADEADADLNLIKGGGGCLWQEKIVAVASRTFVCIGDFRKLSRNLGTQWKQGIPIEVLPKAADHVLAELERLGAHSPRLRSGSGKAGSVVTDNGMHIIDAPFTPLLLAGDEGGTGENGIWSVDRLAAKLKSLVGVCEIGLFYGRSGLDAKDEGGAQKPVAAYFGMADGSVQILNQGSPPVTLTTSSTGGSDGSK

SEQ ID NO: 740 - protein, 280 aa, Nectria haematococca
MSSANLVESAKKQAAYQAVNDHLLPEYKYVGIGSGSTVVYVVEAIVSKGPEFYGGMTFIPTGSQSKGLIRAAGLKLAILDERPTVDGVPVALDVAFDGADEVDEDLNLIKGGGACLFQEKLVAIAAKKFIAVADYRKQSPRLCTTWKTIPIEVLPMAAPDVLTRLRAMGSPNPVVRSGLPSKAGECVTDNGMWLIDAPFPPLLLAKDITSEVDGQGKDGVWEINALAQELVRLPGIVEIGLFHGFNGDEAVKLGKQLQAQKPVAAYFGLANGEVQVQNAA

SEQ ID NO: 741 - protein, 281 aa, Gibberella zeae
MSSSANLVESAKKLAAYQAVNDHLDASYKFVGIGSGSTVVYVVDAIVSKGPEFYKGMTFIPTGSQSKGLIRAAGLNLVNLDERPMVDGLPVPLDVAFDGADEVDEDLNLIKGGGACLFQEKLVAIAAKKFIAVADYRKQSPKLCTTWKTIPIEVLPLSAPDVLVRLRAMGSPKPAIRSGLPAKAGECVTDNGMWLIDAPFSPLLLPKDINSENKGRGENGAWEVNALAEELVRTPGIVEIGLFHGFNGNEAVKLGKESQAQKPIAAYFGLANGEVQVQNAA

SEQ ID NO: 742 - protein, 281 aa, Verticillium albo-atrum
MSTLSPVESAKKAAAARAVSEHLQPSHRYVGIGSGSTVVYVVDAIAAKGPSFWGEMTFFPTGSQSKGLIRAAGLRLCNLDDRPLESGKPVTLDVAFDGADEVDAELNCIKGGGACLLQEKLVAIAAKKFVVVADYRKLSNNLLTQWKTIPIEVLPMAAPDVLNQLVALGSTGPLVRPGVPGKAGEVVTDNGMWIIDAPFAPLKLLSEGAGAERAADGSWGVKALADEIVKIPGVVEVGIFFGLDGSEAAKAGKSGLAQKPVAAYFGMEDGSVKVTNAAGSE

SEQ ID NO: 743 - protein, 220 aa, Ferroglobus placidus
MKEIAAEKALEFVENGMILGLGSGSTVRIFVEKLGELVRKERLKVEVIPTSYDTEILAVKNGLKVSSLLEHPEPDLCVDGADQVDRKLNLIKGGGGALTREKIVAEASKKFYVVVDESKLVERLNMAIPVEILPFAYGFVERRLKELGYNCNLRTSVRKLGPVISDNGNYIADVEAKEVDVEKIERDFRVPGIIEHGVFPSEMVDLVIVGRRDGAEIIRK

SEQ ID NO: 744 - protein, 225 aa, Archaeoglobus fulgidus
MDSSGKYNAAKLALELVKDGMVLGIGSGSTVEVFLNLLGDKIREEGLEIYGIPSSYQSYFAAIRNGVEIVDLVEFEPDLCIDGADQVDAKLNCIKGGGGAMTREKIVAKASRKVVIIVDESKLVEKLSMPVPVEVLPFAYGWVLREIEKMGCKARLREGKGKIGPVITDNGNFVVDCDFGVIEEDRVEGLEGEIKLISGVVENGIFSKELIDAVIAGSSRSARFL

SEQ ID NO: 745 - protein, 233 aa, Bacteroides intestinalis DSM 17393
MKWDNQLINHLQWSNAIINREGKEIVAREIAAMAEEGDVIGAGSGSTVYLTLFALAERIRKESLHIEVIPASAEISMTCIQLGIPQTTLWNKRPDWAFDGADEVDPERSLIKGRGGAMFKEKLLIKSSGKNFIIIDDTKLVDHLGSRFPIPVEVFPSALTFVESEMRRLGASEITLRLADGKDGPVLTENGNFILDTRFSYIDPSLEENLKMITGVIESGLFIGYDVEIVVAK

SEQ ID NO: 746 - protein, 233 aa, Bacteroides cellulosilyticus DSM 14838
MKWDNQLINHLQWSNAIINREGKEIVAQEIAAMAKDGDVIGAGSGSTVYLTLFALAERIRKESLHIEVIPASAEISMTCIQLGIPQTTLWNKRPDWVFDGADEVDPEKSLIKGRGGAMFKEKLLIKSSSKSFIIIDDTKLVDHLGSHFPIPVEVFPGALTFVESEMQRLGASDVKLRLAGGKDGPVLTENGNFIFDTRFSYVDPSLEQNLKAITGVIESGLFIGYDVEIVVAK

SEQ ID NO: 747 - protein, 233 aa, Bacteroides sp. 2_2_4
MDWENHLIKHLQWSDSIINREAKEHVAREIAATAKDGDVIGAGSGSTVYLTLFELSRRIREEHLHIEVIPASQEISMTCIQLGIPQTTLWNQRPDWTFDGADEVDPQQNLIKGRGGAMFKEKLLIRSSRKTFIIIDPSKRVNQLGSKFPIPVEVFPDSLTYVEHELQRLGASEIVLRPARGKDGPIFTENGNFILDTRFNYIDSSLEEQLKAITGVIESGLFIGYDIKVIVAE

SEQ ID NO: 748 - protein, 233 aa, Bacteroides ovatus
MDWKNHLIKHLQWSDSIINREAKEHVAREIAATAKDGDVIGAGSGSTVYLTLFELSRRIREEYLHIEVIPASQEISMTCIQLGIPQTTLWNKRPNWTFDGADEVDPQQNLIKGRGGAMFKEKLLIRSSRKTFIIIDPSKRVNQLGSKFPIPVEVFPDSLTYVEHELQRLGASEIVLRPARGKDGPIFTENGNFILDTRFNYIDSSLEEQLKAITGVIESGLFIGYDIKVIVAE

SEQ ID NO: 749 - protein, 233 aa, Bacteroides sp. D2
MDWKNHLIKHLQWSDSIINREAKEHVAREIAATAKDGDVIGAGSGSTVYLTLFELSRRIREEHLHIEVIPASQEISMTCIQLGIPQTTLWNQRPDWTFDGADEVDPQQNLIKGRGGAMFKEKLLIRSSRKTFIIIDPSKRVNQLGSKFPIPVEVFPDSLTYVEHELQRLGASEIVLRPARGKDGPIFTENGNFILDTRFNDIDSSLEERLKAITGVIESGLFIGYDIKVIVAE

SEQ ID NO: 750 - protein, 233 aa, Bacteroides sp. D1
MDWENHLIKHLQWSDSIINREAKEHVAREIAATAKDGDVIGAGSGSTVYLTLFELARRIREEHLHIEVIPASQEISMTCIQLGIPQTILWNKRPDWTFDGADEVDPQRNLIKGRGGAMFKEKLLIRSSRKTFIIIGPSKRVNLLGNKFPIPVEVFPDSLTYVDHELQRLGASEIVLRPAHGKDGPVFTENGNFILDTRFNYIDSSLEEQLKTITGVIESGLFIGYDVEVIMAE

SEQ ID NO: 751 - protein, 233 aa, Bacteroides thetaiotaomicron
MNWENHLIKDLQWSNEIINREAKERVAREIAATAKTGDVIGAGSGSTVYLTLFELAKRIHEEHLYLEVIPASQEISMTCIQLGIPQTTLWDKRPDWTFDGADEVDPDRNLIKGRGGAMFKEKLLIRSSGKTFIIVDPSKLVNILGSKFPIPVEVFPHALSYVEKELRRLGASEISLRPAHGKDGPILTENGNFILDTRFHYIDASLEEQLKTITGVIESGLFINYDIEVVVTR

SEQ ID NO: 752 - protein, 234 aa, Bacteroides sp. D20
MEWENQLIQELQWSNKISNKASKELVAQEIAGLAKDGDVIGAGSGSTVYLTLFALAQRVKQESLHIEIIPASAEISMTCIQLGLPQTTLWNKRPDWTFDGADEVDPHNNLIKGRGGAMFKEKLLIKSSGKTYIIVDESKLVSKLGSKYPIPVEVFPHALSHVENEIRLLGASKISLRLAERKDGPVFTENGNFILDIHLSNIVPDLEQKLKAITGVIENGLFIGYDITVLMANR

SEQ ID NO: 753 - protein, 234 aa, Bacteroides uniformis
MEWENQLIQELQWSNKISNKASKELVAQEIAGLAKDGDVIGAGSGSTVYLTLFALAQRVKQESLHIEIIPASAEISMTCIQLGLPQTTLWNKRPDWTFDGADEVDPHNNLIKGRGGAMFKEKLLIKSSGKTYIIVDESKLVSKLGSKYPIPVEVFPHALSHVENEIRLLGASKISLRLAEGKDGPVFTESGNFILDIHLSNIVPDLEQKLKAITGVIESGLFIGYDITVLMANR

SEQ ID NO: 754 - protein, 233 aa, Bacteroides fragilis
MKWESSLMEHLQWSDTITNRESKERLARMIAMRVQEGEVIGAGSGSTVYLALLAIAERIRTENLHVTVIPASMEISMECVRLGIPQTTLWMCRPDWTFDGADEVDPDRNLIKGRGGALFKEKLLISSSNRTFILVDESKQVSFLGSRFPVPVEVFPMALPYVEREIRAMGASRTQLRPAKGKDGPVITESGNLILDAWFSNIHSSLEKEIKSVTGVIENGLFMGYDVEVMVAK

SEQ ID NO: 755 - protein, 233 aa, Bacteroides fragilis
MKWESSLVEHLQWSDTITNRESKEQLARMIAMRVQEGEIIGAGSGSTVYLALLAIAERIRTENLHVTVIPASMEISMECVRLGIPQTTLWMCRPDWTFDGADEVDPDHNLIKGRGGALFKEKLLICSSNRTFILVDESKQVSFLGSRFPVPIEVFPMALPYVEREVLTMGALRTELRLAKGKDGPVITENGNLILDAWFGNIHSSLEKEIKSITGVVENGLFMGYDVEVMVAK

SEQ ID NO: 756 - protein, 234 aa, Parabacteroides sp. D13
MKWDHSLIDTLEWGNQISHKEDKIKIADLIASKVENGQVIGVGSGSTSYLALTRIAERIRTERLSILAIPTSLEIRMTCAQLGIPVTSLFSHKPDWTFDGADEVDSHFNLIKGRGGAMFKEKLLISSSPQTYILVDPSKKVERLGAKFPIPIEIFPEALTYVEDKLQRLNPREIKLRMGQGKDGPIITENGNMILDVWMDYIPENTESTLKSITGVLESGLFMNYKVEVLGLTS

SEQ ID NO: 757 - protein, 234 aa, Bacteroides sp. 2_1_33B
MKWDHSLIDTLEWGNQISHKEDKIKIADLIASKVENGQVIGVGSGSTSYLALIRIAERIRTERLSILAIPTSLEIRMTCAQLGIPVTSLFSHKPNWTFDGADEVDSHFNLIKGRGGAMFKEKLLISSSPQTYILVDPSKKVERLGAKFPIPIEIFPGALTYVEDRLQRLNPGEIKLRMGQGKDGPIITENGNMILDVWMDYIPENTESTLKSITGVLESGLFMNYKVEVLGLTS

SEQ ID NO: 758 - protein, 234 aa, Parabacteroides distasonis ATCC 8503
MKWDHSLIDTLEWGNQISHKEDKIKIADLIASKVENGQVIGVGSGSTSYLALTRIAERIRMEHLSILAIPTSLEIRMTCAQLGIPVTSLFSHKPDWTFDGADEVDSHFNLIKGRGGAMFKEKLLISSSPQTYILVDPSKKVERLGAKFPIPVEIFPEALTHVEDRLHRLNPREIKLRMGQGKDGPIITENGNMILDVWMDYIPENTESTLKSITGVLESGLFINYKVEVLGLTS

SEQ ID NO: 759 - protein, 231 aa, Parabacteroides johnsonii DSM 18315
MEWGKTILSSLEWGKTISNREEKERVADIISSMVKEGEIIGVGSGSTAYLALLKIARRMKNEQLHIRAIPTSQEIRMACVRLGIPVTSLWEHKPDWTFDGADEIDTEHNMIKGRGGAMFKEKLLINSSPRTYIIADPSKIVTQLGSRFPVPIEIFPEALTYVEEVLRAYNPKEIKLRMAKGKDGPVITENGNLILDTWFDHIPNNLEESIKSITGVIESGLFIHYDVHIIS

SEQ ID NO: 760 - protein, 243 aa, Treponema vincentii ATCC 35580
MKNTISVEDQKVLVAHTAIDKLISEGLIHSGMKIGLGTGSTAMPAVKRLAEYIAKGELKDIAAVPTSFQTSIACEEYNIPIFSLSSGRINGVLDLTIDGADEIDSKKNLIKGGGAALLREKIIAYNSELFVVIGDETKSVKALGVNFPLPIEIVPEARLSIMKKLESYGVSMIIRDGIRKKGPIITDNGNFIMDIKWPLNAKINPVKLESELNAIPGIIENGFFTQKSPRVFLSNANGTVEEF

SEQ ID NO: 761 - protein, 239 aa, Treponema denticola
MDTSQLKERVAYHAIDTLFSEGKIFDGMKIGLGTGSTAMPAVHRLAQLLSSGKLKKIYAVPTSFQTSIECEKLGIPIYSLSSQQIGGSLDLAIDGADEIDPDKNLIKGGGAALLKEKIIAYNSKEFVVIADERKKVKSMGKGFALPIEIIPEARLSITKALEAQGIEVFLREGVKKMGPVVTDNGNFIIDVKWPKAADVDPKALEESLNKITGVVENGFFTKNTPRVFIVHQDGNIEDL

SEQ ID NO: 762 - protein, 283 aa, Treponema paraluiscuniculi
MRNPQLAQCRYSFAPQKGHRRVSALVEKAIHERNTTTNTPLDVTAQKLLVAQRSVDTLVQEGVLHAHMSIGLGTGSTAMPAVKRIADHLARGTLSDIAAVPTSFQTALICERYNIPLFSLSSKRVGGKLDVTIDGADEIDTQNFVIKGGGAALLQEKIAAYNSAHFVIIVDETKVVETLGTRAALPIEVVPEARMSVMRTLQDWGLSVHIREAVRKKGPVVTDHGNFILDARWQSLPTRTPQDMERALNALPGVIENGLFTERTVRVFVAHADGSVEERSASF

SEQ ID NO: 763 - protein, 254 aa, Treponema pallidum
MHERNTTTNTPLDVTAQKLLVAQRSVDTLVQEGVLHAHMSIGLGTGSTAMPAVKRIADHLARGTLSDIAAVPTSFQTALICERYNIPLFSLSSKRIGGKLDVTIDGADEIDTQNFVIKGGGAALLQEKIAAYNSAHFVIIVDETKVVETLGTRAALPIEVVPEARMSVMRTLQDWGLSVHIREAVRKKGPVVTDHGNFILDARWQSLPTRTPQDMERALNALPGVIENGLFTERTVRVFVAHADGSVEERSASF

SEQ ID NO: 764 - protein, 228 aa, Borrelia recurrentis
MEKQKELISKYAIDKYVTSNMFIGIGTGTTVFYAIKHLSYKIKSGVLKNLTFYPTSSDTQCLLAKENIAYESKFTKLNKNIDITIDGADEVLLDKKALIKGGGAAHLMEKVVAYNSNQLLIIADETKIVTNLGEKTPIPIEIAPNALAFIKAKLEKMNFNPVLRTCKSKAGPLITDNNNYILDIKMNIENPKGTEKYFKLFPGILEIGIFNHQNTKIIYYQNGQIKET

SEQ ID NO: 765 - protein, 228 aa, Borrelia duttonii
MEKQKELISKYAIDNYVTSNMFIGIGTGTTVFYAIKHLSYKIKSGALKNLTFYPTSSDTQCLLAKENIAYESKFTKLNKNIDITIDGADEVLLDKKALIKGGGAAHLMEKVVAYNSNQLLIIADETKIVTNLGEKTPIPIEIAPNALAFIKAKLEKMNFNPVLRTCKSKAGPLITDNNNYILDIKMNIENPKGTEKYFKLFPGILEIGIFNHQNTKIIYYQNGQIKET

SEQ ID NO: 766 - protein, 228 aa, Borrelia turicatae
MEEQKKLVSQYAIDHYVKSNMHLGIGTGTTVFYAIKYLSKKIKSGDLKNLKLYPTSSDTKYLLARENITYESKFTKLSKNIDITIDGADEILLETKALIKGGGAAHLMEKIVAYNSHQLLIIADETKIVQTLGTRASVPIEIVPDALAFITANLANMNFNPVLRTCKSKSGPIITDNNNYILDVKMNVENPKGAEKYFKLLPGILEIGIFNHQNTKIIYYQNGQIKET

SEQ ID NO: 767 - protein, 228 aa, Borrelia hermsii
MEEQKKLVSQYAIDHYIKSNMHLGIGTGTTVFYAIKYLSDKIKSGDLKNLKLYPTSSDTKYLLAKENITYESKFTKFSKNIDITIDGADEILLEKKALIKGGGAAHLMEKIIAYNSHQLLIIADETKIVQTLGEKVSVPIEIVPDALPFITANLEKMNFNPVLRTCKFKAGPIITDNNNYILDVKMNIENPKGAEKYFKLLPGILEIGIFNHQNTKVIYYQNGQIKEI

SEQ ID NO: 768 - protein, 228 aa, Borrelia afzelii
MENQKILVAKYAIDRYIKSNMNLGIGTGTTVYHAIKYLSEKLKSGNLKNLKFYTTSSDTKYLLSKEQIPYESNFSKLNKNLDIAIDGADEILLEKKSLIKGMGGAHLMEKVIAYNSETLLIIADETKIVKKLGTKMPIPIEVAPNAVGFIMTRLEEMNLDITLRICNEKKGPIITDNNNYILDVKMHVENPEGTEKYFKLFPGILEIGIFNHQNTKIVYYQNKQIKEA

SEQ ID NO: 769 - protein, 228 aa, Borrelia afzelii
MENQKILVAKYAIDRYIKSNMNLGIGTGTTVYHAIKYLSEKLKSGNLKNLKFYTTSSDTKYLLSKEQIPYESNFSKLNKNLDIAIDGADEILLEKKSLIKGMGGAHLMEKVIAYNSETLLIIADETKIVKKLGTKMPIPIEVAPNAVGFIMTRLEEMNLDITLRICNEKKGPIITDNNNYILDVKMHVENPEGTEKYFKLFPGILEIGIFNHKNTKIVYYQNKQIKEA

SEQ ID NO: 770 - protein, 228 aa, Borrelia valaisiana VS116
MENQKILVAKYAIDHYIKSNMNLGIGTGTTIYYAIKYLSEKLKSGNLKNLKFYTTSSDTKYLLSREQIPYESNFSKLNKNLDIAIDGADEILLEKKSLIKGMGGAHLMEKVIAYNSETLLIIADETKIVKKLGTKMPIPIEVAQSAVGFIMTRLEEMNLDTTLRICNEKKGPIITDNNNYILDVKMHVENPEGTEKYFKLFPGILEIGIFNHKNTKIVYYQNKQIKEA

SEQ ID NO: 771 - protein, 228 aa, Borrelia spielmanii A14S
MENQKILVAKYAIDHYIKSNMNLGIGTGTTVYHAIKYLIEKLKSGNLKNLKFYTTSNDTKYLLSKEQIPYESNFSKLNKNLDIAIDGADEILLEKKSLIKGMGGAHLMEKVIAYNSETLLIIADETKIVKKLGTKMPIPIEVAQNAVGFIMTRLEEMNLDTTLRICNEKKGPIITDNNNYILDVKMHVENPEGAEKYFKLFPGILEIGIFNHKNTKIVYYQNKQIKEA

SEQ ID NO: 772 - protein, 228 aa, Borrelia garinii
MENQKMLVAKYSIDHYIKSNMNLGIGTGTTIYYAIKYLSEKLKSGNLKNLKLYATSSDTKYLLSKEQIPYESNFSKLNKNLDIAIDGADEILLEKKSLIKGMGGAHLMEKVIAYNSETLLIIADETKIVKKLGTKMPIPIEVAQNAVGFIMTRLEEMNLETTLRVCKEKKGPIITDNNNYILDVKMHVENPEGTEKYFKLFPGILEIGIFNHKNTKIVYYQNKQIKEA

SEQ ID NO: 773 - protein, 228 aa, Borrelia garinii
MENQKMLVAKYAIDHYIKSNMNLGIGTGTTIYYAIKYLSEKLKSGNLKNLKLHATSSDSKYLLSKEQIPYESNFSKLNKNLDIAIDGADEILLEKKSLIKGMGGAHLMEKVIAYNSETLLIIADETKIVKKLGTKMPIPIEVAQNAVGFIMTRLEEMNLDTTLRVCKEKKGPIITDNNNYILDVKMHVENPEGTEKYFKLFPGILEIGIFNHKNTKIVYYQNKQIKEA

SEQ ID NO: 774 - protein, 228 aa, Borrelia garinii
MENQKMLVAKYAIDRYIKSNMNLGVGTGTTIYYAIKYLSEKIKSGNLKNLKLYATSSDTKYLLSKEQIPCESNFSKLNKNLDIAIDGADEILLEKKSLIKGMGGAHLMEKVIAYNSETLLIIADETKIVKKLGTKMSIPIEVAQNAVGFIMTRLEEMNLDTTLRVCKEKKGPIITDNNNYILDVKMHVENPEGTEKYFKLFPGILEIGIFNHKNTKIVYYQNKQIKEA

SEQ ID NO: 775 - protein, 228 aa, Borrelia burgdorferi
MENQKILVAKYAIDHYIKSNMNLGIGTGTTIYYAIKYLSEKIKSGSLKNLKFYTTSSDTKYLLSKEQIPYESNFSKLNKNLDIAIDGADEILLEKKSLIKGMGGAHLMEKVIAYNSETLLIIADETKIVKKLGTKMPIPIEVAQNAVGFIMTRLEEMNLEATLRICKEKKGPTITDNNNYILDVKMHVENPEGTEKYFKLFPGILEIGIFNHKNTRIVYYQDKQIKEA

SEQ ID NO: 776 - protein, 228 aa, Borrelia burgdorferi
MENQKILVAKYAIDHYIKSNMNLGIGTGTTIYYAIKYLSEKIKSGSLKNLKFYTTSSDTKYLLSKEQIPYESNFSKLNKNLDIAIDGADEILLEKKSLIKGMGGAHLMEKVIAYNSETLLIIADETKIVKKLGTKMPIPIEVAQNAVGFIMTRLEEMNLEATLRICKEKKGPTITDNNNYILDVKMHMENPEGTEKYFKLFPGILEIGIFNHKNTRIVYYQDKQIKEA

SEQ ID NO: 777 - protein, 228 aa, Borrelia burgdorferi
MENQKILVAKYAIDHYIKSNMNLGIGTGTTIYYAIKYLSEKIKSGSLKNLKFYTTSSDTKYLLSKEQIPYESNFSKLNKNLDIAIDGADEILLEKKSLIKGMGGAHLMEKVIAYNSETLLIIADETKIVKKLGTKMPIPIEVTQNAVGFIMTRLEEMNLEATLRICKEKKGPTITDNNNYILDVKMHVENPEGTEKYFKLFPGILEIGIFNHKNTRIVYYQDKQIKEA

SEQ ID NO: 778 - protein, 228 aa, Borrelia burgdorferi
MENQKILVAKHAIDHYIKSNMNLGIGTGTTIYYAIKYLSEKIKSGSLKNLKFYTTSSDTKYLLSKEQIPYESNFSKLNKNLDIAIDGADEILLEKKSLIKGMGGAHLMEKVIAYNSETLLIIADETKIVKKLGTKMPIPIEVAQNAVGFIMTRLEEMNLEATLRICKEKKGPTITDNNNYILDVKMHVENPEGTEKYFKLFPGILEIGIFNHKNTRIVYYQDKQIKEA

SEQ ID NO: 779 - protein, 228 aa, Borrelia burgdorferi
MENQKILVAKYAIDHYIKSNMNLGIGTGTTIYYAIKYLSEKIKSDSLKNLKFYTTSSDTKYLLSKEQIPYESNFSKLNKNLDIAIDGADEILLEKKSLIKGMGGAHLMEKVIAYNSETLLIIADETKIVKKLGTKMPIPIEVAQNAVGFIMTRLEEMNLEATLRICKEKKGPIITDNNNYILDVKMHVENPEGTEKYFKLFPGILEIGIFNHKNTRIVYYQDKQIKEA

SEQ ID NO: 780 - protein, 228 aa, Borrelia sp. SV1
MENQKILVAKYAIDHYIKSNMNLGIGTGTTIYYAIKYLSEKIKSGSLKNLKFYTTSSDTKYLLSKEQIPYESNFSKLNKNLDIAIDGADEILLGKKSLIKGMGGAHLMEKVIAYNSETLLIIADETKIVKKLGTKMPIPIEVAQNAVGFIMTRLEEMNLETTLRICKEKKGPTITDNNNYILDVKMHVENPEGTEKYFKLFPGILEIGIFNHKKTKIVYYQDKQIKEA

SEQ ID NO: 781 - protein, 223 aa, Pyrobaculum arsenaticum DSM 13514
MSKATLAREAVKLVKPGMVVGLGSGTTAREFIKALAEARIDGVVLVPTSVDSEILAQEVGLGNALRPMWAVDHVDLAVDGADEVTRDKLILKGRGGALLREKIVDYAADMFVVLIEEHKLVERIPKASPVPIEVVPWAWRFVARRIEREFGGSARLRTGEGKLGPVVTDNGNYIVDWTPPGPLDASAEDRLKAVPGVVESGIFSKRRDAVVLVARRDGTILSF

SEQ ID NO: 782 - protein, 223 aa, Pyrobaculum aerophilum
MLKRLLAREAIRLVKSGMVVGLGSGTTAREFIKALAEAGVDDVLLVATSSDSEILAYEVGLGDRLRPMWAVDRIDLAVDGADEVTKDKVLLKGKGGALLREKIVDYAAEKFVVLIEEHKLVERIPSNNPVPVEVVPWAWRFVAREVEKRFGGVAKLRQDGGKLGPVVTDNGNYIIDWNPPGFIDPYLEDELKAIPGVVENGVFSKRRDATILVASSDGTIKTL

SEQ ID NO: 783 - protein, 223 aa, Thermoproteus neutrophilus V24Sta
MGKALVAREAVKYIKSGMVVGLGSGTTAREFIKALGELGPRDVALVATSVDSELLAVEVGLGDRLRPLWAVDRIDIAVDGADEVTEEKILLKGRGGALLREKVVDYMAERFLVLIEEHKLVQHIPARNPIPIEVVPWAWRSVARAVEAKFGGTAKLRQDGAKLGPALTDNGNYLLDWTPPGPVEPSLEEELKLIPGVVENGIFSKRRDATVLVARGDGTLKVL

SEQ ID NO: 784 - protein, 223 aa, Pyrobaculum islandicum
MLKTILAREAVKYIESGMTVGLGSGTTAREFVKALAEFGPRDVVLVATSIDSELLAIEVGLGDRLRPLWAVETIDIAVDGADEATRDKVLLKGRGGALLREKIVDYLARRFVVLVEEYKVVQYIPTRNPIPIEVVPWAWRHVAKAIKDRYGGVAKLRQDGGKLGPVVTDNGNYIIDWEPSAPIQPSLEDELKLIPGVVETGIFSKRRDAIVIVARENSSVYTF

SEQ ID NO: 785 - protein, 222 aa, Pyrobaculum calidifontis JCM 11548
MKHLLATHALRYVKGGMVIGLGSGTTAREFIKALAALRHLDLTLVATSADSEVVAYEVGLGDRLRPMWAVDKIDLAVDGADEVTRGKLMLKGRGGALLREKVVDYAAEKFVVLVERHKVVDFIPARNPVPVEVLPWAWRHVARQIEKKFGGSTALRTGEGKLGPVVTDNGNYIVDWRPEGPIDERVEDELKQIPGVLETGIFSKRKDAVVLVADEKGTVEEL

SEQ ID NO: 786 - protein, 226 aa, Thermoproteus tenax
MKHLLARKAAEYIREGSIVGLGSGSTAKAFIEELAKRVREDGLTVTLVSTSVDSELKAAEVGLDKYLAPLWAVDRIDIAVDGADELTRDRLFLKGGGGAMFREKVVDYRASTLIIIAESHKLVDRIPARHPIPIEVLPAAWRLVADDIVKRWGGKAVLRVCQCGGKLGPLVTDNGNYILDWAPPGPIDPALEDELRGIPGVIESGIFSKRRDAVVLLADERGVFEL

SEQ ID NO: 787 - protein, 223 aa, Thermofilum pendens
MKLNAAREAARHVRDGMVVGLGSGTTVKIFIDVLAERVRQENLTIFFVSSSIDTSLYAAGKGLLEVPLHEYTPEVSFDGADTVLPDRSLIKGGGGCLLREKIVDYYSKEYVVIVDATKVAETPRNLNVPVEVHPQAFKKVMEELRKSYGAVNVTLRTYEKGKLGPVLTDNGNFILDALFDELKDPLRLELSLKSVPGLIETGIFSVKKPSKIIVGYLHGVQVI

SEQ ID NO: 788 - protein, 229 aa, Caldivirga maquilingensis IC-167
MDPKLAAAKAALKYVRSGYVIGVGSGSTALMFLSELAENIEGGGLTDVKLIATSTETEYEIVKLGLGELLRYPWQVDHVDVAIDGADEVDKDKNLVKGGGGALTREKIIDYWASEFIVIVDESKLVDKIPSKHPIPVEVVPYAWPLVKARLERDYGGSAELRYSSGKRGPVITDNGNYIIDYRPGSGIEPREGERVIKCIPGVVEVGLFNGLKVSRVIVGKQDGSVNEF

SEQ ID NO: 789 - protein, 212 aa, Methanopyrus kandleri
MSGKRNAARKAAEEVCRRGYEVIGVGAGTTVEAFLEELVKREADVLVFTTIPGTIDACRRIGLNVTTIPPEELPVAIDGADAVDPDGNLLKGGGACHSLEKAIDYTADEFWVVVDESKLVENLWELPVPVEVLRGCYELTVRTLEEFGEVRPRTCDEKYGPVVSDSGNPIVDLHVDDWDPAELERELNSVPGVVECGVFPGDKVDRIIVGRS

SEQ ID NO: 790 - protein, 243 aa, Desulfurococcus kamchatkensis 1221n
MDASSIIEQAKLNACDYACRHLYEKYGDALVVGVGTGSTVKLLITKCRDFFTERILVPSSHDTLLHLVSLGLNTAVDPAGVDDIDLYIDGADEVSGKLDLVKGRGGAFLREKSLAVRSRVRMYVVDYTKYTGLNHIYVKPIPIEVVPVSVKYVIRKLQELGYGEPLLRMGTGKDGPVVSDNGNFIVDYRLLKPVEDPLSLHNTLKLVHGVIETGIFPSNLVDIVVVGEPAGVRVLGKNTGGRE

SEQ ID NO: 791 - protein, 233 aa, Staphylothermus marinus
MYEYLKKLSSIYALRMFIDKIRDSKVLGIGTGSTVKYFIDELIRLGMLKDKKVVVSSYATHNYLYKHGIDAYTPINCNYADIYVDGLDEINANLDIIKGRGAALLWEKQLAIRSKLRIYIADYTKVNPEQYLYMKPVPIEVVPNAVYYVIEKLTILGYKPVLRIGKMKDGPIITDNGNFIIDLVYEKIQNAKQVDEEIKKINGVVETGLFPNNLVDYVIVSYPGNIVKVYSRR

SEQ ID NO: 792 - protein, 237 aa, Aeropyrum pernix
MGGCDPMDEAARGALDLLGRIGGELGVLGVGTGRTVMRFLREASARGVEPGVAVPSSFETAVELAGLGWSVGDPRVYRGVNVYVDGADEAEPGRGYMVKGGGGALLGEKILSSRSKLNIFIVGEDRLVGRLGEKTPVPVEVEPGFVSMVLASLEELGLNPRVRTSPGKRGPVVSDWGGVIVDLLTGPLEDPRGLESMLRNVPGVRETGLFLGLADYIVVGLSSCGYRVLGPYRGRAV

SEQ ID NO: 793 - protein, 254 aa, Hyperthermus butylicus
MTALAKVEAARRAAEILEPLIERAERIGIGTGSTVRLVLRFLIESPAASALRRAKVYASSFDTLLELRRLGIEAYDFLPRDGLDVYFDGADEVARVSDMCMAVKGRGAAMLREKLLAFNSAYTLLVVDESKVSRNLGDKGKPVPVEVVPPAVETIVEEFESRGIRAEVRTNCSCRDGPAFTDNYGIVIDTWPWGVMSPIQYESLLDTLPGVMGHGLFIGYMDAIVVGYGDGRSEEWRCRRTRLSAGAKARRAER

SEQ ID NO: 794 - protein, 221 aa, Ignicoccus hospitalis KIN4/I
MSGKEAVARRAAELVASEAPEVLGVGSGTTVRLFIKYLKEFGFSGLTVPTSYDTALELKKHGLKVLDLMSVDEVELSVDGADEVFTMNGSLYAVKGGGAAMLREKVLAYISRKRIYIVDEGKVSGSPCSRGVPVPAEVVPSSLPAVARGLKLLGVGWKLREAKGKLGPVVTDNGNLVIDMDCKSSINVIEKVEALPGVAVTGLFGPDLIDKVVVGERGELP

SEQ ID NO: 795 - protein, 227 aa, Sulfolobus islandicus
MNPKELLATYTLNYLREKKIIGVGTGKTVKKLIEVLSKEENLKETVLFVASSLDTEIELSKHGFKVISLLSAIQPEIYVDSFDVVTKDGIMIKGGGGALLREKLLTYFSKYRIFIGEFNKLKDSKLIDVPIEVVSVGVSYVKDKLEKMGFAVKIREGSGKMGPIISDNGNAILDVSVKTENLCEFDRMIKTIPSVVETGIFCKELYNKIILANEEGRIEEMYAGDGI

SEQ ID NO: 796 - protein, 227 aa, Sulfolobus islandicus
MDPKELLATYTLNYLREKKIIGVGTGKTVKKLIEVLSKEENLKETVLFVASSLDTEIELSKHGFKVISLLSAIQPEIYVDSFDVVTKDGIMIKGGGGALLREKLLTYFSKYRIFIGEFNKLKDSKLIDVPIEVVSVGVSYVKDKLEKMGFAVKIREGSGKMGPIISDNGNAILDVSVKTENLCEFDRMIKTIPSVVETGIFCKELYNKIILANEEGRIEEMYAGDGI

SEQ ID NO: 797 - protein, 227 aa, Sulfolobus islandicus
MNPKELLATYTLNYLREKKIIGVGTGKTVKKLIEVLSKEENLKETVLLVASSLDTEIELSKHGFKVISLLSAIQPEIYVDSFDVVTKDGIMIKGGGGALLREKLLTYFSKYRIFIGEFNKLKDSKLIDVPIEVVSVGVSYVKDKLEKMGFAVKIREGSGKMGPIISDNGNAILDVSVKTENLCEFDRMIKTIPSVVETGIFCKELYNKIILANEEGRIEEMYAGDGI

SEQ ID NO: 798 - protein, 227 aa, Sulfolobus solfataricus
MDPKELLATYTLNYLRGKKIIGVGTGKTVKKLIEVLSSEENLKESSLFVASSIDTEIELSKRGFKVLSLFSAIQPEIYVDSFDIVTKDGIMIKGGGGALLREKLLAYFSKYRIFIGESTKLKDTKVIDIPIEVISVGVSYVKYKLEKMGFTVKIREGSGKMGPIISDNGNVILDVSVKTENLCEFDRMIKNIPSIVETGIFCKELYNKIILANEQGRIEEMDAGDGI

SEQ ID NO: 799 - protein, 219 aa, Sulfolobus tokodaii str. 7
MDPKEVVARFIVDKLKEHKLIGLGTGKTVKKLIEVLSEEGLLKEKIFVASSIDTELEISKREGIVITLYSGLRPQVYIDSFDFVTSDKIMIKGGGAALLREKMLYTFSKEKVFIGEELKLKDLKEYSVPVEVVPVGVAYVISALKERGYEAKIREGNGKIGPIISDNGNIILDVIVKRENLCDFERLVKEIPAIIESGIFCKKDYEIYLANENGRISIL

SEQ ID NO: 800 - protein, 220 aa, Sulfolobus acidocaldarius
MDPKEILSQYVSKRLTGYSIIGLGTGRTVKKLIEHLDREGILNQFKYIASSIDTELEISQRGGLILSLYSGIQPDIYIDSFDVVTKDKVMVKGGGAALLREKILTTFSKSSLFIGEYKKLVKIEQHSVKVPVEIVPVSIMYILKKINEIGFKTSIREGTGKMGGIISDNGNMIIDVEVRINQLCEFDKTIKSIPGIIETGVFCNKYDVVLADEDGRIEIL

SEQ ID NO: 801 - protein, 227 aa, Metallosphaera sedula
MTDPKEVLAHYILPILANKRVIGLGTGKTVRKLVEVMALQGSLQGRILVTSSTDTDLLASSKGALVLSPFSGVIPEIYVDGFDFLVESQGRKVLIKGGGAALLREKILSFFSKERIFIGETSKFVSRREIQVPVEVVPAGFSLILVRLNEMGLKPVPREGSGKMGPVVTDNGNLILDISVMVEDLCKWERELKTIPGVVETGIFCENLYDSIVIGDSEGRIQVFQRG

SEQ ID NO: 802 - protein, 201 aa, Nosema ceranae
MLKNNIKDVCEDKHTIGIGTGRTVESILQYLNPNSTYVSSSHQTSISLTNLSLKSVPIETVQRLDLYIDGCDYFDREGNMIKGKGGSLTTEKLLCSMADEVVIVVQDYKYRKRFNNCYVPIEILPQSIKYIENILIKNGIKYELRCSKNKFGPVITDLGNFIIDIVYDREFLIRSKQICGVVEHGYFENKDYNIKVEVFKE

SEQ ID NO: 803 - protein, 201 aa, Encephalitozoon cuniculi
MDRGFPKCIANKTVIGIGTGTTVERYIDALHHDATYVPSSIRTALILSEKGFTVSSPLAHGVLDLYIDGADYFDKNGNMIKGGGGALTTEKLLYSMAKETIIIVQSHKYRETFDGCFIPVEAIPTSLLKLISTLEGSGLKYCLRETDGKMGPLITDLGNCIVDVEYDDVFISSCKSICGVVEHGLFESVGNTTIVEEDGNN

SEQ ID NO: 804 - protein, 227 aa, Clostridium acetobutylicum
MAKDNLKKISAKKALEYIKDNTVIGLGGGETIGYLCDYLKEKIKSGFNIKVVTPSIKTRNTCIENGIEVLYTSSVEHLDVAFDGCDQLDEKLNALKSCGGIHSKEKIIASMADKYILLTNESKFVKKLDSTYPIVLEILEESAGYVKRRISEIGGKATFRSSAAKDGFTITDSGNLLLDVFFDELGDAKELQKGLKGITGVVETSLFVDLVSQAIIAYEDDIKIISK

SEQ ID NO: 805 - protein, 226 aa, Clostridium beijerinckii
MSDNDLKKNSAKEAMKYIKDGMIVGLGGGRSIAYLIEFIKQDKNINVKIVTPSVKTKMLCIEKGLEVLYTSSVDKVDVAFDGCDQVDEKLNALKSGGGIHTKEKLIASMAEEYILLVDEAKVEKELTFNVPVVLEVLEDSLKYVEKKVLELNGKPVIRSSDIKDGFTISDNGNLLVDVFFNNVKDIHKLNDNLIRICGVIETSLFTNVITKVIIASKEGIREISQK

SEQ ID NO: 806 - protein, 226 aa, Clostridium butyricum
MIFMKKKCAMEALKYIKDKSIIGLGGGSTISYLVSYIKETGLDVEIVTPSSVTERQCIENGLKVVPAWAVDSISVAFDGCDEIDNNLTALKSGGGIHTKEKIIASMAEDYILLVDESKVVEKLDFKYPVVLEIIPESIKIVEKTVKKLGGNTVMRSSSSKDGFTRSDHGLFLMDVNFNSEDVDDISVLNDKLKKIVGVVDTSLFYNIATKAIVAGENGVRIMECER

SEQ ID NO: 807 - protein, 221 aa, Clostridium spiroforme
MNNLKEKCALEALKYIKDQSIVGLGGGSTIAYLVEFLAKKNLDIKIVTPSYQTAMLCLKHQLCVVPTWSVDHVDIAFDGCDEVDLKLNALKSGGAIHTKEKIIASMADDYVLLVDESKVFEKLPFDHAITIEIIPESIKYVQKRLEKLGAIVSMRQSKAKDGYTISDHGMFIMEAKFKNVEDIQELDNNLKKITGIVDTSLFVGKVNFVLSIDDDGYIRKF

SEQ ID NO: 808 - protein, 226 aa, Eubacterium biforme
MIMKKKCALYASKLVKDGMVVGLGGGSTISYLIDYVKDKDIKVVSPSSKTVLLAQKMGLTVLNTQYVDHVDIAFDGCDEVDSHLNALKSGGGIHTQEKIIASMAGEYIVLVDESKFHETLAFKVPVVVEVLPKAYSIVKKKIEKLNGNIELRTASNKDGFLMSDEGNILLDVYFDGVQDIRLLNQTLLMMPGVVDTSLFVDILTGMILVNDKGVFKKERNGEFYAL

SEQ ID NO: 809 - protein, 230 aa, Bacillus coahuilensis m4-4
MMDKKQQCAKKAMDYIKDGMVIGLGGGSTIKHLIGYIARSDKEVKIITPSFETRQHCIEAGLRVLSTSDVGEVSVAFDGCDQVDEQFHSLKSGGGIHTEEKLIASMANDYILLVDDSKYVPTLTYDHPVVLEVLPQALAFVKRQLESFSTLGGALRMSKDRDGAVLTENGNYLIDVRFPPQENSRGLEQSLKGLPGVVEVSLFTAVVSKVLVATDNGVREVASRRDRGIV

SEQ ID NO: 810 - protein, 220 aa, Catenibacterium mitsuokai DSM 15897
MKKRSAKAALELIEDGMIVGLGGGETIGYLVEYLSHSHKDVKVVTPSFATEQVCIQSGLELLPLWSVNHVDLSFDGCDEVDQDMNALKSGGAIQTREKLIASMSDRYILLLDESKYFVTLPFLHDITCEVLKEAYSYVSRKIKEMGGKLILRPNKSKAGPVISDDGHFIVDVHFDTIENIKELNNKLNNIEGLIATSLFVGLVTDLIISNKEETYRIGGK

SEQ ID NO: 811 - protein, 233 aa, Eubacterium hallii
MTEKGDRIMNMKQLCAKEALKYIKDGMCIGLGGGSTIGYLAEYLAKEERKITVVTPSDDTAELCKNLGLMVLSLEMTAHINIAFDGCDELDKELNALKANGAIHTKEKIIASMAEKYVLLIDESKFYDTLPLKDSVTLEVIPQSRNYVQAQIEKLGGKAVMRKSGAKAGFVISDNGNYIMDTDFSNVAAFAGKPEELHQKLKQLTGVVETALFIDVVAFALCVCGDEVKVIEK

SEQ ID NO: 812 - protein, 205 aa, Clostridium sp. SS2/1
MKRLCAKAALDLVPDHGIIGLGGGETISYLAEDIKEARKAVKVVTPSDHTAQVCKKLGLEIVDTKEVKEIEIAFDGCDQVDSDLDAYKSGGGIHTLEKIIAKMAKEYVLLVDETKVTDKLNNKVPVVLDIIPEAVNYVTSQVEAMGATVKKRDEHLLEVYYDTLPELEEIDKNLKMITGVIETSLFYQVATKALVAGEEGIRVIK

SEQ ID NO: 813 - protein, 235 aa, Chitinophaga pinensis DSM 2588
MTDYKLEAAKAAALMISAGQTIGLGGGKTIAYLVEQLAAQPALQASLTVTSSSFDTTALLHEKGFKLVAPAFVGRLDIYFDGCDVFDANLNALKSGGGIHVMEKLLASAADKFVLLGDESKAQPKLDTKYPMVVELLPQALEIVKQAITARYPQTRFVQRMSTGKIGALISDNGNLLADVYFEAFPDLEQLDIQVKMLPGVVGHSLFFQMAQQAVIAGEEGVKYIYPAVNHQVNG

SEQ ID NO: 814 - protein, 227 aa, Pedobacter sp. BAL39
MNNYKQQAATEAFKLISKGQVIGLGAGSTIAYLVKTIAADHALASTLTFSSPSYDTVIMLNDHRLNVKPSDFLQGVDLYFDGCDQLDWQLNALKSGGGIHTYEKILAVMADEFVLLGDYGKLVEHLDVTYPLVIEVLPQALNVVSAILRKQFKGISLIIRTGDQRVGPVRTDGGCYLIDASFVTLPGLELLDQIKMIPGVVDHSLFFKLADKAILAGPEGIRTITQK

SEQ ID NO: 815 - protein, 222 aa, Lactobacillus plantarum
MTIKQAIVQQALTLIKPQMVVGFGGGSTVGELVKEAANHVNDITVVTPSPTTRQLATVLGYTVVDTAYCDRVDIAFDGCDQLDHHGNALKSGGGIHANEKIIASLADEYWLLTMQDRLVDQFDIKTPLVLEVLPAALSLVMRTVSDLGGQATIRTANNRDGFTLTDSGNLLIDCHFPTYAKLTDLNVELATLAGVVETSYFDHLVTNAWLGDATTNTVKALF

SEQ ID NO: 816 - protein, 222 aa, Lactobacillus plantarum
MTIKQAIVQQALTLIKPQMVVGFGGGSTVGELVKEAANHVNDITVVTPSPTTRQLATVLGYTVVDTAYCDRIDIAFDGCDQLDHHGNALKSGGGIHANEKIIASLADEYWLLTMQDRLVDQFDIKTPLVLEVLPAALSLVMRTVSDLGGQATIRTANNRDGFTLTDSGNLLIDCHFPTYAKLTDLNVELATLAGVVETSYFDHLVTNAWLGDATTNTVNALF

SEQ ID NO: 817 - protein, 221 aa, Lactobacillus johnsonii
MSLISQKALSKIKPNMSISLGGGSNVLNLAKDLCQAHISNLTLYSPSEITQAKCKQFGLKVLPFSENSSHLDLAFDGCDSIDKNFNALKSGGGIHLFEKLAAENTEEYILLLPAERFRDELSPTIPLCLEVVPACLENVINSIPEEYDYKIRLGKAVASFARSPLGNILIDIYPHTSWNNIKKLNSFLLKQNGVVSSSYFEGIVTSIITETKNKAVEIKKG

SEQ ID NO: 818 - protein, 221 aa, Lactobacillus johnsonii
MSLISQKALSKIKPNMSISLGGGSNVLNLAKDLCQAHISNLTLYSSSEITQAKCKQFGLKVLPFSENSPHLDLAFDGCDSIDKNFNALKSGGGIHLFEKLAAENTEEYILLLPAERFRDELSPTIPLCLEVVPACLENVINSIPEEYDYKIRLGKAVASFARSPLGNILIDIYPHTSWNNIKKLNSFLLKQNGVVSSSYFEGIVTSIITETKNKAVEIKKG

SEQ ID NO: 819 - protein, 221 aa, Lactobacillus gasseri
MSIISKKALSKIQPNMTVSLGGGSNVLTLAKDLNNAQIPGLLLYSPSEITKFQCEQLGLNILALNDNMPKFDLAFDGCDSIDQNFNALKSGGGIHLFEKIAAENAKEYILLLPKERFKETLNPTISLCIEIIPNCLNNLMKKIPQGYTAKIRLSQSVASFAHSPLGNLLIDIYPNNSWSDIEQLNDFLLKQNGVISSSYFKNLVTSIITENNNEAIEIKKG

SEQ ID NO: 820 - protein, 227 aa, Lactobacillus crispatus
MKINSISDLALSKIKPKMTISLGGGSNVFKLSQAIAQHNLDITLYSPSELTRFRCKELGLELLPSTAATKIDIAFDGCDSIDKNFNVLKSLGGIHLFEKQAAQIAKQFILLLPSQRIQPILNPKIPLCLEVAPPCVNQVQKYLSSLHLTSKIRQDSSVAAFARTPLGNYLIDVFNEDWHNITELNRQLCLQNGVVSSSLFENLTTSLITEKDGEIIELKRGNNHENI

SEQ ID NO: 821 - protein, 210 aa, Lactobacillus crispatus
MTISLGGGSNVFKLSQAIAQHNLDITLYSPSELTRFRCKELGLELLPSTAATKIDIAFDGCDSIDKNFNVLKSLGGIHLFEKQAAQIAKQFILLLPSQRIQPILNPKIPLCLEVAPPCVNQVQKYLSSLHLTSKIRQDSSVAAFARTPLGNYLIDVFNEDWHNITELNRQLCLQNGVVSSSLFENLTTSLITEKDGEIIELKRGNNHENI

SEQ ID NO: 822 - protein, 225 aa, Lactobacillus salivarius
MDNVINLAFNLLHPDTTISLGGGSNVKKLAHKLSQHPELNIKVCSPSEYTRQICRDLNLNLIDITETSTIELGFDGCDAIDFDLNVLKSNGGIHTLEKEYAYKAEKYIIISPPERLKASLNPNVQLCLEVVSPSVDSVLSTAKQLGLKAKLRLGSAVASYARTPLGNYLIDCYCESWQDIKKINSILSSLNGVVSTSYFENIVHSVLTLDKNNNPIEIKKGDLHA

SEQ ID NO: 823 - protein, 225 aa, Lactobacillus salivarius
MDNVIDLAFNLLHPDTTISLGGGSNVKKLAHKLSQHPELNIKVCSPSEYTRQICRDLNLNLIDITEASTIEFGFDGCDAIDFDLNVLKSNGGIHTLEKEYAYKAEKYIIISPPERLKASLNPNVQLCLEVVFPSVDSVLFAAKQLGLKAELRLGSAVASYARTPLGNYLIDCYCESWQDIKKINSKLSSLNGVVSTSYFENIVHSVLTLDKNNNPIEIKKGDLHA

SEQ ID NO: 824 - protein, 223 aa, Lactobacillus casei
MTEQIAAALALIQPHQVVSLGGGRHMQALADGIVARALPGIQICSPSEVTLAYCQTLGLPTTTQIASDIAFDGCDSADKDLNLLKSNGGIHFYEKLHAQASHAYVILTAQKNVNAQLNAAVPLTLEVVSAASEQVRASAKLLGLQAKRRMATTYMGYTRTRDGNELIDCTMAEWTDIAKVDHLLASLPGVVATSYFAHLATLLLIETPDGQVHEIKQSVNQPG

SEQ ID NO: 825 - protein, 223 aa, Lactobacillus casei
MTDQIAAALALIQPHQVVSLGGGRHMQTLADGIVARALPGIQICSPSEVTLAYCQTLGLPTTTQIASDIAFDGCDSADKDLNLLKSNGGIHFYEKLHAQASHAYVILTAQKNVNAQLNAAVPLTLEVVSAASEQVMASAKLLGLQAKRRMATTYMGYTRTRDGNELIDCTMAEWTDIAKVDHLLASLPGVVATSYFAHLATLLLIETPDGQVHEIKQSVNQPG

SEQ ID NO: 826 - protein, 223 aa, Lactobacillus paracasei
MTDQIAAALALIQPYQVVSLGGGRHMQTLADGIVARALPGIQICSPSEVTLAYCQTLGLPTTTQIVSDIAFDGCDSADKDLNLLKSNGGIHFYEKLHAQASHAYVILTAQKNVNAQLNAAVPLTLEVVSAASEQVMASAKLLGLQAKRRMATTYMGYTRTRDGNELIDCTMAEWTDIAKVDHLLASLPGVVATSYFAHLATLLLIETPDGQAHEIKQCVNRPG

SEQ ID NO: 827 - protein, 238 aa, Lactobacillus paracasei
MKYNFIKNKREEATFMTEQIAAALALIQPHQVVSLGGGRHMQALADGIVARALPGIQICSPSEVTLAYCQILGLPTTTQIASDIAFDGCDSADKDLNLLKSNGGIHFYEKLHAQASHAYVILTAQKNVNAQLNAAVPLTLEVVSAASEQVMASAKLLGLQAKRRVATTYMGYTRTRDGNELIDCKMAEWTDIAKVDHLLASLPGVVATSYFAHLATLLLIETPDGQVHEIKQSVNQPG

SEQ ID NO: 828 - protein, 215 aa, Lactobacillus ruminis
MLQEAMKMIKPEMTVSFGGGSTVARLAKYLCDEDETLRKTLKVTTPSLETMEVLNKLNYQIVALDDVEKIDVAFDGCDYVTQNLNAQKCMGGIHVDEKKAAKKALRYVLLTKPERIGKTYNAKLPICAEVEQDEADLFLKMADQAGFEAKNRPGIKTSRGNLLFDLYNEKCTQADAEDVETWPGVVGTSSFFDLCTDVIYEEKGKTIHLRKEELK

SEQ ID NO: 829 - protein, 234 aa, Lactococcus lactis
MTKENIANLAINLIKDGQTIGLGGGRNVSLIVKSLEKSSLKHIRIVTVSNETKTLCEQMGLNLVEFEEVDQIDWTFDGCDWINRKFQALKTRGGIQTEEKMLAQVSKHYVLLVTKDKLYDPKKTELPICCEILPNSIKVIRKKLLNYNADFNLRISNNMPIKTRHGNYLIDVQWKNSDIPEYISTVLDSLAGIVSHSFFLNEITEVLYNDDNVKHIHKNREREEEEWENIIGEL

SEQ ID NO: 830 - protein, 230 aa, Methylobacillus flagellatus KT
MNDKQLVAIQAAQHVQDGMVVGLGTGSTANYFIEELARRHRDEGLHITAAASSVASTIQAQTHGLPLVALEHLGRLDLYVDGADEVTTNLALLKGRGYDLVREKLLARASERFIVLVDKSKLVGHLGEKFPIPLEVIPFAWQLVQASLQQLGIASSLRQNAAKDGWAITSHGSLVLELTLPKTFKSDELNRLLNDIPGIVEHGVFDELADAVFVADNGQVEEIWKRPGNI

SEQ ID NO: 831 - protein, 223 aa, Methylotenera mobilis JLW8
MNDKQLVALRAAQYVQNGMLVGLGTGSTANYFIEELARLTREQGLRCTTIASSAISAHKAQSLQLPIVALEHVASIDLYVDGADEITPDKTLLKGRGSDLVKEKLLAKAATQFIAVADASKLVSHIGQNFTIPIEVIPFAWQLAKKNLEALGGVGELRPNAAKDGFWITSHGSYVLDMKFDANIDANTLNAMLNNTPGVVEHGIFYQLADTILIAQDGVVSER

SEQ ID NO: 832 - protein, 225 aa, Methylovorus sp. SIP3-4
MNDKQLVAEHAASLVEDSMIVGLGTGSTANYFIEALSRRQRDEGLRITTVASSTISAIKAAEHGLPLLDISQLGHLDLYVDGADEITPGLTLLKGRGQDLVMEKLLARAAERFVVVADKSKQVSRIGEKFVIPVEVMPAAWKIVRHALEKANGEAELRLNASKDNVAVTAHGSYVLDVRFPDWLDDAELDILLNNTPGVVEHGVFRGLASLVLIADQGQVDVVHA

SEQ ID NO: 833 - protein, 230 aa, Methylophaga thiooxidans DMS010
MTAQNIMNPKQRVAVHAANLVEADMIVGLGTGSTANLFIEALAKRNRNEHLKVTTVSSSAISAVKAKEAGLPVVSIDSLDYLDMYVDGADEVTPDLTLLKGRGQDLVREKLLASAADQFYVLVDESKLVEHIGQNFPVPVEVLPEAWKLVLAQLKQHGGVGELRMNAAGDNVAFTAHGSLVLDMSFEHIDSLELTMLLDTIAGVVEHGIFSDLASAVFIGGEQEVEEHWR

SEQ ID NO: 834 - protein, 224 aa, Methylophilales bacterium HTCC2181
MNDKELVADAALDYVKNNSIVGLGTGSTADIFINALAKKISAESLNIKVVASSTSTHEKANAAGLNYISIDQITELDLYIDGADEITENLDILKGRGYDLVREKILARASKSFIVIGDQSKIVSKIGEKYSIPIEITPIAWKITKILVEKLAIKCEVRENLTKNAFAITSYGNYVLDCEFNETNLKKLGDEIASIPGVFEHGLFIDMCGLALIASNGQITKITT

SEQ ID NO: 835 - protein, 223 aa, beta proteobacterium KB13
MEDKEIIAIKALDYVTDNSMIGLGTGSTANFFIKHLANKIKNERLNIQVVASSTVSEIEAQRNKLNLIGIDTLETLDLYVDGADEITNDLNVLKGRGYDLVKEKILAQSAKKFIIIADHSKRVNRIGENYPIPIEVLKSTWRLSKKILDKFGQGSLRKNAAGDAYAISSAGNYIFDYSFDEMPLRDLHEKILSSPGVIETGIFYAITDCALIVDNGHIEILSK

SEQ ID NO: 836 - protein, 235 aa, Vibrio sp. MED222
MAQRFIENQSQDCLRTKAAKVALEQVLKTLTPSSVIGIGTGATVEVFIQLLKESGAEFAHCVSSSVRSSRALSSAGLNEISISECGRVDFYIDGIDEGLTTGMTVKGGGAALAREKVLATLALSFITIADSGRLVTQLGKFPLPVEVLPAAQTAVFNALQSLGGHPTLRQDCTTDNGNIILDVAHLDIAEPKRLELQINAIPGVVENGIFAQRTADFMAFSNAEGTYLLSKQHVQ

SEQ ID NO: 837 - protein, 269 aa, Vibrio splendidus
MVNQHQQNNSSKCLDLRLKISLKNPYRFWRSNMSMAQRFIENQSQDCLRTKAAKVALEQVLKTLTPSSVIGIGTGATVEVFIQLLKESGAEFAHCVSSSVRSSRALSSAGLNEISISECGRVDFYIDGIDEGLTTGMTVKGGGAALAREKVLATLALSFITIADSGRLVTQLGKFPLPVEVLPAAQTAVFNALQSLGGHPTLRQDCTTDNGNIILDVAHLDIAEPKRLELQINAIPGVVENGIFAQRTADFMAFSNAEGTYLLSKQHVQ

SEQ ID NO: 838 - protein, 234 aa, Vibrio orientalis
MSMAKRFIEMDSSDCLRTKAAKAALDQVLRVLTPSSVIGIGTGATVEIFIQLLKQSGAEFSHCVSSSERSSKALQQAGLSEQPISSCERVDVYVDGIDEGLSSGETVKGGGAALAREKVLATMAMSFITIADSGRLKLALGTFPLPIEVLPAAELAVTHALQSLGGTPVRREGCTTDNGNIILDCSGLDLSEPQALEVSLNSIPGVVENGIFARRKADYMAFSDDGGVHWLARN

SEQ ID NO: 839 - protein, 234 aa, Vibrio shilonii AK1
MNMISYPMDTPASTCLRAKAAQVALEHVMKALTPSSVIGIGTGATVEVFIQLLKHSGATFSHCVSSSKRSSAALAAAGINELPIDQCDRVDFYVDGIDEGLSNGTTVKGGGAALAREKVLATLAMSFITIADSGRLKESLGEFPLPIEVLPAAELAVLRALQSLGGNPIRRKNCVTDNGNLIIDCAGLDLSDSTATELSLNSIPGVVENGIFSRRKADFMAFSGESGVEWFCRN

SEQ ID NO: 840 - protein, 211 aa, Cardiobacterium hominis
MLAAKAALHYIEDGITLGVGSGSTVNCFIEALGAAKMQFADIVTASDESTRRLEALGYRVSDLNSVGRIDVYVDGCDEINPHKAMIKGGGAALTREKIVAACSAKFVCIVDESKQVPVLGRFPLPVEVIPMARSFVARELVKLGGEPRWRENVVTDNGNWILDVYHLEIAEPYKLEEAINNIPGVVTNGIFARQAADVVITAYQSGRIGTR

SEQ ID NO: 841 - protein, 218 aa, Dichelobacter nodosus
MNQQLLKEKVAAAVLEHVPENITLGVGSGSTVLCFIEALKQAKRQFRDIVAASETSSKALEAAGFRVRDLNACDPPDIYVDGADEINDDKIMIKGGGAALTREKIIASAAKEFICIIDESKKVAQLGRFPVAVEVIPMARSYVAREIVKLGAEPRWRQGVVTDNGHWILDVHYLDLTAAERMEARINTIAGVVECGIFAQRRADKVLMSQSDGEIVLW

SEQ ID NO: 842 - protein, 219 aa, Psychrobacter sp. PRwf-1
MSQQLKLKQEVAKAALAYIDDGMILGVGTGSTVNCLIELLPQVNLKGAVASSQVTQDKLEALGIEVMDLNYVGELDLYIDGADEVNPNLQLIKGGGGALTREKIVAAASKQFICLVDESKWVTQLGREFPVPIEVLPQARSYVARQLVKMGGEPVYREDFITDYGNVILDTYNLDITSASEFEARLNNIVGVVCNGIFAANQADKLLIAKSTGVETLQR

SEQ ID NO: 843 - protein, 219 aa, Psychrobacter arcticus 273-4
MSDQQAQKQAAAKAALRYIEDDMILGVGTGSTVNCLIELLPTLKLAGAVASSQVTEDRLRALGIEIVDLNFAGQLDVYIDGADEVNAHLQLIKGGGGALTREKIVAAASNKFVCMVDESKSVEILGRAFPVPIEVLPQARSYVARQLARMGGEPVYREDFVTDYGNVILDTYDLDVSNPLALEQQLNNIVGVVCNGIFAANQADVLLKASSNGVEILNR

SEQ ID NO: 844 - protein, 219 aa, Psychrobacter cryohalolentis K5
MSDQQAQKQAAARAALRYIEDDMILGVGTGSTVNCLIELLPTVKLAGAVASSQVTEDRLRALGIEIVDLNFAGQLDVYIDGADEVNAHLQLIKGGGGALTREKIVAAASNKFVCMVDASKSVEILGREFPVPIEVLPQARSYVARELAKMGGEPVYREDFVTDYGNVILDTYDLDVSNPIALEQQLNNIVGVVCNGIFAANQADVLLKASSNGVEVLTR

SEQ ID NO: 845 - protein, 229 aa, Enhydrobacter aerosaccus SK60
MSTMNASTQQQQKQAVAADALKYIESGMILGVGTGSTVNCLIELLPKVNLKGAVASSKVTEDKLKALGIEVMDLNFTGELDLYIDGADEVNEHLQLVKGGGGALTREKIVAAASKQFICMVDESKWVQQLGVGFPLPIEVLPQARSYVARELVQLGGEPVYREGFVTDYGNLILDVYGLDIGLDIEKVAAFEAKLNNIVGVVCNGLFSARRADILLMATADGVKKLTAK

SEQ ID NO: 846 - protein, 223 aa, Acinetobacter sp. ATCC 27244
MSLYATQDEKKQAAAKAALKHLPKGGILGVGTGSTVNFLIDLLPELQLEAAVASSNATAERLKELGIEVVDMNSVGGLDAYVDGADEIDRHMHMIKGGGAALTREKIVASIAKKFICIVDDSKWVEQLGRDFPLPVEVIPMARSAVARKIVALGGDPVYREGVVTDNGNVILDVYNLNILNPIELEKTLNNIPGVVTNGIFALNAATIAIVATNNGIEERVAQ

SEQ ID NO: 847 - protein, 223 aa, Acinetobacter junii
MSLYATQDEKKQAAAKAALKHLPKGGILGVGTGSTVNFLIDLLPELQLEAAVASSNATAERLKKLGIEVVDMNSVGGLDAYVDGADEIDRHMHMIKGGGAALTREKIVASIAKKFVCIVDDSKWVEQLGRDFPLPVEVIPMARSAVARKIVALGGDPVYREGVVTDNGNVILDVYNLNILNAIELEKALNNIPGVVTNGIFALNAASIAIVATNNGIEERTAQ

SEQ ID NO: 848 - protein, 223 aa, Acinetobacter sp. ADP1
MSLYATQDEKKQAAAKAALKHLPKGGILGVGTGSTVNFLIELLPELQLEAAVASSEATAKRLKELGIEVVDMNHVGGLDAYVDGADEIDRHMHMIKGGGAALTREKIVASIAKKFVCIVDDSKWVEQLGRDFPLPVEVIPMARSAVARKLVSLGGDPVYREGVVTDNGNVILDVYNLNILNALELEKTINDIPGVVTNGIFALNAASIAIVATNNGIEERTAV

SEQ ID NO: 849 - protein, 223 aa, Acinetobacter radioresistens
MSLYTTQDEKKQAAAKAALKHLPRGGILGVGTGSTVNFLIELLPELQLEAAVASSNATAERLKKLGIEVVDMNHVGGLDAYVDGADEIDRHMHMIKGGGAALTREKIVASIAKKFVCIVDDSKWVEQLGRDFPLPVEVIPMARSAVARKLVSLGGDPVYREGVITDNGNVILDVYNLNILNALELEKTINNIPGVVTNGIFAINKADIAIVATNNGIEERTAI

SEQ ID NO: 850 - protein, 223 aa, Acinetobacter sp. RUH2624
MSLYATQDEKKQAAAKAALKHLPKGGILGVGTGSTVNFLIDLLPELQLEAAVASSQATADRLKKLGIEVVDMNHVGSLDAYVDGADEIDRHMHMIKGGGAALTREKIVASIAKKFVCIVDDSKWVDQLGRDFPLPVEVIPMARSAVARKLVSLGGDPVYREGVVTDNGNVILDVFNLNILNAIDLEKTINNIPGVVTNGIFALNPATIAIVATNNGIEERTAQ

SEQ ID NO: 851 - protein, 223 aa, Acinetobacter calcoaceticus
MSLYATQDEKKQAAAKAALKHLPKGGILGVGTGSTVNFLIDLLPELQLEAAVASSQATADRLKKLGIEVVDMNHVGGLDAYVDGADEIDRHMHMIKGGGAALTREKIVASIAKKFVCIVDDSKWVDQLGRDFPLPVEVIPMARSAVARKLVALGGDPVYREGVVTDNGNVILDVFNLNILNAIDVEKTINNIPGVVTNGIFALNPATIAIVATNNGIEERTAQ

SEQ ID NO: 852 - protein, 223 aa, Acinetobacter baumannii
MSLYATQDEKKQAAAKAALKHLPKGGILGVGTGSTVNFLIDLLPELQLEAAVASSQATADRLKKLGIEVVDMNHVGSLDAYVDGADEIDRHMHMIKGGGAALTREKIVASIAKKFVCIVDDSKWVDQLGRDFPLPVEVIPMARSAVARKLVSLGGDPVYREGVVTDNGNVILDVFNLNILNAIDLEKTINNIPGVVTNGIFALNPATIAIVATNDGIEERTAQ

SEQ ID NO: 853 - protein, 223 aa, Acinetobacter baumannii
MSLYATQDEKKQAAAKAALKHLPKGGILGVGTGSTVNFLIDLLPELQLEAAVASSQATADRLKKLGIEVVDMNHVGSLDAYVDGADEIDRHMHMIKGGGAALTREKIVASIAKKFVCIVDDSKWVDQLGRDFPLPVEVIPMARSAVARKLVSLGGDPVYREGVVTDNGNIILDVFNLNILNAIDLEKTINNIPGVVTNGIFALNPATIAIVATNDGIEERTAQ

SEQ ID NO: 854 - protein, 223 aa, Acinetobacter baumannii
MSLYATQDEKKQAAAKAALKHLPKGGILGVGTGSTVNFLIDLLPELQLEAAVASSQATADRLKKLGIEVVDMNHVGNLDAYVDGADEIDRHMHMIKGGGAALTREKIVASIAKKFVCIVDDSKWVDQLGRDFPLPVEVIPMARSAVARKLVSLGGDPVYREGVVTDNGNVILDVFNLNILNAIDLEKTINNIPGVVTNGIFALNPATIAIVATNDGIEERTAQ

SEQ ID NO: 855 - protein, 223 aa, Acinetobacter baumannii
MSLYATQDEKKQAAAKAALKHLPKGGILGVGTGSTVNFLIDLLPELQLEAAVASSQATADRLKKLGIEVVDMNHVVSLDAYVDGADEIDRHMHMIKGGGAALTREKIVASIAKKFVCIVDDSKWVDQLGRDFPLPVEVIPMARSAVARKLVSLGGDPVYREGVVTDNGNVILDVFNLNILNAIDLEKTINNIPGVVTNGIFALNPATIAIVATNDGIEERTAQ

SEQ ID NO: 856 - protein, 223 aa, Acinetobacter lwoffii
MSLYATQDEKKQAAAKAALKHLPKGGILGVGTGSTVNFLIDLLPELQLEAAVASSEATAQRLKKLGIEVVDMNSVSGLDAYVDGADEIDRHMHMIKGGGAALTREKIVASIAKKFVCIVDDSKWVGQLGREFPLPVEVIPMARSAVARKIVSLGGDPAYREGVVTDNGNVILDVYNLNILNALELEKTLNDIPGVVCNGIFAINKADIAIVATDNGIEERTAV

SEQ ID NO: 857 - protein, 223 aa, Acinetobacter johnsonii
MSLYATQDEKKQAAAKAALKHLPKGGILGVGTGSTVNFLIELLPELQLEAAVASSEATAERLKKLGIEVVDMNSVGGLDAYVDGADEIDRHMHMIKGGGAALTREKIVASIARKFVCIVDDSKWVDQLGRDFPLPIEVIPMARSAVARKIVALGGDPAYREGVVTDNGNVILDVYNLNILNALELEKTINDIPGVVCNGIFAINKADVAVVATDSGIEERTAV

SEQ ID NO: 858 - protein, 224 aa, Francisella philomiragia
MFFNKKNNQDELKRAAAIEAAKHIKSEIVLGVGTGSTVAFLIEELVNYKDKIKSVVSSSEDSTKKLKALGFDVVDLNYAGEIDLYIDGADECNNHKELIKGGGAALTREKICVAAAKKFICIIDESKKVNTLGEFPLPVEVIPMARSYVAREIVKLGGQPVYREQTITDNGNVILDVYNLKIDNPLKLETELNQITGVVTNGIFALKPADTVIMARKDGSIKNF

SEQ ID NO: 859 - protein, 224 aa, Francisella philomiragia
MFFNKKNNQDELKKAAAIEAAKHIKSEIVLGVGTGSTVAFLIEELVNYKDKIKSVVSSSEDSTKKLKALGFDVVDLNYAGEIDLYIDGADECNNHKELIKGGGAALTREKICVAAAKKFICIIDESKKVNTLGEFPLPVEVIPMARSYVAREIVKLGGQPVYREKTITDNGNIILDVYNLKIDNPLKLETELNQITGVITNGIFALKPADTVIMAKKDGSIESF

SEQ ID NO: 860 - protein, 224 aa, Francisella tularensis
MFFNKKNNQDELKKLAATEAAKSITTEITLGVGTGSTVGFLIEELVNYRDKIKTVVSSSEDSTRKLKALGFDVVDLNYAGEIDLYIDGADECNNHKELIKGGGAALTREKICVAAAKKFICIIDESKKVNTLGNFPLPIEVIPMARSYIARQIVKLGGQPVYREQTITDNGNVILDVYNLKIDNPLKLETELNQITGVVTNGIFALKPADTVIMATKDSNIVVL

SEQ ID NO: 861 - protein, 224 aa, Francisella tularensis
MFFNKKNNQDELKKLAATEAAKSITTEITLGVGTGSTVGFLIEELVNYRDKIKTVVSSSEDSTRKLKALGFDVVDLNYAGEIDLYIDGADECNNHKELIKGGGAALTREKICVAAAKKFICIIDESKKVNTLGNFPLPIEVIPMARSYVARQIVKLGGQPVYREQTITDNGNVILDVYNLKIDNPLKLETELNQITGVVTNGIFALKPADTVIMATKDSNIVVL

SEQ ID NO: 862 - protein, 241 aa, Francisella tularensis
MSKEVFLVTYLVRESFKMFFNKKNNQDELKKLAATEAAKSITTEITLGVGTGSTVGFLIEELVNYRDKIKTVVSSSEDSTRKLKALGFDVVDLNYAGEIDLYIDGADECNNHKELIKGGGAALTREKICVAAAKKFICIIDESKKVNTLGNFPLPIEVIPMARSYIARQIVKLGGQPVYREQTITDNGNVILDVYNLKIDNPLKLETELNQITGVVTNGIFALKPADTVIMATKDSNIVVL

SEQ ID NO: 863 - protein, 224 aa, Francisella tularensis
MFFNKKNNQDELKKLAATEAAKSITTEITLGVGTGSTVGFLIEELVNYRDKIKTVVSSSEDSTRKLKALGFDVVDLNYAGEIDLYIDGADECNNHKELIKGGGAALTREKICVAAAKKFICIIDESKKVNTLGNFPLPIEVIPMARSYVARQIVKLGGQPVYREQTITDNGNVILDVYNLKIDNPLKLETELNQITGVVTNGIFALKPADTVIMAKKDGKIERF

SEQ ID NO: 864 - protein, 216 aa, Legionella pneumophila
MSELKIKAAKAAIAYIEDDMVIGVGTGSTVNFFIKELAAIKHKIEACVASSKATEALLRAEGIPVIDLNSVQDLPIYVDGADEVNERGEMIKGGGGALTREKIVANVATQFICIVDESKVVKRLGEFPVAVEVIPMARSFVARQIVKLGGDPEYREGFVTDNGNIILDVFNLNFSTPMALEDSLNVIPGVVENGVFAKRLADKVLVASASGVNNLK

SEQ ID NO: 865 - protein, 216 aa, Legionella pneumophila
MSELKIKAAKAAIAYIEDDMVIGVGTGSTVNFFIKELAAIKHKIEACVASSKATEALLRAEGIPVIDLNSVQDLPIYVDGADEVNERGEMIKGGGGALTREKIVANVATQFICIVDESKVVKRLGEFPVAVEVVPMARSFVARQIVKLGGDPEYREGFVTDNGNIILDVFNLNFSTPMALEDSLNVIPGVVENGVFAKRLADKVLVASASGVNNLK

SEQ ID NO: 866 - protein, 216 aa, Legionella pneumophila
MSELKIKAAKAAIAYIEDDMVIGVGTGSTVNFFIKELAAIKHKIEACVASSKATEALLRAEGIPVIDLNSVQDLPIYVDGADEVNERGEMIKGGGGALTREKIVANVATQFICIVDESKVVKRLGEFPVAVEVIPMARSFVARQIVKLGGDPEYREGFITDNGNIILDVFNLNFSTPMALEDSLNVIPGVVENGVFAKRLADKVLVASASGVNNLK

SEQ ID NO: 867 - protein, 216 aa, Legionella pneumophila
MSELKIKAAKAAIAYIEDDMVIGVGTGSTVNFFIKELAAIKHKIEACVASSKATEALLRAEGIPVIDLNSVQDLPIYVDGADEVNERGEMIKGGGGALTREKIVANVATQFICIVDESKVVKRLGEFPVAVEVIPMARSFVARQIVKLGGDPEYREGFVTDNGNIILDVFNLSFSTPMALEDSLNVIPGVVENGVFAKRLADKVLVASASGVNNLK

SEQ ID NO: 868 - protein, 216 aa, Legionella longbeachae
MSDLKIKAAKAALDFIEDDTIVGVGTGSTVNYFIKELATIKHKIDACVASSKATEALLRQEGIPVIDLNSVQDLPVYIDGADEVTEHGEMIKGGGGALTGEKIVAQLAQKFICIADDSKQVRHLGGFPVAVEVLPMARSMVARELVKLGGDPEYREGFVTDNGNIILDVFNFTINEPMDLEERINRITGVVENGIFAHRIADVILLGSQDGVKRLK

SEQ ID NO: 869 - protein, 223 aa, Neisseria sicca
MATQDELKRIAAEKAVEFVPENEYIGIGSGSTVNMFIEALGKSGKKIKGAVSTSKKSSELMAQYDIPEVSLNDVMGLAVYVDGADEVNHMLQMIKGGGGAHLNEKVVASASDKFICIADESKYVSRLGKFPLPVEVLPGARSLVSRKLLAMGGQPELRLNYTTFHGNQIIDVYDLHIDRPLTMEDEINRITGVLENGIFARNAADVLILGTEQGVKVIKPGQN

SEQ ID NO: 870 - protein, 223 aa, Neisseria mucosa
MATQDELKRIAAEKAVEFVPENEYIGIGSGSTVNMFIEALGKSGKKIKGAVSTSKKSSELMAQYDIPEVSLNDVMYLAVYIDGADEVNHMLQMIKGGGGAHLNEKVVASASDKFICIADESKYVSRLGKFPLPVEVLPGARSLVSRKLLAMGGQPELRLDCTTFHGNQIVDVYDLNIDRPLTMEDEINRITGVVENGIFARNAADLLILGTEQGAKVIKPGQN

SEQ ID NO: 871 - protein, 223 aa, Neisseria meningitidis
MTTQDELKRIAAEKAVEFVPENEYIGIGTGSTINFFIEALGKSGKKIKGAVSTSKKSSELLAQYDIPVVSLNEVSGLAVYIDGADEVNHALQMIKGGGGAHLNEKIVASASEKFVCIADESKYVSRLGKFPLPVEVVESARSLVSRKLLAMGGQPELRIGYTTFYGNQIVDVHGLNIDQPLTMEDEINKITGVLENGIFARDAADVLILGTEEGAKVIYPCQG

SEQ ID NO: 872 - protein, 223 aa, Neisseria meningitidis
MTTQDELKRIAADKAVEFVPENEYIGIGTGSTINFFIEALGKSGKKIKGAVSTSKKSSELLAQYDIPVVSLNEVSGLAVYIDGADEVNHALQMIKGGGGAHLNEKIVASASEKFVCIADESKYVSRLGKFPLPVEVVESARSLVSRKLLAMGGQPELRIGYTTFYGNQIVDVHGLNIDQPLTMEDEINKITGVLENGIFARDAADVLILGTEEGAKVIYPCQG

SEQ ID NO: 873 - protein, 223 aa, Neisseria gonorrhoeae
MTTQDELKRIAAEKAVEFVPENEYIGIGTGSTINFFIEALGKSGKKIKGAVSTSKKSGELLARYDIPVVSLNEVSGLAVYIDGADEVNHALQMIKGGGGAHLNEKIVASASEKFVCIADESKYVSRLGKFPLPVEAVESARSLVSRKLLAMGGQPELRIGYTTFYGNQIVDVHGLNIDQPLTMEDEINKITGVLENGIFARDAADVLILGTEEGAKVIYPCQG

SEQ ID NO: 874 - protein, 223 aa, Neisseria gonorrhoeae
MTTQDELKRIAAEKTVEFVPENEYIGIGTGSTINFFIEALGKSGKKIKGAVSTSKKSGELLARYDIPVVSLNEVSGLAVYIDGADEVNHALQMIKGGGGAHLNEKIVASASEKFVCIADESKYVSRLGKFPLPVEVVESARSLVSRKLLAMGGQPELRIGYTTFYGNQIVDVHGLNIDQPLTMEDEINKITGVLENGIFARDAADVLILGTEEGAKVIYPCQG

SEQ ID NO: 875 - protein, 223 aa, Neisseria meningitidis
MTTQDELKRIAAEKAVEFVPENEYIGIGTGSTINFFIEALGKSGKKIKGAVSTSKKSGELLAQYDIPVVSLNEVSGLAVYIDGADEVNHALQMIKGGGGAHLNEKIVASASEKFICIADESKYVSRLGKFPLPVEVVESARSLVSRKLLAMGGQPELRIGYTTFYGNQIVDVHGLNIDQPLTMEDEINKITGVLENGIFARDAADVLILGTEEGAKVIYPCQG

SEQ ID NO: 876 - protein, 223 aa, Neisseria meningitidis
MTTQDELKRIAAEKAVEFVPENEYIGIGTGSTINFFIEALGKSGKKIKGAVSTSKKSGELLAQYDIPVVSLNEVSGLAVYIDGADEVNHALQMIKGGGGAHLNEKIVASASEKFICIADESKYVSRLGKFPLPVEVVESARSLVSRKLLAMGGQPELRIGYTTFYGNQIVDVHGLNIDKPLTMEDEINKITGVLENGIFARDAADVLILGTEEGAKVIYPCQG

SEQ ID NO: 877 - protein, 223 aa, Neisseria lactamica
MTTQDELKRIAAEKAVEFVPENEYIGIGTGSTINFFIEALGKSGKKIKGAVSTSKKSSELLARYDIPVVSLNEVSGLAVYIDGADEVNHALQMIKGGGGAHLNEKIVASASEKFICIADESKYVSRLGKFPLPVEVVESARSLVSRKLLAMGGQPELRIGYTTFYGNQIVDVHGLNIDKPLTMEDEINKITGVLENGIFARDAADVLILGTEEGAKVIYPCQG

SEQ ID NO: 878 - protein, 223 aa, Neisseria meningitidis
MTTQDELKRIAAEKAVEFVPENEYIGIGTGSTINFFIEALGKSGKKIKGAVSTSKKSSELLAQYDIPVVSLNEVSGLAVYIDGADEVNHALQMIKGGGGAHLNEKIVASASEKFVCIADESKYVSRLGKFPLPVEVVESARSLVSRKLLAMGGQPELRIGYTTFYGNQIVDVHGLNIDKPLMMEDEINKITGVLENGIFARDAADVLILGTEEGAKVIYPCQG

SEQ ID NO: 879 - protein, 223 aa, Neisseria cinerea
MATQDELKRIAAEKAVEFVPENEYIGIGTGSTINFFIEALGKSGKKIKGAVSTSKKSSELLAQYDIPVVSLNEVSGLAVYIDGADEVNHALQMIKGGGGAHLNEKIVASASEKFICIADESKYVSRLGKFPLPVEVVESARSLVSRRLLAMGGQPELRIGYTTFYGNQIVDVHGLNIDQPLTMEDEINKITGVLENGIFARDAADVLILGTAAGAKVIYPCQG

SEQ ID NO: 880 - protein, 223 aa, Neisseria flavescens
MATQDELKRIAAEKAVEFVPENEYIGIGTGSTINFFIEALGKSGKKIKGAVSTSKKSSELLAKYEIPEVSLNEVMGLAVYVDGADEVNHALQMIKGGGGAHLNEKIVASASDKFVCIADESKYVSRLGKFPLPVEVVENARSLVSRKLLAMGGQPELRVGYTTFYGNQIVDVHGLNIDQALKMEDEINKITGVLENGIFARDAADVLVLGTAEGAKVILPCQD

SEQ ID NO: 881 - protein, 227 aa, Kingella oralis
MCKMSNFTQDQLKQLAAAKAVEFVPENEYIGIGTGSTVNFFIQALGQSGKKIKGAVTTSLKSAELMEQYGIPQIQLNEVTRLGVYIDGADEINHMMQMIKGGGAALLPEKIVATLSDQFICIADESKYVRKLGKFPLPVEVIPMARSMVARKIVKLGGQPELRIGCKTLHGNEILDVHGLDLSEPMKMEDTLNRITGVVENGLFAHRYADLLILAKKDGAEVIQAHV

SEQ ID NO: 882 - protein, 222 aa, Eikenella corrodens
MSAQDQLKRTAAQKALEFVPENAYIGIGTGSTVNFFIEELANSGIRIKGAVSTSKATSELLKQHGIPEVPLTEADELPVYIDGADEVNHSLQMIKGGGGALLAEKIVASAAEKFVCIVDESKYVSRLGKFPLPIEIIPAARSLVSRQLLKYGGSPQLRLNFTTDSGHKIIDVHNMPINEPLKLEDELNRIPGIVENGLFARHPAHVLIIGRAEGAEVIKIGS

SEQ ID NO: 883 - protein, 212 aa, unknown
  uncultured marine gamma proteobacterium EBAC31A08
MSGSKINVAKQAIEYIKNNLHPEMILGIGTGSTVNFFIEELKEHRHKFAGAVSSSDASSKLLNENGIEVFSLNDVVDIAYYIDGADEVSPENCLIKGGGGAHTREKIVASASNEFICIVDQSKMVNLLGAFPLPIEVIPESRSLVARKIISIGGIPTYRTGFITDQGNHILDISNMDISNPTEMEALINNIPGVVDNGIFAANKPKTVLVSK

SEQ ID NO: 884 - protein, 215 aa, Stenotrophomonas maltophilia
MSEAKRLAAEKAIEYVEDGMIVGVGTGSTVAYFIDALARIQHRIKGAVSSSEQSTARLKQHGIEVIELNHSGNLSLYVDGADECDANKCLIKGGGAALTREKIIAEASERFICIVDPSKQVPVLGKFPLPVEVIPMARSLIARQIRDMTGGQPTWREGVVTDNGNQILDIHNLQITDPEKLERELNQLPGVVCVGLFARRRADVVIVGGEPPVVL

SEQ ID NO: 885 - protein, 215 aa, Stenotrophomonas maltophilia
MSEAKRLAAEKAIEYVEDGMIVGVGTGSTVAYFIDALARIQHRIKGAVSSSEQSTARLKQHGIEVIELNHSGNLSLYVDGADECDANKCLIKGGGAALTREKIIAEASERFICIIDPSKQVPVLGRFPLPVEVIPMARSLVARQIRDMTGGQPTWREGVVTDNGNQILDIHNLQITDPEKLERELNQLPGVVCVGLFARRRADVVIVGGEPPVVL

SEQ ID NO: 886 - protein, 215 aa, Stenotrophomonas sp. SKA14
MSEAKRLAAEKAIEYVEDGMIVGVGTGSTVAYFIDALARIQHRIKGAVSSSEQSTARLKQHGIEVIELNHSGNLSLYVDGADECDPNKCLIKGGGAALTREKIIAEASERFICIVDPSKQVPVLGAFPLPVEVIPMARSLVARQIRDMTGGQPTWREGVVTDNGNQILDIHNLQITDPEKLERELNQLPGVVCVGLFARRRADVVIVGGEPPVVL

SEQ ID NO: 887 - protein, 241 aa, Xanthomonas oryzae
MGIRSMPAAVPLQRIPNFQSPIPSPTMSEAKRLAAEKAIDYVEDGMIVGVGTGSTVAYFIDALGHIGHRIKGAVSSSEQSTARLRQHGIEVLDLNHTGNLSLYVDGADECDPNRCLIKGGGAALTREKIIAEASERFICIVDPSKQVPVLGKFPLPVEVIPMARSLVARQILALTGGQPVWRDVVLTDNGNVVLDVHNLQITDPVALERSLNQIPGVVCVGLFARRPADVVIVGGEPPRVL

SEQ ID NO: 888 - protein, 230 aa, Xanthomonas axonopodis
MTNLDSPITNPELLPMSEAKRLAAEKAIDYVEDGMIVGVGTGSTVAYFIDALGRIGHRIKGAVSSSEQSTARLRQHGIEVLDLNHTGNLSLYVDGADECDPNRCLIKGGGAALTREKIIAEASERFICIVDPSKQVPVLGKFPLPVEVIPMARSLVARQILALTGGQPVWRDGVVTDNGNVVLDVHHLQVTDPVGLERSLNQIPGVVCVGLFARRPADVVIVGGEPPQVI

SEQ ID NO: 889 - protein, 215 aa, Xanthomonas axonopodis
MSEAKRLAAEKAIDYVEDGMIVGVGTGSTVAYFIDALGRIGHRIKGAVSSSEQSTARLRQHGIEVLDLNHTGNLSLYVDGADECDPNRCLIKGGGAALTREKIIAEASERFICIVDPSKQVPVLGKFPLPVEVIPMARSLVARQILALTGGQPVWRDGVVTDNGNVVLDVHHLQVTDPVGLERSLNQIPGVVCVGLFARRPADVVIVGGEPPQVI

SEQ ID NO: 890 - protein, 215 aa, Xanthomonas campestris
MSEAKRLAAEKAIDYVEDGMIVGVGTGSTVAYFIDALGRIGHRIKGAVSSSEQSTARLRQHGVEVLDLNHTGNLSLYVDGADECDPNRCLIKGGGAALTREKIIAEASERFICIVDPSKQVPVLGKFPLPVEVIPMARSLVARQILALTGGQPVWRDGVVTDNGNVVLDVHHLQITDPVGLERSLNQIPGVVCVGLFARRPADVVIVGGEPPQVI

SEQ ID NO: 891 - protein, 215 aa, Xanthomonas oryzae
MSEAKRLAAEKAIDYVEDGMIVGVGTGSTVAYFIDALGHIGHRIKGAVSSSEQSTARLRQHGIEVLDLNHTGNLSLYVDGADECDPNRCLIKGGGAALTREKIIAEASERFICIVDPSKQVPVLGKFPLPVEVIPMARSLVARQILALTGGQPVWRDVVLTDNGNVVLDVHNLQITDPVALERSLNQIPGVVCVGLFARRPADVVIVGGEPPRVL

SEQ ID NO: 892 - protein, 215 aa, Xanthomonas oryzae
MSEAKRLAAEKAIDYVEDGMIVGVGTGSTVAYFIDALGHIGHRIKGAVSSSEQSTARLRQHGIEVLDLNHTGNLSLYVDGADECDPNRCLIKGGGAALTREKIIAEASERFICIVDPSKQVPVLGKFPLPVEVIPMARSLVARQILALTGGQPVWRDGVVTDNGNVVLDVHNLQITDPVALERSLNQIPGVVCVGLFARRPADVVIVGGEPPRVL

SEQ ID NO: 893 - protein, 215 aa, Xanthomonas oryzae
MSEAKRLAAEKAIDYVEDGMIVGVGTGSTVAYFIDALGRIGHRIKGAVSSSEQSTARLRQHGIEVLDLNHTGNLSLYVDGADECDPNRCLIKGGGAALTREKIIAEASERFICIVDPSKQVPVLGKFPLPVEVIPMARSLVARQILALTGGQPVWRDGVVTDNGNVVLDVHNLRITDPVALERSLNQLPGVVCVGLFARRPADVVIVGGEPPRVL

SEQ ID NO: 894 - protein, 215 aa, Xanthomonas campestris
MSEAKRLAAEKAIDYVEDGMIVGVGTGSTVAYFIDALGRIGHRIKGAVSSSEQSTARLRQHGIEVLDLNHTGTLSLYVDGADECDPNRCLIKGGGAALTREKIIAEASERFICIVDPSKQVPVLGNFPLPVEVIPMARSLVARQILALTGGQPVWRDGVVTDNGNVVLDVHNLHITDPVALERNLNQIPGVVCVGLFARRPADVVIVGGETPRVL

SEQ ID NO: 895 - protein, 237 aa, Xylella fastidiosa
MNSTQPANACAPSHIPIIIDNPMSEAKRRAAEKAIEYVENDMIIGVGTGSTVAYFIDALGHTPKRIKGAVSSSEQSTAHLKQHGIEVLELNHTGTLPLYVDGADECDPYKRLIKGGGASLTREKIIAEASKQFICIIDPNKQVATLGKFPLPIEVIPMARSLVARQIMARTDGQPVWREGVITDNGNVILDVHHLCITDPVKLEQELNQIPGVVCVGLFARRCADLVIIGSEPPHIL

SEQ ID NO: 896 - protein, 245 aa, Xylella fastidiosa
MEIATVTRVNSTQPANACAPSHIPIIIDNPMSEAKRRAAEKAIEYVENDMIIGVGTGSTVAYFIDALGRTPKRIKGAVSSSEQSTAHLKQHGIEVLELNHTGTLPLYVDGADECDPYKRLIKGGGASLTREKIIAEASKQFICIIDPNKQVATLGKFPLPIEVIPMARSLVARQIMARTDGQPVWREGVITDNGNVILDVHHLCITDPVKLEQELNQIPGVVCVGLFARRCADLVIIGSEPPHIL

SEQ ID NO: 897 - protein, 245 aa, Xylella fastidiosa
METATVTRVNSTQPANACAPSHIPIIINNPMSEAKRRAAEKAIEYVENDMIIGVGTGSTVAYFIDALGRTPKRIKGAVSSSEQSTAHLKQHGIEVLELNHTGTLPLYVDGADECDPYKRLIKGGGASLTREKIIAEASKQFICIIDPNKQVATLGKLPLPIEVIPMARSLVARQIMARTDGQPVWREGVITDNGNVILDVHHLRITDPVKLEQELNQIPGVVCVGLFARRCADLVIIGSEPPHIL

SEQ ID NO: 898 - protein, 215 aa, Xylella fastidiosa
MSEAKRRAAEKAIEYVENDMIIGVGTGSTVAYFIDALGRTPKRIKGAVSSSEQSTAHLKQHGIEVLELNHTGTLPLYVDGADECDPYKRLIKGGGASLTREKIIAEASKQFICIIDPNKQVATLGKLPLPIEVIPMARSLVARQIMARTDGQPVWREGVITDNGNVILDVHHLRITDPVKLEQELNQIPGVVCVGLFARRCADLVIIGSEPPHIL

SEQ ID NO: 899 - protein, 215 aa, Xylella fastidiosa
MSEAKRRAAEKAIEYVENDMIIGVGTGSTVAYFIDALGRTPKRIKGAVSSSEQSTAHLKQHGIEVLELNHTGTLPLYVDGADECDPYKRLIKGGGASLTREKIIAEASKQFICIIDPNKQVATLGKFPLPIEVIPMARSLVARQIMARTDGQPVWREGVITDNGNVILDVHHLCITDPVKLEQELNQIPGVVCVGLFARRCADLVIIGSEPPHIL

SEQ ID NO: 900 - protein, 215 aa, Xylella fastidiosa
MSEAKRRAAEKAIEYVENDMIIGVGTGSTVAYFIDALGHTPKRIKGAVSSSEQSTAHLKQHGIEVLELNHTGTLPLYVDGADECDPYKRLIKGGGASLTREKIIAEASKQFICIIDPNKQVATLGKFPLPIEVIPMARSLVARQIMARTDGQPVWREGVITDNGNVILDVHHLCITDPVKLEQELNQIPGVVCVGLFARRCADLVIIGSEPPHIL

SEQ ID NO: 901 - protein, 215 aa, Xylella fastidiosa
MSEAKRRAAEKAIEYVENDMIIGVGTGSTVAYFIDALGHTPKRIKGAVSSSEQSTAHLKQHGIEVLELNHTGTLPLYVDGADECDPYKRLIKGGGASLTREKIIAEASKQFICIIDPNKQVATLGKFPLPIEVIPMARSLVARQIMTLTDGQPVWREGVITDNGNVILDVHHLCITDPVKLEQELNQIPGVVCVGLFARRCADLVIIGSEPPHIL

SEQ ID NO: 902 - protein, 229 aa, Acidovorax sp. JS42
MTAPTSLSQDELKTLVGQAALQYVVPGELVGVGTGSTVNKFIDALASIKDSIRGAVSSSEASTARLKALGIPVLDANDVRSLSVYIDGADEIDGNGYMVKGGGAALTREKIVAALARRFVCIADESKLVNVLGAFPLPVEVIPMAAAYIARRFESLGGQATLRLKDGQPLVTDNGQHILDVRGLTISDPLAFETEVNQWPGVVTVGVFALQKANVCLLGTAQGVRTLSL

SEQ ID NO: 903 - protein, 229 aa, Diaphorobacter sp. TPSY
MTAPTSLSQDELKTLVGQAALQYVVPGELVGVGTGSTVNKFIDALASIKDSIRGAVSSSEASTARLKALGIPVLDANDVRLLSVYIDGADEIDGNGYMVKGGGAALTREKIVAALARRFVCIADESKLVNVLGAFPLPVEVIPMAAAYIARRFESLGGQATLRLKDGQPLVTDNGQHILDVRGLTISDPLAFETEVNQWPGVVTVGVFALQKANVCLLGTAQGVRTLSL

SEQ ID NO: 904 - protein, 232 aa, Comamonas testosteroni
MTTSAAPLSQDELKTLVGQAALKYVVAGEIVGVGTGSTVNKFIDALATIKDQIPGAVSSSVASTERLKALGIKVFDANEVTSLAVYIDGADEIDGKGHMVKGGGAALTREKIVAALAQRFVCIADESKRVPVLGNFPLPVEVIPMAAAQIARRFEAMGADVTAQIRMKDGAPLVTDNGQHILDVRGLKIAEPLAFESEVNQWPGVVTVGVFAHQKAAVCLLGTAQGVQTLEY

SEQ ID NO: 905 - protein, 244 aa, Comamonas testosteroni
MEIIAGLPGFSLMTTSAAPLSQDELKTLVGQAALKYVVAGEIVGVGTGSTVNKFIDALATIKDQIPGAVSSSVASTERLKALGIKVFDANEVTSLAVYIDGADEIDGKGHMVKGGGAALTREKIVAALAQRFVCIADESKRVPVLGNFPLPVEVIPMAAAQIARRFEAMGADVTAQIRMKDGAPLVTDNGQHILDVRGLKIAEPLAFESEVNQWPGVVTVGVFAHQKAAVCLLGTAQGVQTLEY

SEQ ID NO: 906 - protein, 230 aa, Delftia acidovorans SPH-1
MTTSAASFSQDELKALVGQAALAYVVPGEIVGVGTGSTVNKFIDALATIKDQIPGAVSSSVASTERLKALGINVLDANEVASLSVYIDGADEIDGRGYMVKGGGAALTREKIVAALAERFVCIADASKRVEVLGDFPLPVEVIPMAAAQIANHFKAMGGRAEIRMKDGAPLVTDNGQHILDVRGLKIAEPLAFESEVNQWPGVVTVGVFAHQKASVCLLGTPEGVQTLNY

SEQ ID NO: 907 - protein, 255 aa, Verminephrobacter eiseniae EF01-2
MTTTPPLPRQLPRGLTQDELKTRVGQAALRYVLPGDIVGVGTGSTVNKFIDALAGMKEQIKGAVSSSVASTERLQALGIAVFDANAVPSLSVCIDGADEIDGQGHMLKGGGAALTREKIVAALAERFVCIADESKLVRTLGQFPLPVEVIPMAARHIARRFAAMGGQASLRLRNGQALVTDNGQHILDVKGLSITDPLAFESQVNQWPGVVTVGVFAHQKASVCLLGTAQGVKTLVYPGPDRPEPATRRCSASNH

SEQ ID NO: 908 - protein, 230 aa, Acidovorax delafieldii
MTTSSPLTQDELKALVGQAALQYVVPGDIVGVGTGSTVNKFIDALAGMKDQIRGAVSSSIASTERLKALGIAVFDANDVESLAVYIDGADEVDGQGYMVKGGGAALTREKIVAALARRFVCIVDESKLVPSLGRFPLPVEVIPMAAQHIGRRFAALGGEARLRLKDGEPLVTDNGQHILDVTGLSITDPLAFESEVNQWPGVVTVGVFAHQKASVCLMGTAQGVVKTFTY

SEQ ID NO: 909 - protein, 230 aa, Acidovorax avenae subsp. citrulli AAC00-1
MTTPAPLSQDELKALVGQAALKYVVPGDIVGVGTGSTVNQFIQALGSMKDRIRGAVSSSEASTQRLRALGIPVFDANEVESLSVYIDGADEIDPRGHMVKGGGAALTREKIVAALARQFVCIADVSKLVETLGRFPLPVEVIPMAAQQIARRFATRGGQAVLRRGADGQPLVTDNQQYILDVKGLSIQDPLAFESEVSQWPGVVTVGVFAHQKADVALIGAPEGVRTFTY

SEQ ID NO: 910 - protein, 230 aa, Acidovorax avenae subsp. avenae ATCC 19860
MTTPASLSQDELKALVGQAALKYVVPGDIIGVGTGSTVNQFIQALGPMKDKIRGAVSSSEASTQRLRALGIPVFDANEVESLSVYIDGADEIDPRGHMVKGGGAALTREKIVAALARQFVCIADASKLVETLGRFPLPVEVIPMAAQQITRRFAARGGQAVLRRGADGQPLVTDNQQHILDVTGLSIQDPLAFESEVNQWPGVVTVGVFAHQKAHVALIGAPEGVRTVTY

SEQ ID NO: 911 - protein, 234 aa, Rhodoferax ferrireducens T118
MTNPISQAAGALSQDELKTLVGQAALQYVAPGEIVGVGTGSTVNKFIDALASIRHLIKGAVSSSEASTLRLKALGIPVFDANEVAELSVYIDGADEIDGHGNMIKGGGAALTREKIVAALANQFVCIADESKLVQTLGRYPLPVEIIPMAAQRITQQFAALGGRAQVRLKGDQPLVTDNGQILLDVTGLQISDPLAFETLVSQWPGVVTVGVFAYQKAQVCLLGTARGVKTLTF

SEQ ID NO: 912 - protein, 249 aa, unknown
  Curvibacter putative symbiong of Hydra magnipapillata
MPAFRFQLPPLSLRTFQAFLMTTPALSQDELKTLVGQAALQYVVPGEIVGVGTGSTVNKFIDALATIKDQIKGAVSSSVASTERLQALGIQVFDSNEVDKLSVYIDGADEIDGAGNMVKGGGAALTREKIVAAQSAKFVCIADESKLVQTLGKFPLPVEVIPMATQRVIAQFAAKGGKGSIRLKDGKPLVTDNGQYIVDVTGLQITDPQAFEAEVSQWPGVVTVGVFAYQRAQVCLLGTASGVKTLAFQ

SEQ ID NO: 913 - protein, 249 aa, Polaromonas naphthalenivorans CJ2
MSSDCRKIPPRPNPIPQTSPNLARHTMTQDELKTLVGQAALNYVEAGSIVGVGTGSTVNKFIDALATIKDQIAGAVSSSNASTERLQALGIKVFDATEVDELGVYIDGADEIDHAGYMVKGGGAALTREKIVAAQSRRFICIADKSKYVATLGGFPLPVEIIPMATRRIARQFEAMGGAATVRHKDGKPLVTDNGQHILDVTGLKIADPLAFESEVSQWPGVVTVGVFAFQKAHVCLLGTDDGVETLVF

SEQ ID NO: 914 - protein, 240 aa, Polaromonas sp. JS666
MSQKPTSHPYKPNMTQDELKALVGQAALPYVEPGSIVGVGTGSTVNKFIDALATMKDRIAGAVSSSVASTERLQAIGIKVFDATEVDELAVYIDGADEIDHAGYMIKGGGAALTREKIVAAQSRKFVCIADESKLVQTLGSFPLPVEVIPMAARRIARQFAALGGTATLRSKGGAESGEPLVTDNGQHILDVTGLKITDPLGFESQVNQWPGVVTVGVFAFQKAHVCLLGASDGVRTLVF

SEQ ID NO: 915 - protein, 243 aa, Variovorax paradoxus
MTAPVSPSSADGAANGAGAITQDELKAQVGRAALAYVAKGEIVGVGTGSTVNKFIDALATIKDQIKGAVSSSVASTERLRALGIPVFDSNEVDELGVYIDGADEIDPRGFMVKGGGAALTREKIVAAQSRRFVCIADASKLVDTLGAFPLPVEVIPMAARRVMRQFEAMGGIAQVREKDGLPLVTDNGQHIVDVTGLRISDPLAFESEVSQWPGVVTVGVFAHQKADVCLLGTPAGVRTMQFD

SEQ ID NO: 916 - protein, 220 aa, Leptothrix cholodnii
MTQDELKALVGQAAVAYVPDGSVVGVGTGSTVNCFIDALAAIKDRIAGAVSSSVRSTERLQALGIPVLDLSQVERIPVYIDGADEIDPRGHMIKGGGAALTREKIVADLAERFVCIADASKRVDVMGRFPLPVEVIPMAAAQVARRFGAAYGGLARVREGVVTDNGNLILDVTGLHIADPLAMETEVNQWPGVVCVGIFARHKAAVCLLGTPEGVRTLNF

SEQ ID NO: 917 - protein, 219 aa, Methylibium petroleiphilum PM1
MNQDELKTLVGRAALEYVPEGSIVGVGTGSTVNCFIDALAGIKERIAGAVSSSVKSTERLREKGIRVFEAAAVESLPVYIDGADEIDPHGCMIKGGGAALTREKIVADLAERFVCIADASKLVDVLGRFPLPVEVLPMAVSQIQRRFAKLGATATVREGVITDNGQLILDVQGLRIGDPLAFETEVNQWPGVVTVGVFARHKASVCLLGTPEGVKTLRF

SEQ ID NO: 918 - protein, 219 aa, Ralstonia metallidurans CH34
MTQDEIKAMVARAALPHVLPGSIIGVGTGSTVNHFIDALSSLREGIAGAVSSSNATTARLRGHGIRVLEAGEVEQLALYVDGADEIDPHGHMIKGGGAALTREKIVADLAQRFLCIADASKKVEVLGRFPLPVEVIDVAATRIARRFAAIGGRAVLRKGVVTDNGHPILDVHGLAIADPPALEAEINQWPGVVTVGLFARHRAHACLLGTPEGVLTLQF

SEQ ID NO: 919 - protein, 223 aa, unknown
  uncultured bacterium
MTQDEMKTLVGLAALDHVQAGSIVGVGTGSTVDKFIDALGAALKTDPQRVVGAVSSSVRSTERLQSLGVKVLPAESVSRLAVYIDGADEINHQGDMIKGGGAALTREKIVADLAERFVCIADETKLVQTLGKFPLPVEVIPMAAAQVIRAFAAQGGQARVREGVVTDNGNLIVDVTGLSITDPARLESDVNQWPGVVTVGIFARNRASVCLLGTPNGVKTLNF

SEQ ID NO: 920 - protein, 225 aa, Oxalobacter formigenes
MAQDDLKLSVARAAVKYVPEGKIIGVGTGSTANFFIDELAKIKDRITGAVASSKATAERLAAHGIRVFNLTEVEEIPVYIDGADEITRSGAMIKGGGGALTREKIIASAAARFICIADESKLVATLGKFPLPVEVIPMAYKLVAGKLDALGGRAELRIRDGKPFVTDNGNLILDVFGLQIGHPLRLEEKINNFTGVVTVGLFAQRGADLCLLGSPDGVGTLEFGN

SEQ ID NO: 921 - protein, 225 aa, Oxalobacter formigenes
MSQDDLKLSVARAAIQYIPEGKIIGVGTGSTANFFIDELARIKNRIVGAVASSRATADRLASHGIKVFDLNDITEPLPVYIDGADEITAKGAMIKGGGGALTREKIIASASEKFICIADESKLVDILGKFPLPVEVIPMASQLIARKLAVFGGKPVLRMKEGKPFVTDNGNVILDVSGLQIKDPANLEEKINNIVGVVTVGLFARTGANLCLMGCSDGVKTLAFQ

SEQ ID NO: 922 - protein, 223 aa, Janthinobacterium sp. Marseille
MTQDEMKQAVARAAIDYVVAGEIIGVGTGSTANFFIDELGKIKDRIKGAVASSEATAERLRAHGITIFDLNDIDSMSVYIDGADEITAQGAMIKGGGAALTREKIVASVAKKFVCIADGSKLVDKLGKFPLPVEVIPMAQAVVARKLAALGGEPRLRVKDGKAVVTDNGCYIIDVLGLQIEDPATLEAQINDIVGVVTVGLFARRGADIALLGTADGVNSLSF

SEQ ID NO: 923 - protein, 223 aa, Herminiimonas arsenicoxydans
MTQDEMKQAVARAAIEYVVPGEIIGVGTGSTANFFIDELGKIKDRIKGAVASSEATAQRLKSHGIAVFDLNEIDAMSVYIDGADEITAQGAMIKGGGAALTREKIVASVAKQFVCIADGSKLVDLLGNFPLPVEVIPMAQAVVARKLAALGGEPRLRLKDGKPLVTDNGCFIIDVLGLKIQDPAELEAQINNIVGVVTVGLFARRGADIALLGTAEGVKRLTF

SEQ ID NO: 924 - protein, 228 aa, Ralstonia eutropha
MTQDELKALVAQAAADYVKQEVPEGAVLGVGTGSTANLFIDAVAAFKERFAGAVSSSEASTRRLQQHGFKVLDLNEVDEIPVYVDGADEIDASGAMIKGGGGALTREKIVASVAKRFVCIADGSKLVQTMGTFPLPVEVIPMARAAVARKLQALGGQPRLRMTKEGGIYKTDNGNVILDVAGLKIDDPRGLEQAVNQVPGVVTVGLFALRGADVLLLGTGDGVQRTDY

SEQ ID NO: 925 - protein, 228 aa, Cupriavidus taiwanensis
MTQDELKALVAQAAADYVKQEVPEGAVLGVGTGSTANLFIDAVAAFKDRFAGAVSSSEASTRRLQQHGFKVLDLNEVDEIPVYVDGADEIDASGAMVKGGGGALTREKIVASVARRFVCIADGSKLVQTMGAFPLPVEVVPMARAAVARKLQALGGQPRLRMTKEGGIYKTDNGNVILDVAGLKIDDPRGLEQTINQVPGVVTVGLFALRGADVLLLGTGDGVQRTDY

SEQ ID NO: 926 - protein, 228 aa, Ralstonia eutropha
MTQDELKALVAQAAADYVKQEVPEGAVLGVGTGSTANLFIDAVAAFKDRFAGAVSSSEASTRRLQQHGFKVLDLNEVDDIPVYVDGADEIDASGAMIKGGGGALTREKIVASVAGRFVCIADGSKLVETMGAFPLPVEVIPMARAAVARQVAALGGQPRLRMNKDGGIYKTDNGNVILDVSGLKITDPRGLEQSINQIPGVVTVGLFALRGANVLLLGTGEGVQRTDY

SEQ ID NO: 927 - protein, 228 aa, Ralstonia metallidurans CH34
MTQDELKALVAQAAADYVKQEVPEGAVLGVGTGSTANLFIDAVAAFKERFSGAVSSSEASTRRLQQHGFNVLDLNEVDSIPVYVDGADEIDNSGAMIKGGGGALTREKIVASVADRFVCIADGSKLVPTMGAFPLPVEVIPMARAAVARSLAALGGQPRLRMTKEGGIYKTDNGNVILDVSGLKIENPKALEQQINQLPGVVTVGLFALRGANVLLLGTEQGVQRSDY

SEQ ID NO: 928 - protein, 228 aa, Ralstonia pickettii
MTQDELKALVAQAAADYVLANVPEGAVLGVGTGSTANLFIDAMAPHKARFAGAVSSSEASTRRLQGHGFTVLDLNEVDAIPVYVDGADEIDASGAMIKGGGGALTREKIVASVASVFVCIADGSKLVETMGAFPLPVEVVPMARAAVARQLAALGGQPRLRMTKEGQIYKTDNGNVIIDVVGLRIADPKGLESVVNEIPGVVTVGLFAKRGANVLLLGTEAGVQRRDF

SEQ ID NO: 929 - protein, 228 aa, Ralstonia pickettii
MTQDELKALVAQAAADYVLANVPEGAVLGVGTGSTANLFIDAMAPHKARFAGAVSSSEASTRRLQGHGFTVLDLNEVDTIPVYVDGADEIDASGAMIKGGGGALTREKIVASVANVFVCIADGSKLVETMGAFPLPVEVVPMARAAVARQLAALGGQPRLRMTKEGQIYKTDNGNVILDVTGLRIADPKGLESVVNEIPGVVTVGLFAKRGANVLLLGTEAGVQRRDF

SEQ ID NO: 930 - protein, 228 aa, Ralstonia solanacearum
MTQDELKALVAQAAADYVLANVPEGAVLGVGTGSTANLFIDAMAPHKARFAGAVSSSEASTRRLQGHGFAVLDLNEVDTIPVYVDGADEIDDTGAMIKGGGGALTREKIVASVAGQFVCIADGSKLVDVLGAFPLPVEVVPMARAAVARQLAALGGQPRLRMTKEGQIYQTDNGNVILDVVGLRIGEPKTLEAQINDIPGVVTVGLFAKHGANVLLLGTETGVQRRDF

SEQ ID NO: 931 - protein, 228 aa, Ralstonia solanacearum
MTQDELKALVAQAAADYVLANVPEGAVLGVGTGSTANLFIDAMAPHKARFAGAVSSSEASTRRLQGHGFAVLDLNEVDTIPVYVDGADEIDDTGAMIKGGGGALTREKIVASVAGRFVCIADGSKLVDVLGAFPLPVEVVPMARAAVARQLAALGGQPRLRMTKEGQIYQTDNGNVILDVSGLRIGEPKTLEAQINDIPGVVTVGLFAKRGADVLLLGTEAGVQRRDF

SEQ ID NO: 932 - protein, 278 aa, Ralstonia solanacearum
MRVRGAGRRGPPGVVAKSIVLRAPGAARRGRAVAVIRYTTGFSDSDRVFAMTQDELKALVAQAAADYVLANVPEGAVLGVGTGSTANLFIDAMAPHKARFAGAVSSSEASTRRLQGHGFAVLDLNEVDTIPVYVDGADEIDDTGAMIKGGGGALTREKIVASVAGQFVCIADGSKLVDVLGAFPLPVEVVPMARAAVARQLAALGGQPRLRMTKEGQIYQTDNGNVILDVVGLRIGEPKTLEAQINDIPGVVTVGLFAKHGANVLLLGTETGVQRRDF

SEQ ID NO: 933 - protein, 270 aa, Burkholderia sp. H160
MSQGVRQTSARDATKRARTEPSPRHSGKLGVFHASPASPMTQDELKQLVGQAAADYVNANVPQGSVIGVGTGSTANCFIDALAATKSRYRGAVSSSLATTARLQSHGIKVLDLNEIDSLPVYVDGADEIDRSGAMIKGGGGALTREKIVASVSDVFVCIADASKVVETLGNFPLPIEVVPMARTAIGRRVTALGGVPVVRVTKEGVPFITDNGNEIIDVKGLKISDPRTLEAQINAWPGVVTVGLFAGRGANLCLLGTDTGVQTITYDQN

SEQ ID NO: 934 - protein, 292 aa, Burkholderia dolosa AUO158
MRAIRTRRPMRSPRRCSTSISPTRRPQTTRAERAARTRRKRAAGLPSPVNCRFFAIQQHHDSMTQDELKRLVGQAAADYVIQHVPEGTVIGVGTGSTANCFIDALAAVKSRYRGAVSSSVATTERLKSHGIKVFDLNDVESLQVYVDGADEIDASGAMIKGGGGALTREKIVASVADTFVCIADASKRVPVLGAFPLPIEVVPMARTAIGRRVTALGGVPVLRVTKDGAPYITDNGNEIIDVKGLQITDPRGFEAKVNAWPGVVTVGLFAERGANLCLLGTETGVETIIYSA

SEQ ID NO: 935 - protein, 231 aa, Burkholderia phytofirmans PsJN
MTQDELKQLVGQAAADYVNATVPEGAVIGVGTGSTANCFIDALAGNKARYRGAVSSSLATTARLQTHGIKVFDLNEIDSLPVYVDGADEIDRSGAMIKGGGGALTREKIVASVSDVFVCIADASKLVETLGTFPLPIEVVPMARTAIGRRVTALGGVPVVRVTKEGVPFITDNGNEIIDVKGLRISDPRTLETHINAWPGVVTVGLFAARGANLCLLGTDTGVETIEYSKG

SEQ ID NO: 936 - protein, 231 aa, Burkholderia xenovorans LB400
MTQDELKQLVGQAAADYVNANVPEGSVIGVGTGSTANCFIDALAAGKTRYRGAVSSSLATTARLQSHGFKVLDLNEIDSLPVYVDGADEIDHSGAMIKGGGGALTREKIVASVSDVFVCIADASKLVETLGSFPLPIEVVPMARTSIGRRVTALGGVPVVRVTKEGVPFITDNGNEIIDVKGLRISDPRTLETHVNAWPGVVTVGLFASRGADLCLLGTDTGVDTIRFSKG

SEQ ID NO: 937 - protein, 231 aa, Burkholderia sp. CCGE1002
MTQDELKQLVGQAAADYVNANVPQGSVIGVGTGSTANCFIDALAATKSRYRGAVSSSLATTARLQSHGFKVFDLNEIDSLPVYVDGADEIDRSGAMIKGGGGALTREKIVASVSEVFVCIADASKVVETLGKFPLPIEVVPMARTAIGRRVTALGGVPVVRVTKEGAPFITDNGNEIIDVKGLSISDPRTLEAHINAWPGVVTVGLFAGRGANLCLLGTDTGVQTITYGQN

SEQ ID NO: 938 - protein, 231 aa, Burkholderia sp. CCGE1001
MTQDELKQLVGQAAADYVLANVPEGSVIGVGTGSTANCFIDALAANKARYRGAVSSSLATTARLQSHGIKVLDLNEIDSLPVYVDGADEIDHSGAMIKGGGGALTREKIVASVSDVFVCIADASKLVETLGNFPLPVEVVPMARTAIGRRVTALGGVPVVRVTKEGTPFITDNGNEIIDVKGLRITDPCALETQINAWPGVVTVGLFAGRGASLCLLGTDTGVQTIEYRKD

SEQ ID NO: 939 - protein, 231 aa, Burkholderia phymatum STM815
MTQDELKQLVGQAAADYVIANVPEGTIIGVGTGSTANCFIDALAAHKARFRGAVSSSVATTARLQSHGIPVFDLNDIESLPVYVDGADEIDHGGAMIKGGGGALTREKIVASVAEKFLCIADASKVVDVLGQFPLPVEVVPMARTAIGRRVTALGGVPIVRVTKDGAPFLTDNGNEIIDVKGLRITDPRTLEAHVNAWPGVVTVGLFAARGADLCLLGTQKGVETIVYPNR

SEQ ID NO: 940 - protein, 231 aa, Burkholderia thailandensis Bt4
MTQDELKRLVGEAAARYVTDNVPQGAVIGVGTGSTANCFIDALAAVKDRYRGAVSSSVATTERLKSHGIRVFDLNEIESLQVYVDGADEIDESGAMIKGGGGALTREKIVASVAETFVCIADASKRVAMLGQFPLPVEVVPMARTAIGRRLAALGGVPVLRVKQDGTPYVTDNGNEILDVKGLRIDDPRALEAAINGWPGVVTVGLFAQRGADLCLLGTEHGVETLRYAAR

SEQ ID NO: 941 - protein, 231 aa, Burkholderia thailandensis TXDOH
MTQDELKRLVGEAAARYVTDNVPQGAVIGVGTGSTANCFIDALAAVKDRYRGAVSSSVATTERLKSHGIRVFDLNEIESLQVYVDGADEIDESGAMIKGGGGALTREKIVASVAETFVCIADASKRVAMLGQFPLPVEVVPMARTAIGRRLAALGGVPVLRVKQDGTPYVTDNGNEILDVKGLRIDDPRALEATINGWPGVVTVGLFAQRGADLCLLGTEHGVETLRYAAR

SEQ ID NO: 942 - protein, 231 aa, Burkholderia thailandensis MSMB43
MTQDELKRLVGEAAARYVTDNVPQGAVIGVGTGSTANCFIDALAAVKDRYRGAVSSSVATTERLKSHGIKVFDLNEIESLQVYVDGADEIDESGAMIKGGGGALTREKIVASVAETFVCIADASKRVAVLGQFPLPVEVVPMARTAIGRRLAALGGVPVLRVKQDGAPYVTDNGNEILDVKGLRIDDPRALEATVNGWPGVVTVGLFAQRGADLCLLGTEHGVETLRYATR

SEQ ID NO: 943 - protein, 235 aa, Burkholderia thailandensis E264
MTLLMTQDELKRLVGEAAARYVTDNVPQGAVIGVGTGSTANCFIDALAAVKDRYRGAVSSSVATTERLKSHGIRVFDLNEIESLQVYVDGADEIDESGAMIKGGGGALTREKIVASVAETFVCIADASKRVAMLGQFPLPVEVVPMARTAIGRRLAALGGVPVLRVKQDGTPYVTDNGNEILDVKGLRIDDPRALEAAINGWPGVVTVGLFAQRGADLCLLGTEHGVETLRYAAR

SEQ ID NO: 944 - protein, 235 aa, Burkholderia mallei
MTLPMTQDELKRLVGEAAARYVTENVPQGAVIGVGTGSTANCFIDALAAVKDRYRGAVSSSVATTERLKSHGIKVFDLNEIESLQVYVDGADEIDGSGAMIKGGGGALTREKIVASVAETFVCIADASKRVAVLGQFPLPVEVVPMARTAIGRRLAALGGVPVLRVKQDGAPYVTDNGNEILDVKGLRIDDPRALEAAINGWPGVVTVGLFAQRGADLCLLGTERGVETLRYAAH

SEQ ID NO: 945 - protein, 231 aa, Burkholderia pseudomallei
MTQDELKRLVGEAAARYVTENVPQGAVIGVGTGSTANCFIDALAAVKDRYRGAVSSSVATTERLKSHGIKVFDLNEIESLQVYVDGADEIDGSGAMIKGGGGALTREKIVASVAETFVCIADASKRVAVLGQFPLPVEVVPMARTAIGRRLAALGGVPVLRVKQDGAPYVTDNGNEILDVKGLRIDDPRALEAAINGWPGVVTVGLFAQRGADLCLLGTERGVETLRYAAH

SEQ ID NO: 946 - protein, 231 aa, Burkholderia pseudomallei
MTQDELKRLVGEAAARYVTENVPQGAVIGVGTGSTANCFIDALAAVKDRYRGAVSSSVATTERLKSHGIKVFDLNEIESLQVYVDGADEIDGGGAMIKGGGGALTREKIVASVAETFVCIADASKRVAVLGQFPLPVEVVPMARTAIGRRLAALGGVPVLRVKQDGAPYVTDNGNEILDVKGLRIDDPRALEAAINGWPGVVTVGLFAQRGADLCLLGTERGVETLRYAAH

SEQ ID NO: 947 - protein, 231 aa, Burkholderia pseudomallei
MTQDELKRLVGEAAARYVTENVPQGAVIGVGTGSTANCFIDALAAVKDRYRGAVSSSVATTERLKSHGIKVFDLNEIESLQVYVDGADEIDGSGAMIKGGGGALTREKIVASVAETFVCIADASKRVAVLGQFPLPVEVVPMARTAIGRRLAALGGVPVLRVKQDGAPYVTDNGNEILDVKGLRIDDPRALEAAINGWPGVVTVGLFAQRGADLCLLGTERGVETLRYAEH

SEQ ID NO: 948 - protein, 235 aa, Burkholderia oklahomensis C6786
MTLLMTQDELKRLVGEAAAQYVIDNVPERAVIGVGTGSTANCFIDALAAVKDRYRGAVSSSVATTERLKSHGIKVFDLNEIESLQVYVDGADEIDGGGAMIKGGGGALTREKIVASVAETFVCIADASKRVAVLGQFPLPVEVVPMARTAIGRRLAALGGVPVLRVKQDGTPYVTDNGNEILDVKGLRIQDPRALEATINGWPGIVTVGLFAERGADLCLLGTEHGVETLRYVKR

SEQ ID NO: 949 - protein, 231 aa, Burkholderia oklahomensis EO147
MTQDELKRLVGEAAAQYVIDNVPERAVIGVGTGSTANCFIDALAAVKDRYRGAVSSSVATTERLKSHGIKVFDLNEIESLQVYVDGADEIDGGGAMIKGGGGALTREKIVASVAETFVCIADASKRVAVLGQFPLPVEVVPMARTAIGRRLAALGGVPVLRVKQDGTPYVTDNGNEILDVKGLRIQDPRALEATINGWPGIVTVGLFAERGADLCLLGTEHGVETLRYVKR

SEQ ID NO: 950 - protein, 230 aa, Burkholderia ambifaria AMMD
MTQDELKRLVGQAAADYVIQNVPEGAVIGVGTGSTANCFIDALAAVKARYRGAVSSSLATTERLKSHGIKVFDLNEIESLQVYVDGADEIDASGAMIKGGGGALTREKIVASVADTFVCIADASKRVPVLGAFPLPIEVVPMARTAIGRRVTALGGVPVLRVTKDGAPYITDNGNEIIDVKGLQIADPRGFEAQVNAWPGVVTVGLFAERGANLCLLGTPNGVETIVYPA

SEQ ID NO: 951 - protein, 231 aa, Burkholderia cenocepacia AU 1054
MTQDELKRLVGQAAADYVIQNVPEGAVIGVGTGSTANCFIDALAAVKSRYRGAVSSSIATTERLKSHGIKVFDLNEIESLQVYVDGADEIDAGGAMIKGGGGALTREKIVASVADTFVCIADASKRVPVLGAFPLPIEVVPMARTAIGRRVTALGGVPVLRVTKDGAPYITDNGNEIIDVKGLQIADPRGFEAQVNAWPGVVTVGLFAERGANLCLLGTENGVETIVYPAG

SEQ ID NO: 952 - protein, 231 aa, Burkholderia cenocepacia J2315
MTQDELKRLVGQAAADYVIQNVPEGAVIGVGTGSTANCFIDALAAVKSRYRGAVSSSVATTERLKSHGIKVFDLNEIDALQVYVDGADEIDAGGAMIKGGGGALTREKIVASVADTFVCIADGSKRVPVLGAFPLPIEVVPMARTAIGRRVTALGGVPVLRVTKDGAPYITDNGNEIIDVKGLQIADPRGFEARVNAWPGVVTVGLFAERGANLCLLGTENGVETIVYPAA

SEQ ID NO: 953 - protein, 230 aa, Burkholderia ambifaria IOP40-10
MTQDELKRLVGQAAADYVIQNVPEGAVIGVGTGSTANCFIDALAAVKSRYRGAVSSSLATTERLKSHGIKVFDLNEVESLQVYVDGADEIDASGAMIKGGGGALTREKIVASVADTFVCIADASKRVPVLGAFPLPIEVVPMARTAIGRRVTALGGVPVLRVTQDGAPYITDNGNEIIDVKGLQIADPRGFEAQVNAWPGVVTAGLFAERGANLCLLGTANGVETIVYPG

SEQ ID NO: 954 - protein, 230 aa, Burkholderia ambifaria MEX-5
MTQDELKRLVGQAAADYVIQNVPEGAVIGVGTGSTANCFIDALAAVKSRYRGAVSSSVATTERLKSHGIKVFDLNEVESLQVYVDGADEIDASGAMIKGGGGALTREKIVASVADTFVCIADGSKRVPVLGAFPLPIEVVPMARTAIGRRVTALGGVPVLRVTNDGAPYITDNGNEIIDVKGMQIADPRGFEAQINAWPGVVTVGLFAERGANLCLLGTPNGVETIVYPG

SEQ ID NO: 955 - protein, 230 aa, Burkholderia ambifaria MC40-6
MTQDELKRLVGQAAADYVIQNVPEGAVIGVGTGSTANCFIDALAAVKSRYRGAVSSSVATTERLKSHGIKVFDLNEIESLQVYVDGADEIDASGAMIKGGGGALTREKIVASVADTFVCIADGSKRVPVLGAFPLPIEVVPMARTAIGRRVTALGGVPVLRVTQDGAPYITDNGNEIIDVKGLQIVDPRGFEAQINAWPGVVTVGLFAERGANLCLLGTPNGVETIVYPG

SEQ ID NO: 956 - protein, 231 aa, Burkholderia sp. 383
MTQDELKRLVGQAAADYVIQNVPEGAVIGVGTGSTANCFIDALAVVKARYRGAVSSSVATTERLKSHGIKVFDLNEVDSLQVYVDGADEIDASGAMIKGGGGALTREKIVASVADTFVCIADASKRVPVLGAFPLPIEVVPMARTAIGRRVTALGGVPVLRVTKDGAPYITDNGNEIIDVKGLQIADPRGFEAQVNAWPGVVTVGLFAERGANLCLLGTENGVETIVYSAN

SEQ ID NO: 957 - protein, 231 aa, Burkholderia multivorans ATCC 17616
MTQDELKRLVGQAAADYVIQNVPEGAVIGVGTGSTANCFIDALAAVKSRYRGAVSSSVATTERLKSHGIKVFDLNEVESLQVYVDGADEIDASGAMIKGGGGALTREKIVASVADTFVCIADASKRVPVLGAFPLPIEVVPMARTAIGRRVTALGGVPVLRVTKDGAPYITDNGNEIIDVKGLQIADPRGFEAQVNAWPGVVTVGLFAARGANLCLLGTEHGVETIVYPAR

SEQ ID NO: 958 - protein, 231 aa, Burkholderia multivorans CGD2M
MTQDELKRLVGQAAADYVIQNVPEGAVIGVGTGSTANCFIDALAAVKSRYRGAVSSSVATTERLKSHGIAVFDLNEVESLQVYVDGADEIDASGAMIKGGGGALTREKIVASVADTFVCIADASKRVPVLGAFPLPIEVVPMARTAIGRRVTALGGVPVLRVTKDGAPYITDNGNEILDVKGLQIADPRGFEAQVNAWPGVVTVGLFAARGANLCLLGTEHGVETIVYPAH

SEQ ID NO: 959 - protein, 235 aa, Burkholderia multivorans ATCC 17616
MTHPMTQDELKRLVGQAAADYVIQNVPEGAVIGVGTGSTANCFIDALAAVKSRYRGAVSSSVATTERLKSHGIKVFDLNEVESLQVYVDGADEIDASGAMIKGGGGALTREKIVASVADTFVCIADASKRVPVLGAFPLPIEVVPMARTAIGRRVTALGGVPVLRVTKDGAPYITDNGNEIIDVKGLQIADPRGFEAQVNAWPGVVTVGLFAARGANLCLLGTEHGVETIVYPAR

SEQ ID NO: 960 - protein, 250 aa, Burkholderia multivorans CGD1
MRESGKLAVFPQSCSIIHPMTQDELKRLVGQAAADYVIQNVPEGAVIGVGTGSTANCFIDALAAVKSRYRGAVSSSVATTERLKSHGIAVFDLNEVESLQVYVDGADEIDASGAMIKGGGGALTREKIVASVADTFVCIADASKRVPVLGAFPLPIEVVPMARTAIGRRVTALGGVPVLRVTKDGAPYITDNGNEILDVKGLQIADPRGFEAQVNAWPGVVTVGLFAARGANLCLLGTEHGVETIVYPAH

SEQ ID NO: 961 - protein, 234 aa, Burkholderia ubonensis Bu
MTQDELKRLVGQAAADYVIQNVPEGAVIGVGTGSTANCFIDALAAVKSRYRGAVSSSVATTERLKAHGITVFDLNDVESLQVYVDGADEIDASGAMIKGGGGALTREKIVASVADTFVCIADASKRVPVLGAFPLPIEVVPMARTAIGRRVTAAGGVPVLRVTKDGAPYITDNGNEIIDVKGLQIADPRGFEAEVNAWPGVVTVGLFAARGANLCLLGTESGVETIVYPDVCKK

SEQ ID NO: 962 - protein, 230 aa, Burkholderia vietnamiensis G4
MTQDELKRLVGQAAADYVIQNVPEGAVIGVGTGSTANCFIDALAAVKSRYRGAVSSSVATTERLKSHGIKVFDLNEIDALQVYVDGADEIDASGAMIKGGGGALTREKIVASVADTFVCIADGSKRVPVLGAFPLPIEVVPMARTAIGRRVAALGGVPVLRVTKDGAPYITDNGNEIIDVKGLQIAEPRAFEAKVNAWPGVVTVGLFAERGANLCLLGTENGVETIIYPA

SEQ ID NO: 963 - protein, 231 aa, Burkholderia glumae
MTQDELKRLVGQAAADYVLANVPEGSVIGVGTGSTANCFIDALAAIKTRYRGAVSSSIATTQRLASHGIRVFDLNQIDGLQVYVDGADEIDASGAMIKGGGGALTREKIVASVSATFVCIADASKRVATLGAFPLPVEVVPMARTAIGRRLTALGGVPVLRVTGDGTPYLTDNGNEILDVKGLAITDPRGLEATVNGWPGVVTVGLFAQRGADLCLLGGPAGVETIDYRGV

SEQ ID NO: 964 - protein, 236 aa, Polynucleobacter necessarius
MNQDQLKQMVGEAARDEVLKLPAGQVLGVGTGSTANYFIDALALHKGHFAGTVSSSNATTERLLKHGFKVLDPNDVQGLPAYVDGADEIDPAGHMIKGGGGVLTGEKIIASMAKQFICICDSSKQVPVLGNFALPVEIIPLSQGVVSRELEKFGGRVTLRLAKHTRADLNQTPSEPFVTDNGGWILDVAGLRIASPAQMEAQINQIAGVITVGLFAKEKANILLVSNAAGVERIQF

SEQ ID NO: 965 - protein, 236 aa, Polynucleobacter necessarius
MNQDQLKKMVGDAARDEVLKLPAGQILGVGTGSTANCFIDALAPHKDHFAGTVSSSNATTERLLKHGFKVLDPNDVVSLPAYVDGADEIDPQGHMIKGGGGALTREKIIASMAQQFICICDSSKQVPVLGNFALPVEIIPLAKGVVTRELEKLGGKVTLRLAKSTRADLNQTPSEPFVTDNGGWILDIAGLQIADPLKIESQINQIAGVITVGLFAKEKANILLVSNAAGVDRIVL

SEQ ID NO: 966 - protein, 220 aa, Thiomonas intermedia K12
MTQDELKQQVAAAALTQVPQGEIIGVGTGSTVNFFIDALAGIKYQIKGAVSSSERSTERLRAHGITVYDLNEVAQLSVYVDGADEIDASGAMIKGGGGALTREKIIAEAAERFICIVDQSKLVPVLGQFPLPVEVVPMARELVARRLRALGGDPRERSGYVTDNGNLILDVHGLEIAQPREFETRVNQIPGVVTVGLFALRAANVALIGTAEGVQRRDFV

SEQ ID NO: 967 - protein, 232 aa, Dechloromonas aromatica RCB
MRSKPFRSITMTQDELKQAVAQAAADYVAQTAPAGSIIGVGTGSTANFFIDALAPLKDKYKGAVASSEATRKRLEGHGIAVYDLNDVEDIPVYVDGADEIDAGLNMIKGGGGALTREKIVAAVAREFVCICDGSKLVDTMGKFPLPVEVIPMARAHVARELAKLGGTPVLREGFVTDNGNIILDVKGLSITDPKGLEAQINQITGVVTNGLFAVRPANLLLLGTADGVRTIR

SEQ ID NO: 968 - protein, 220 aa, Candidatus Accumulibacter phosphatis clade IIA str. UW-1
MTQDEMKKAVAHAALAHVVDGKIVGVGTGSTANCFIDALAAIKHRIGGAVASSEATRQRLASHGIAVFDLDEVEELPVYVDGADEINAAMQMIKGGGGALTREKIVAAVARKFVCIADGSKLVPVLGRFPLPVEVIPMALGHVRRELAKIGGTPLRRAGFVTDNGNLIVDVGGLPIADPVELETRINQIVGVVTNGLFACRPADVCLLGTADGVRTLTAA

SEQ ID NO: 969 - protein, 220 aa, Aromatoleum aromaticum EbN1
MTQDELKKAAAIAALDYVENGMIVGVGTGSTVNHFIDGLAGIKGRIAGAVSSSEASARRLQAHGIPVLDLNDITDLPVYVDGADEIDGGFCMIKGGGGALTREKIVAAVARRFICICDASKKVACLGRFPLPVEIIPMARAYVERELVRIGGRPELREGFVTDNGNLIVDVHGLMITSPRALETELNQIVGVVTNGLFARRGADVLLLATLAGVERQVAN

SEQ ID NO: 970 - protein, 222 aa, Azoarcus sp. BH72
MTQDELKKAAALAALDYVEDGMIVGVGTGSTVNHFIDGLAGIKHRIRGAVSSSEASSKRLAAHGIALLDLNDVDELPVYIDGADEIDHGFAMIKGGGGALTREKIVAAVARRFVCICDESKRVDVLGRFPLPIEVIPMARSQVMRAAAALGATPRLREGFVTDNGNLIIDLHGLSITDPCATEQALNAVVGVVTNGLFAARGADTLLLASAQGVRRFERSAT

SEQ ID NO: 971 - protein, 220 aa, Thauera sp. MZ1T
MTQDELKKAAAYAALDHVVEGSIVGVGTGSTVNHFIDALAGMRDRIRGAVSSSEASTQRLRAHGIEVFDLDGIESLPVYVDGADEIDGGFAMIKGGGGALTREKIVAAVSERFVCICDASKKVEVLGRFPLPIEVIPMARSHVARELRALGGEPRLREGFVTDNGNLILDVHGLSITDPVTIEMRINQIVGVVTNGLFAVRGADVLLLAAPGGVQRLDAR

SEQ ID NO: 972 - protein, 223 aa, Candidatus Ruthia magnifica str. Cm (Calyptogena magnifica)
MTQDEMKFAVAQAALKHVVKDTIIGVGTGSTTNFFIDALAKIKNEIKGAIASSKATRQRLESYDIKVFDLNEVETISVYIDGADESDDGLNLIKGGGGALMREKIVAAVANQFICIADESKLVTIMGDFPLPVEVIPMASNYVKYQISQRIGGTPTVRENFITDNGNLILDIKDLKITNPKVMETKLNSITGVVANGLFANRGADILLLGTSNGVKIVTRLIG

SEQ ID NO: 973 - protein, 220 aa, Candidatus Vesicomyosocius okutanii HA
MTQDEMKFTVAQTALKYVIKNTIIGVGTGSTANFFIDALSTIKNNIKGAVASSKATAQRLENHGIRVFDLNKVTAISTYIDGADESDNNLNLIKGGGGALTREKIVAAVAHQFICIADESKLVSIMGSFPLPIEVIPMAANYVKNQISQKIGGIPEVRKDFITDNGNFILDIKDLKITNPKAMETKLNSIIGVVTNGLFANRGANVLLLGTPNGVKIITN

SEQ ID NO: 974 - protein, 230 aa, unknown
  Uncultured SUP05 cluster bacterium
MNIIEFMERIMTQDEMKFAVAQEALKYVVKDTIIGVGTGSTANFFIDALATMKDDIKGCVASSVATAERLEGHGIKVFDLNEVEAISVYIDGADESDDGLNLIKGGGGALTREKIVAAVADKFVCIADESKFVKTMGDFPLPVEVIPMAANYVKHQITRRIGGTPFVRENFVTDNGNLILDVEGLKITDPKALETELDSIVGVVTNGLFANRGANVLLLGTPTGVTVVGA

SEQ ID NO: 975 - protein, 224 aa, unknown
  Uncultured SUP05 cluster bacterium
MERIMTQDEMKFAVAQEALKYVVKDTIIGVGTGSTANFFIDALATMKDDIKGCVASSVATAERLEGHGIKVFDLNEVEAISVYIDGADESDDGLNLIKGGGGALTREKIVAAVADKFVCIADESKFVKTMGDFPLPVEVIPMAANYVKHQITRRIGGTPFVRENFVTDNGNLILDVEGLKITDPKALETELDSIVGVVTNGLFANRGANVLLLGTPTGVTVVGA

SEQ ID NO: 976 - protein, 222 aa, Mariprofundus ferrooxydans PV-1
MTQDEMKQKVAEAALAYVKPGTIVGVGTGSTANMFIDALASMKGDIIGAVASSEATAARLAGHGITVLDLNEALTQVASLSVYIDGADEFDAGKNLTKGGGGALTREKIVAAASDAFICIVDESKRVDCLGAFPLPIEVIPMARELVAGIARKLGGNPVLRDGFITDNGNLIIDVHGLKITDARALEDELNSVPGVVTNGIFSHQGADVVLMGTPAGVETIR

SEQ ID NO: 977 - protein, 226 aa, Bordetella parapertussis
MLTQQELKQQAADAALELVEQVAGPDVIIGVGTGSTADLFIDGLARFKGRLRGTVASSERSAARLAGHGLAVLDLNDVQSMPIYVDGADEIDPNLHMIKGGGGALTREKIVASVARRYICIADESKLVERLGRFPLPVEVIPMARNAVARGLSRLGGQPALREGFVTDNGNIILDVAGLSIADAPGLEKTINDIPGVVTCGLFALAGADVALLATQDGIRRLERRG

SEQ ID NO: 978 - protein, 226 aa, Bordetella bronchiseptica
MLTQQELKQQAAEAALELVEQVAGPDVIIGVGTGSTADLFIDGLARFKGRLRGTVASSERSAARLAGHGLAVLDLNDVQSMPIYVDGADEIDPNLHMIKGGGGALTREKIVASVARRYICIADESKLVERLGRFPLPVEVIPMARNAVARGLSRLGGQPALREGFVTDNGNIILDVAGLSIADAPGLEKTINDIPGVVTCGLFALAGADVALLATQDGIRRLERRG

SEQ ID NO: 979 - protein, 226 aa, Bordetella pertussis
MLTQQELKQQAADAALELVEQVAGPDVIIGVGTGSTADLFIDGLACFKGRLRGTVASSERSAARLAGHGLAVLDLNDVQSMPIYVDGADEIDPNLHMIKGGGGALTREKIVASVARRYICIADESKLVERLGRFPLPVEVIPMARNAVARGLSRLGGQPALREGFVTDNGNIILDVAGLSIADAPGLEKTINDIPGVVTCGLFALAGADVALLATQDGIRRLERRG

SEQ ID NO: 980 - protein, 225 aa, Bordetella petrii DSM 12804
MLTQQELKQQAADAALALIEPLLGPDVIIGVGTGSTADLFIDGLARYRDRLRGTVASSERSAARLAGHGITVLDLNDVTSMPVYVDGADEIDARLHMIKGGGGAQTREKIVASVADRYICIVDESKLVERLGSFPLPVEVIPMARQAVARALVALGGQPRLREGFTTDNGNIILDVAGLQIDDAPALELTVNNLPGVVTCGLFARPGADVALLATQNGIRRLERP

SEQ ID NO: 981 - protein, 224 aa, Bordetella avium
MLTQQQLKQQAADAALEFVEQVAGPDVIIGVGTGSTADLFIDGLARFAGRIRGTVASSERSAQRLASHGLLVLDLNDVQYMPIYVDGADEIDANLHMIKGGGGALTREKIVASVAERFICIADESKLVDRLGAFPLPLEVIPMARAAVARSLAALGGEPRLREGFVTDNGNIILDVHGLSINDAPALEARVNNIPGVVTCGLFSLAGADVALLATQNGIRRLSR

SEQ ID NO: 982 - protein, 217 aa, Limnobacter sp. MED105
MDALTLKKMVAKAALTYVQPGTVLGVGTGSTVDCFIDALAESGLQLKGAVSSSVRSEKKLREIGVPIVDMNDVESLSIYVDGADEVDPANCLIKGGGGANTREKIVADISDKFVCIADQSKLVQVLGAFPLPVEVLPMASNAIARKLTALGGQVKVREGFITDNGNVILDVAGLKITDPVAMEKEINHWPGVVTNGLFAIRKADVVLIATADGIKTL

SEQ ID NO: 983 - protein, 223 aa, Acidithiobacillus caldus ATCC 51756
MDVRALKEMAAEAALSYIQPGMVVGVGTGSTSNLFIDALGRAQIHVEGYVASSLATEARLKSLGLPVLDLNATGDIPVYIDGADEIDPHFRLIKGGGGALTREKIVASAARRFICIADNSKDKPALGSFPLPVEVIPFARSFVARQLVKLGGSPVLRKDVTTDNGNVILDVTGLDLTDPLAMEMRINSIPGVLDNGIFAQRRADVVLMGSESGLISRAADTQA

SEQ ID NO: 984 - protein, 219 aa, Acidithiobacillus ferrooxidans ATCC 53993
MNTDALKKMAAEAALRYIQPGMVVGVGTGSTTNFFIEALGAAKIHVDGYVASSIATENRLKAQGLNVLELNATGDIPVYIDGADEADPHFRLIKGGGGALTREKIVASAARLFVCIADDSKDRPMLGKFPLPVEVIPFARSFVARQLVKIGGSPTLRSGITTDNGNVILDVTGLDFSDPLRMEETINAIPGVLDNGIFAHRRADVMLFGSAGGVIERKA

SEQ ID NO: 985 - protein, 231 aa, Escherichia coli
MRVKFHTTGETIMTQDELKKAVGWAALQYVQPGTIVGVGTGSTAAHFIDALGTMKGQIEGAVSSSDASTEKLKSLGIHVFDLNEVDSLGIYVDGADEINGHMQMIKGGGAALTREKIIASVAEKFICIADASKQVDILGKFPLPVEVIPMARSAVARQLVKLGGRPEYRQGVVTDNGNVILDVHGMEILDPIAMENAINAIPGVVTVGLFANRGADVALIGTPDGVKTIVK

SEQ ID NO: 986 - protein, 231 aa, Shigella dysenteriae
MHVKFHTTGETIMTQDELKKAVGWAALQYVQPGTIVGVGTGSTAAHFIDALGTMKGQIEGAVSSSDASTEKLKSLGIHVFDLNEVDSLGIYVDGADEINGHMQMIKGGGAALTREKIIASVAEKFICIADASKQVDILGKFPLPVEVIPMARSAVARQLVKLGGRPEYRQGVVTDNGNVILDVHGMEILDPIAMENAINAIPGVVTVGLFANRGADVALIGTPDGVKTIVK

SEQ ID NO: 987 - protein, 231 aa, Citrobacter koseri ATCC BAA-895
MRLNFHTTGETIMTQDELKKAVGWAALQYVQPGTIVGVGTGSTAAHFIDALGTMKGQIEGAVSSSDASTEKLKSLGITVFDLNEVDSLGVYVDGADEINGHMQMIKGGGAALTREKIIASVAKKFICIADASKEVDILGKFPLPVEVIPMARSAVARQLVKLGGRPEYRQGVVTDNGNVILDVYGMEILDPIAMENAINAIPGVVTVGLFANRGADVALIGTADGVKTIVK

SEQ ID NO: 988 - protein, 231 aa, Escherichia coli
MRVKFHTTGETIMTQDELKKAVGWAALQYVQPGTIVGVGTGSTAAHFINALGTMKGQIEGAVSSSDASTEKLKSLGIHVFDLNEVDSLGIYVDGADEINGHMQMIKGGGAALTREKIIASVAEKFICIADASKQVDILGKFPLPVEVIPMARSAVARQLVKLGGRPEYRQGVVTDNGNVILDVHGMEILGPDSDGKRHKCDSWRGDCWFVANRGADVALIGTPDGVKTIVK

SEQ ID NO: 989 - protein, 243 aa, Escherichia coli
MPTGSESLFLYIMRVKFHTTGETIMTQDELKKAVGWAALQYVQPGTIVGVGTGSTAAHFIDALGTMKGQIEGAVSSSDASTEKLKSLGIHVFDLNEVDSLGIYVDGADEINGHMQMIKGGGAALTREKIIASVAEKFICIADASKQVDILGKFPLPVEVIPMARSAVARQLVKLGGRPEYRQGVVTDNGNVILDVHGMEILDPIAMENAINAIPGVVTVGLFANRGADVALIGTPDGVKTIVK

SEQ ID NO: 990 - protein, 245 aa, Klebsiella pneumoniae
MICIAGTFPLSMFYNAPQAFTSRTRIMTQDELKKAVGWAALQYVQPGTIVGVGTGSTAAHFIDALGTMKGQIEGAVSSSDASTEKLKSLGITVFDLNSVDRLGIYVDGADEINGHMQMIKGGGAALTREKIIASVADKFICIADASKQVDILGKFPLPVEVIPMARSAVARQLVKLGGRPEYRQGVVTDNGNVILDVHGLEILDAIALENAINGIPGVVTVGLFANRGADVALIGTADGVKTIVK

SEQ ID NO: 991 - protein, 238 aa, Citrobacter youngae ATCC 29220
MFYNAREFSHHIHTTGETIMTQDELKKAVGWAALQYVQPGTIVGVGTGSTAAHFIDALGTMKGQIEGAVSSSDASTEKLKSLGIHVFDLNEVDSLGVYVDGADEINGHMQMIKGGGAALTREKIIASVAKKFICIADASKEVDILGNFPLPVEVIPMARSAVARQLVKLGGRPEYRQGVVTDNGNVILDVHGLEILDAIAMENAINAIPGVVTVGLFANRGADVALIGTPDGVKTIVK

SEQ ID NO: 992 - protein, 238 aa, Citrobacter sp. 30_2
MFYNAREFSHHIHTTGETIMTQDELKKAVGWAALQYVQPGTIVGVGTGSTAAHFIDALGTMKGQIEGAVSSSDASTEKLKSLGIHVFDLNEVDCLGVYVDGADEINGHMQMIKGGGAALTREKIIASVAKKFICIADASKEVDILGNFPLPVEVIPMARSAVARQLVKLGGRPEYRQGVVTDNGNVILDVHGLEILDAIAMENAINAIPGVVTVGLFANRGADVALIGTPDGVKTIVK

SEQ ID NO: 993 - protein, 231 aa, Enterobacter sp. 638
MRPEFSHHRQTIMTQDELKKAVGWAALQYVQPGTIVGVGTGSTAAHFIDALGTMKGQIEGAVSSSDASTEKLKSLGITVFDLNEVDRLGIYVDGADEINGHMQMIKGGGAALTREKIIASVADKFICIADASKQVDILGTFPLPVEVIPMARSAVARQLVKLGGRPEYRQGVVTDNGNVILDVYNLEILDAVAMENAINAIPGVVTVGLFANRGADVALIGTADGVKTIVK

SEQ ID NO: 994 - protein, 231 aa, Enterobacter sakazakii
MRHSFYTTGKTLMTQDELKKAVGWAALKYVEPGTIVGVGTGSTAAHFIDALGTMKNEIEGAVSSSDASTAKLKSLGITVFDLNEVDSLGIYVDGADEINGQMQMIKGGGAALTREKIIASVAQKFICIADASKQVDVLGTFPLPVEVIPMARSAVARQLVKLGGRPEYRQGVVTDNGNVILDVYGLTILDPIALENAINGIPGVVTVGLFANRGADVALIGTADGVKTIVK

SEQ ID NO: 995 - protein, 231 aa, Cronobacter turicensis
MRHSFYTTGKILMTQDELKKAVGWAALQYVEPGTIVGVGTGSTAAHFIDALGTMKNEIEGAVSSSDASTEKLKSLGITVFDLNEVDSLGIYVDGADEINGQMQMIKGGGAALTREKIIASVAKKFICIADASKQVDVLGNFPLPVEVIPMARSAVARQLVKLGGRPEYRQGVVTDNGNVILDVYGMAILDPIALENAINGIPGVVTVGLFANRGADVALIGTADGVKTIVK

SEQ ID NO: 996 - protein, 219 aa, Escherichia coli; identical to SEQ ID NO: 83

SEQ ID NO: 997 - protein, 219 aa, Escherichia coli
MTQDELKKAVGWAALQYVQPGTIVGVGTGSTAAHFIDALGTMKGQIEGAVSSSDASTEKLKSLSIHVFDLNEVDSLGIYVDGADEINGHMQMIKGGGAALTREKIIASVAEKFICIADASKQVDILGKFPLPVEVIPMARSAVARQLVKLGGRPEYRQGVVTDNGNVILDVHGMEILDPIAMENAINAIPGVVTVGLFANRGADVALIGTPDGVKTIVK

SEQ ID NO: 998 - protein, 219 aa, Escherichia coli
MTQDELKKAVGWAALQYVQPGTIVGVGTGSTAAHFINALGTMKGQIEGAVSSSDASTEKLKSLGIHVFDLNEVDSLGIYVDGADEINGHMQMIKGGGAALTREKIIASVAEKFICIADASKQVDILGKFPLPVEVIPMARSAVARQLVKLGGRPEYRQGVVTDNGNVILDVHGMEILDPIAMENAINAIPGVVTVGLFANRGADVALIGTPDGVKTIVK

SEQ ID NO: 999 - protein, 219 aa, Salmonella enterica
MTQDELKKAVGWAALQYVQPGTIVGVGTGSTAAHFIDALGTMKGQIEGAVSSSDASTEKLKGLGIHVFDLNEVDSLGIYVDGADEINGHMQMIKGGGAALTREKIIASVAEKFICIADASKQVDILGKFPLPVEVIPMARSAVARQLVKLGGRPEYRQNVVTDNGNVILDVYGMEILDPIALENAINAIPGVVTVGLFANRGADVALIGTPDGVKTIVK

SEQ ID NO: 1000 - protein, 219 aa, Salmonella enterica
MTQDELKKAVGWAALQYVQPGTIVGVGTGSTAAHFIDALGTMKGQIEGAVSSSDASTEKLKGLGIHVFDLNEVDSLGIYVDGADEINGHMQMIKGGGAALTREKIIASVAEKFICIADASKQVDILGKFPLPVEVIPMARSAVARQLVKLGGRPEYRQGVVTDNGNVILDVYGMEILDPIALENAINAIPGVVTVGLFANRGADVALIGTPDGVKTIVK

SEQ ID NO: 1001 - protein, 219 aa, Escherichia fergusonii
MTQDELKKAVGWAALQYVQPGTIVGVGTGSTAAHFIDALGTMKDQIEGAVSSSDASTEKLKSLGITVFDLNDVDSLGIYVDGADEINGHMQMIKGGGAALTREKIIASVAKKFICIADASKQVDILGKFPLPVEVIPMARSAVARQLVKLGGRPEYRQGVITDNGNVILDVHGMEILDPVAMENAINAIPGVVTVGLFANRGADVALIGTAEGVKTIVK

SEQ ID NO: 1002 - protein, 219 aa, Escherichia albertii TW07627
MTQDELKKAVGWAALQYVQPGTIVGVGTGSTAAHFIDALGTMKDQIEGAVSSSEASTEKLKSLGIHVFDLNEVDSLGIYVDGADEINGHMQMIKGGGAALTREKIVASVAKKFICIADASKQVDILGKFPLPVEVIPMARSAVARQLVKLGGRPEYRQGVVTDNGNVILDVHGMEILDPIAMENAINAIPGVVTVGLFANRGADVALIGTADGVKTIVK

SEQ ID NO: 1003 - protein, 219 aa, Klebsiella pneumoniae
MTQDELKKAVGWAALQYVQPGTIVGVGTGSTAAHFIDALGTMKGQIEGAVSSSDASTEKLKSLGITVFDLNSVDRLGIYVDGADEINGHMQMIKGGGAALTREKIIASVADKFICIADASKQVDILGKFPLPVEVIPMARSAVARQLVKLGGRPEYRQGVVTDNGNVILDVHGLEILDAIALENAINGIPGVVTVGLFANRGADVALIGTADGVKTIVK

SEQ ID NO: 1004 - protein, 219 aa, Enterobacter cancerogenus ATCC 35316
MTQDELKKAVGWAALQYVQPGTIVGVGTGSTAAHFIDALGTMKGQIEGAVSSSDASTEKLKSLGITVFDLNEVDRLGIYVDGADEINGHMQMIKGGGAALTREKIIASVADKFICIADASKQVDILGNFPLPVEVIPMARSAVARELVRLGGRPEYRQGVVTDNGNVILDVHGLEILDAVALENAINGIPGVVTVGLFANRGADVALIGTADGVKTIVK

SEQ ID NO: 1005 - protein, 219 aa, Klebsiella pneumoniae
MTQDELKKAVGWAALQYVQPGTIVGVGTGSTAAHFIDALGTMKGQIEGAVSSSDASTEKLKSLGIPVFDLNSVDRLGIYVDGADEINGHMQMIKGGGAALTREKIIASVADKFICIADASKQVDILGAFPLPVEVIPMARSAVARQLVKLGGRPEYRQGVVTDNGNVILDVHGLEILDAVALENAINGIPGVVTVGLFANRGADVALIGTADGVKTIVK

SEQ ID NO: 1006 - protein, 219 aa, Pantoea sp. At-9b
MTQDELKKAVGWAALQYVQPGTIVGVGTGSTAAHFIDALGSIKHQIEGAVSSSEASTQKLKSLGIHVFDLNEVDSLSVYVDGADEINPHMQMIKGGGAALTREKIVSAVAEKFICIADASKEVDVLGHFPLPVEVIPMARSYVARELVKLGGLPEYRQNVVTDNGNIILDVHNLRILDPIALEKAINALPGVVTVGLFAARGADVALIGTADGVKTITK

SEQ ID NO: 1007 - protein, 219 aa, Erwinia pyrifoliae Ep1/96
MTQDELKKAVGWAALDYVTPGTVVGVGTGSTAAHFIDALASMKHQIEGTVSSSELSTARLKAYGIPVFDLNEIDVLSLYVDGADEINGQMQMIKGGGAALTREKIIAAVADRFICIADESKQVDVLGHFPLPVEVIPMARSYVARELVKLGGLPEYRQDVVTDNGNIILDVHNLNIIDPIRLETAINALTGVVTVGLFAARGADVALIGTANGVQTIKK

SEQ ID NO: 1008 - protein, 219 aa, Erwinia tasmaniensis Et1/99
MTQDELKKAVGWAALDYVTPGTIVGVGTGSTAAHFIDALASIKHQIEGTVSSSEMSTARLKAYGIPVFDLNEIDALSLYVDGADEINGQMQMIKGGGAALTREKIIAAVADRFICIADESKQVDVLGHFPLPVEVIPMARSYVARELVKLGGLPEYRQDVITDNGNIILDVYNLSIIDPIRLETAINALTGVVTVGLFAARGADVALIGTADGVKTIKK

SEQ ID NO: 1009 - protein, 219 aa, Providencia rustigianii DSM 4541
MTQDELKKAVGWAALEYVKPGTIVGVGTGSTASHFIDALATMKGQIEGAVSSSEASTQKLKSLGIPVFDCNNVDSLDVYVDGADEVDNNMNMIKGGGAALTREKIVSAIAKTFVCIVDQSKLVDVLGKFPLPVEVIPMARSYVARELVKLGGQPVYRENVITDNGNVILDVHNLKILDPVALENKINGIAGVVTVGLFANRGADVVLMGTAEGVKTIKL

SEQ ID NO: 1010 - protein, 219 aa, Providencia alcalifaciens DSM 30120
MTQDELKKAVGWAALEYVKPGTIVGVGTGSTASHFIDALATMKGQIEGAVSSSEASTQKLKSLGIPVFDCNSVDSLDVYVDGADEVDGNMNMIKGGGAALTREKIVSAIAKTFVCIVDQSKLVGVLGNFPLPVEVIPMARSYVARELVKLGGQPVYRENVVTDNGNVILDVHNLKILDPVALENKINGIAGVVTVGLFANRGADVVLMGTAEGVKTIKL

SEQ ID NO: 1011 - protein, 220 aa, Providencia rettgeri
MTQDELKKAVGWAALDYVKPGTIVGVGTGSTASHFIDALATMKGQIEGAVSSSEASTQKLKSLGITVFDCNEVDSLDVYVDGADEVDHHLNMIKGGGAALTREKIVSAIAKTFVCIVDESKLVDVLGKFPLPVEVIPMARSYVARELVKLGGTPEYRQNVITDNGNVILDVHNLNIIDPVALENTINGIAGVVTVGLFANRGADVVLMGTANEGVKTIKL

SEQ ID NO: 1012 - protein, 218 aa, Providencia stuartii
MTQDELKKAVGWAALDYVKPGTIVGVGTGSTASHFIDALATMKGQIEGAVSSSEASTAKLKSLGIPVLDCNDVDSLDVYVDGADEIDHHKNMIKGGGAALTREKIVAAIAKTFVCIVDESKQVDVLGKFPLPVEVIPMARSYVARELVKLGGVPEYRQNVVTDNGNVILDVHNLSIVDPVALENKINAIAGVVTVGLFANRGADIVLMGTSEGVKTIK

SEQ ID NO: 1013 - protein, 218 aa, Proteus mirabilis
MTQDELKKAVGWAALEYVKPGTIVGVGTGSTASHFIDALATMKGQIEGAVSSSEASTAKLKSYGIPVFDCNEVDSLDIYVDGADEINHQMQMIKGGGAALTREKIIAAVAKTFVCIVDESKQVDVLGKFPLPVEVIPMARSYVARELVKLGGLPEYRENVVTDNGNVILDVYNLTILNPIELENKINSIAGVVTVGLFANRGADIVLMGTSEGVKTIK

SEQ ID NO: 1014 - protein, 219 aa, Photorhabdus luminescens
MTQDELKKAVGWAALEFVTPGTVVGVGTGSTASHFIDALGSIKDQIEGAVSSSEASTEKLKSLGIPVFDCNEVDSLDIYVDGADEINGNMQMIKGGGAALTREKIIAAIAKKFVCIVDASKKVEVLGKFPLPVEVIPMARAYVARELVKLGGVPKYRQNVVTDNGNVILDVHNLAILDPAELENKINRISGVVTVGLFANRGADIVLMGTLDGVETITQ

SEQ ID NO: 1015 - protein, 219 aa, Photorhabdus asymbiotica
MTQDELKKAVGWAALEFVTPGTIVGVGTGSTASHFIDALGSIKDQVKGAVSSSEASTEKLKSLGIPILDCNEVDSLDIYVDGADEINSNMQMIKGGGAALTREKIIAAIAKKFVCIVDASKQVDVLGRFPLPVEVIPMARSYVARELVKLGGVPKYRQNVVTDNGNVILDVHNLSILDPIELENKINGIAGVVTVGLFANRGADVVLMGALDGVKTITQ

SEQ ID NO: 1016 - protein, 220 aa, Dickeya zeae Ech1591
MTQDELKKAVGWAALDYVRPGTIVGVGTGSTAAHFIDALGSIKHQIEGAVSSSDASTAKLKSLGIPVFDCNDVDALDVYVDGADEINPHMQMIKGGGAALTREKIIAAIARQFVCIVDASKQVDVLGRFPLPVEVIPMARAYVARELVKLGGQPVYRDGVVTDNGNIILDVHNMDLSDAVAMESRINGLAGVVTVGLFANRGADVALVGTADGVKIVRLK

SEQ ID NO: 1017 - protein, 220 aa, Dickeya dadantii Ech586
MTQDELKKAVGWAALDYVRPGTIVGVGTGSTAAHFIDALGSIKHQIEGAVSSSDASTAKLKSLGIPVFDCNDVDVLDVYVDGADEINPHMQMIKGGGAALTREKIVAAIARQFVCIVDASKQVDVLGRFPLPVEVIPMARAYVARELVKLGGQPVYRDGVITDNGNIILDVHNMDLSDAVAMENCINNLAGVVTVGLFANRGADVALVGTADGVKTVRLK

SEQ ID NO: 1018 - protein, 220 aa, Dickeya dadantii Ech703
MTQDELKKAVGWAALDYVRPGTVVGVGTGSTAAHFIDALGTIKDQIKGAVSSSDASTAKLKSLGIPVFDCNDVDALDVYVDGADEINSHMQMIKGGGAALTREKIVAAISRQFVCIVDASKQVEVLGKFPLPVEVIPMARTYVTRELTKLGGRPVYRDGVLTDNGNIILDVHDFDLSDAVAMENRINGIAGVVTVGLFANRGADVALVGTADGVKTVRLK

SEQ ID NO: 1019 - protein, 238 aa, Pectobacterium wasabiae WPP163
MFYNTHTFSYIDSTGQKQIMTQDELKKAVGWAALDYVRPDTIVGVGTGSTAAHFIDALGSIKHQIKGAVSSSDASTEKLKSLGIPVFDANDVDSLDVYVDGADEINGHMQMIKGGGAALTREKIISALSRQFICIVDASKQVDVLGKFPLPVEVIPMARSYVARELAKLGGQPVYRQGVVTDNGNVILDVHNLNIMDAVAVENHINGIAGVVTVGLFANRGADVALVGTAEGVKTVVK

SEQ ID NO: 1020 - protein, 239 aa, Serratia proteamaculans
MKNSDLPYNTHTFSYRGNGHIMTQDELKKAVGWAALDYVTPGTIVGVGTGSTAAHFIDALGSIKHQIEGAVSSSDASTAKLKSLGIHVFDSNEVDSLDIYVDGADEINRHMQMIKGGGAALTREKIIAAIARKFICIVDSSKQVDVLGKFPLPVEVIPMARSYVARELVKLGGLPEYRQNVLTDNGNVILDVHNLSIMDAIALENKINGIAGVVTVGLFANRGADVALVGTPDGVKVVE

SEQ ID NO: 1021 - protein, 251 aa, Serratia odorifera
MRLRVKKCDPAGVKNSDLPYNTHTFSYRGNGHIMTQDELKKAVGWAALDYVTPGTIVGVGTGSTAAHFIDALGSIKHQIEGAVSSSDASTAKLKSLGIHVFDSNEVDSLDIYVDGADEINRQMQMIKGGGAALTREKIIAAIARKFICIVDSSKQVDVLGKFPLPVEVIPMARSYVARELVKLGGLPEYRQNVLTDNGNVILDVHNLSIMDAIALENKINGIAGVVTVGLFANRGADVALVGTPDGVKVVE

SEQ ID NO: 1022 - protein, 219 aa, Pectobacterium carotovorum subsp. carotovorum WPP14
MTQDELKKAVGWAALDYVRPDTIVGVGTGSTAAHFIDALGSIKHQIKGAVSSSDASTEKLKSLGIPVFDANDVDSLDVYVDGADEINGHMQMIKGGGAALTREKIISALSRQFICIVDASKQVDVLGKFPLPVEVIPMARSYVARELAKLGGQPVYRQGVVTDNGNVILDVHNLNIMDAVAVENHINGIPGVVTVGLFANRGADVALVGTAEGVKTVVR

SEQ ID NO: 1023 - protein, 219 aa, Pectobacterium carotovorum subsp. brasiliensis PBR1692
MTQDELKKAVGWAALDYVRPDTIVGVGTGSTAAHFIDALGSIKHQIKGAVSSSDASTEKLKSLGIPVFDANDVDSLDVYVDGADEINGHMQMIKGGGAALTREKIISAMSRQFICIVDASKQVDVLGKFPLPVEVIPMARSYVARELAKLGGQPVYRQGVLTDNGNVILDVHNLNIMDAVAVENHINGIPGVVTVGLFANRGADVALVGTAEGVKTVVK

SEQ ID NO: 1024 - protein, 219 aa, Pectobacterium carotovorum subsp. carotovorum PC1
MTQDELKKAVGWAALDYVRPDTIVGVGTGSTAAHFIDALGSIKHQIKGAVSSSDASTEKLKSLGIPVFDANEVDSLDVYVDGADEINGHMQMIKGGGAALTREKIISALSRQFICIVDASKQVDVLGKFPLPVEVIPMARSYVARELVKLGGQPVYRQGVVTDNGNVILDVHNLNIMDAIAVENHINGIPGVVTVGLFANRGADVALVGTSEGVKTVVK

SEQ ID NO: 1025 - protein, 219 aa, Pectobacterium atrosepticum SCRI1043
MTQDELKKAVGWAALDYVRPDTIVGVGTGSTAAHFIDALGSIKHQIKGAVSSSDASTEKLKSLGIPVFDANDVDSLDVYVDGADEINGHMQMIKGGGAALTREKIISALSRQFICIVDASKQVDVLGKFPLPVEVIPMARSYVARELVKLGGQPEYRQGVVTDNGNVILDVHNLNIMDAVAVENHINGIAGVVTVGLFANRGADVALVGTADGVKTVTK

SEQ ID NO: 1026 - protein, 219 aa, Yersinia ruckeri
MTQDELKKAVGWAALEYVKPGTIVGVGTGSTAAHFIDALGSIKNQIEGAVSSSDASTAKLKSLGIHVFDSNEVDGLDIYVDGADEINGHMQMIKGGGAALTREKIIAAMARQFICIVDASKQVDILGKFPLPVEVIPMARSYVARELVKLGGLPEYRQNVVTDNGNVILDVYNLNIMDAIALENKINGIAGVVTVGLFANRGADIALVGTAEGVKKVIR

SEQ ID NO: 1027 - protein, 219 aa, Yersinia bercovieri
MTQDELKKAVGWAALDYVKPGTIVGVGTGSTAAHFIDALGSIKDQIEGAVSSSDASTAKLKSYGIHVFDCNEVDVLDIYVDGADEINGHMQMIKGGGAALTREKIIAAIARKFICIADASKQVDLLGKFPLPVEVIPMARSYVARELVKLGGLPEYRQNVLTDNGNVILDVHNLTILDAVALENKINGIAGVVTVGLFANRGADVALIGTADGVKTIVK

SEQ ID NO: 1028 - protein, 219 aa, Yersinia mollaretii
MTQDELKKAVGWAALDYVKPGTIVGVGTGSTAAHFIDALGSIKDQIEGAVSSSDASTAKLKSYGIHVFDCNEVDVLDIYVDGADEINGHMQMIKGGGAALTREKIIAAIARQFICIADATKQVDVLGKFPLPVEVIPMARSYVARELVKLGGLPEYRQNVLTDNGNVILDVHNLTILDAIALENKINGIAGVVTVGLFANRGADVALIGTAEGVKTIVK

SEQ ID NO: 1029 - protein, 220 aa, Yersinia intermedia
MTQDELKKAVGWAALDYVKPGTIVGVGTGSTAAHFIDALGSIKGQIEGAVSSSDASTAKLKSYGIHVFDCNEVDVLDIYVDGADEINGQMQMIKGGGAALTREKIIAAIARQFICIADASKQVDILGKFPLPVEVIPMARSYVARELVKLGGLPEYRQNVLTDNGNVILDVHNLSILDAIALENKINGIAGVVTVGLFANRGADVALIGTADGVKTIKLK

SEQ ID NO: 1030 - protein, 220 aa, Yersinia rohdei
MTQDELKKAVGWAALDYVKPGTIVGVGTGSTAAHFIDALGSIKHQIEGAVSSSDASTAKLKSYGIQVFDCNDVDVLDIYVDGADEINGQMQMIKGGGAALTREKIIAAIARKFICIADASKQVDVLGKFPLPVEVIPMARSYVARELVKLGGLPEYRQNVLTDNGNVILDVHNLTILDAIALENKINGIAGVVTVGLFANRGADVALIGTAEGVKTVVLK

SEQ ID NO: 1031 - protein, 220 aa, Yersinia frederiksenii
MTQDELKKAVGWAALDYVKPGTIVGVGTGSTAAHFIDALGSIKGQIEGAVSSSDASTAKLKSYGIQVFDCNEVDVLDIYVDGADEINGQMQMIKGGGAALTREKIIAAIARKFICIADASKQVDVLGRFPLPVEVIPMARSYVARELVKLGGLPEYRQNVLTDNGNVILDVHNLTILDAIALENKINGIAGVVTVGLFANRGADVALIGTADGVKTVVLK

SEQ ID NO: 1032 - protein, 220 aa, Yersinia kristensenii
MTQDELKKAVGWAALDYVKPGTIVGVGTGSTAAHFIDALASIKGQIEGAVSSSDASTAKLKSYGIQVFDCNEVDVLDIYVDGADEINSQMQMIKGGGAALTREKIIAAISRKFICIADASKQVDVLGKFPLPVEVIPMARSYVARELVKLGGLPEYRQNVLTDNGNVILDVHNLTILDAIALENKINGIAGVVTVGLFANRGADVALIGTAEGVKTIVLK

SEQ ID NO: 1033 - protein, 220 aa, Yersinia aldovae
MTQDELKKAVGWAALEYVTPGTIVGVGTGSTAAHFIDALGSIKHQIEGAVSSSDASTAKLKSLGIQVFDCNEVDVLDIYVDGADEINGQMQMIKGGGAALTREKIIAAIARKFICIADASKQVDVLGRFPLPVEVIPMARSYVARELVKLGGLPEYRQNVLTDNGNVILDVHNLTILDAIALENKINGIAGVVTVGLFANRGADVALIGTADGVRTIIAK

SEQ ID NO: 1034 - protein, 220 aa, Yersinia enterocolitica
MTQDELKKAVGWAALEYVKPGTIVGVGTGSTAAHFIDALASIKGQIEGAVSSSDASTAKLKSYGIQVFDCNEVDELDIYVDGADEINSQMQMIKGGGAALTREKIIAAIARKFICIADASKQVDVLGKFPLPVEVIPMARSYVARELVKLGGLPEYRQNVLTDNGNVILDVHNLTILDAIALENKINNIAGVVTVGLFANRGADVALIGTADGVKTVELK

SEQ ID NO: 1035 - protein, 218 aa, Yersinia pestis
MTQDELKKAVGWAALDYVKPGTIVGVGTGSTAAHFIDALGSIKHQIEGAVSSSDASTAKLKSYGIPVFDCNDVDVLDIYVDGADEINGQMQMIKGGGAALTREKIIAAIARKFICIADESKQVGVLGKFPLPVEVIPMARSYVARELIKLGGLPEYRQNVLTDNGNVILDVHNLSILDAIALENQINGIAGVVTVGLFANRGADVALIGTANGVKVIG

SEQ ID NO: 1036 - protein, 219 aa, Edwardsiella ictaluri 93-146
MTQDELKKAVGWAALKYVRPGTIVGVGTGSTASHFIDALATMKGQIEGAVSSSDASTARLKSLGIPVFDLNEVDSLDIYVDGADEINGAMQMIKGGGAALTREKIVAAVAKKFVCIVDASKQVDILGSFPLPVEVIPMARAYVARELVKLGGQPVYRQGVLTDNGNVILDVHNLQIMEPCKLENAINAIAGVVTVGLFANRGADVALVGCADGVKTLTL

SEQ ID NO: 1037 - protein, 219 aa, Edwardsiella tarda
MTQDELKKAVGWAALKYVQPGTIVGVGTGSTASHFIDALATMKGQIEGAVSSSDASTAKLKSLGIPVFDLNEVDALDIYVDGADEINGAMQMIKGGGAALTREKIVAAVAKKFVCIVDASKQVDILGNFPLPVEVIPMARAYVARELVKLGGQPVYRQGVLTDNGNVILDVHNLQIMEPCKLENAINAIAGVVTVGLFANRGADVALVGCADGVKTLTL

SEQ ID NO: 1038 - protein, 218 aa, Sodalis glossinidius str. 'morsitans'
MTQDELKKAVGWAALKYVRLGTIVGVGTGSTAAHFIDALASVRHQIDGAVSSSEASSAKLQSLGIPLFDLNEVDSLDIYVDGADEINGSMQMIKGGGAALTREKIIAAVARKFICIADSSKLVDVLGTFPLPVEVIPMARAWVARELVRLGGAPVYRQGVVTDNGNIILDVHNLAIMDAVALEEQINNIPGVVTVGLFARRGADVALIGSEQGVKIIG

SEQ ID NO: 1039 - protein, 223 aa, Baumannia cicadellinicola str. Hc (Homalodisca coagulata)
MMHEKLKKAVGWAALEYVSSGMIIGVGTGSTTDHFIDALGTVKHKIEGVVSSSEQSTTKLKSMGILLFNLNDVDGLDIYVDGTDEINSNMQMIKGGGAALTREKVLAAAANKFICIADTSKQVDILGNFPLPIEVIPMAHAWVARELVHLTGGLPKYRQGVITDNGNIILDIYNLKILDAIALEKIINNIPGVVTVGLFANRCADIALISSDLGIEEISRSIK

SEQ ID NO: 1040 - protein, 219 aa, Buchnera aphidicola
MNLNELKKKAAWAALDYIYPGTVIGVGTGSTVFYFIQALSTVKHLISGAVSSSNSSTVLLKKNGIRVLDLNTFDFLEIYVDSADEINNDMQMIKGGGAALTKEKIIAAMSKKFVCIIDESKKVNILGTFPLPIEIIPIAFSYISKEILKIGGQPKLRENIITDNGNVIIDVYNLFINDPISVEKKINSLPGVVSVGLFASRVADVVLIGTQKGVEIIKN

SEQ ID NO: 1041 - protein, 223 aa, Buchnera aphidicola
MNLNKLKKKAAWAALDYIDPGTIIGVGTGTTIFYFIEALGTIKNLIYGAVSSSNSSTVLLKKHGIEVFDLKNFSSLAIYVDSADEINNHMQMIKGGGGALTREKIIASMSKKFVCIIDKSKKVDVLGTFPLPIEIIPMALSYIFREMIKIGGTPKYRKNVITDNGNIIIDVYNLCIKDPISMEKKINSLPGVVTVGLFASRSADIVLIGTQKGIRTINKKENR

SEQ ID NO: 1042 - protein, 218 aa, Buchnera aphidicola
MKTNELKRLVARKVVDYINPGSVIGIGTGSTVSYFIEVLSTIKNLISGAVSSSNFSTACLKRIGIPIYDLSKINSLVLYIDSADEINPQLQMIKGGGAALTREKIIAATAEKFICIADESKQVEILGKVPLPIEIIPMARSYISNEIIKIGGMPKYRKNVITDNGNVIIDVFNLVITDPVCLENKINSFPGVVSVGLFATRKADIALIGTSSGVQVIY

SEQ ID NO: 1043 - protein, 218 aa, Candidatus Blochmannia pennsylvanicus str. BPEN
MVQNKLKKSVGWAALKYVQSSRIIGVGTGSTVTYFIEALNSIKEKIEGVVSSSNYSSNQLKKIGIPLCNLNSLHELDVYVDSADEIDSHMQMIKGKGGALTKEKIIAAAAKKFICIVDSSKQVNILGRGPLPIEVIPMARSLVARELVRLGGLPEYRHNVITDNGNNILDVYNMKIVNASLLETKINNIPGVVSVGIFAKRRADIVLIGTREGIKIIE

SEQ ID NO: 1044 - protein, 222 aa, Candidatus Blochmannia floridanus
MISKDKLKKLVGWEALKYIKSNTIIGVGTGSTVNYFIEALSSIKQQIEGVVSSSQHSSNQLKKLGIPLYNLNNLNDLEIYIDSADEIDLHMQMIKGGGGALTKEKIIAFAAKKFICIVDDSKQVNILGRKGPIPVEVIPMARSVVSKSLICLGGLPEYRNGVITDNGNSILDVYNMNITDASLLEQRINNIPGVVSVGLFAQRKADIALIGTQKGIKILNSN

SEQ ID NO: 1045 - protein, 218 aa, Wigglesworthia glossinidia
MIEEKLKKQAAWAAIKYIKPGDIVGVGSGSTAEYFIDALGSIKNLIKGTVSSSRISSSKLKDLNIPLFDLNEVSLLNIYVDGADEINQKKHMIKGKGAALTREKIIASAAKKFICIVDSSKFVHVLGRAPLPIEVIPMARTLVSKKIIDIGGSPKYRKGIITENGNVLLDVHNLIILDSLFLEEKINNIPGVVSVGLFAHRAADIAIISGKNGIKIID

SEQ ID NO: 1046 - protein, 218 aa, Buchnera aphidicola
MFDTLKKSVAKYALSYIKKNSIIGIGSGSTIEFFIKELYTIFSNIQGVVVSSKKSEKLLKKINIPIYDLNSIQNLDIYIDSADQVNSSLEMIKGGGGALTREKIIASAAKRFLCIIDKSKYVNTFNNFPIPIEVIPMSLMFVSREILKMGGFVKYRKNFITDNGNYIIDAYNLNVIYPTNLEKIINNIPGVVSVGLFCIRKADTLLISYSNYVRTIIL

SEQ ID NO: 1047 - protein, 222 aa, Rickettsiella grylli
MEIQNLERLKKKLAETTLAYISPGSILGLGSGSTINHLITALAAIRHKIEGVVPASLETEKRLKELHIPVLDLNSAGELMLYIDSADEVNPHLQLIKGGGGALTREKIIASASQNFMCIIDESKYVGMLGQKGLPLEVIPMARSYVAREIVKLGGFPFLRDKFITDNGNIILDTQHWDFTDPIKLERLLNNIPGVVSNGLFAQRPANKLLIANKNGIKIIES

SEQ ID NO: 1048 - protein, 218 aa, Candidatus Hamiltonella defensa 5AT (Acyrthosiphon pisum)
MTQDEMKKAVSLVALNYVKSDMIVGIGTGSTVTHFIHALGSIKELVKGAVSSSEDSTRKLNNIGIPVLDTNEVDIIDIYVDSADEVNHHKQMIKGGGAALTREKVISSMAKKFICIVDHTKKVNILGQFPLPIEVIPMARSYVARELVKLRGLPEYRQGVITDNANIILDVRHLNMAHPIHLENKINAIAGVVTVGLFALRPADLVLIATSNTVEIME

SEQ ID NO: 1049 - protein, 217 aa, Alteromonadales bacterium TW-7
MTQDELKKAAAWAALEFVKENTIVGVGTGSTVNHFIDALGTVKDTLVGAVSSSEASTARLKELGIEVFELNDIDVLDVYIDGADEINAQNEMIKGGGAALTREKIVAAVAKQFVCIVDDTKLVDTLGEFPLPVEVIPMARSYVARELLKLGGDPVYRQGVVTDNGNVILDVYNLNITNAKQLETDINQIVGVVTNGLFAMRGADKVIIGTKNGPQIK

SEQ ID NO: 1050 - protein, 251 aa, Pseudoalteromonas haloplanktis
MCHLKQLSPQIKPTVGKALLCIPAEIFDINEHKTMTQDELKKAAAWAALEFVKENTIVGVGTGSTVNHFIDALGSIKDTIKGAVSSSEASTARLKALGIEVFELNDVDVLDVYVDGADEINAHNEMIKGGGAALTREKIVAAVAKQFVCIVDDTKLVATLGGFPLPVEVIPMARSYVARELLKLGGDPVYRQGVVTDNGNVILDVHNLNITQAKQLETQINQIVGVVTNGLFAERGADKVIIGTKNGPQIK

SEQ ID NO: 1051 - protein, 218 aa, Pseudoalteromonas tunicata D2
MTQDEMKKAAAWAALEYVEKDSIIGVGTGSTVNHFIDALGTIKGDIRGAVSSSEASTEKLKALGIEIFELNDVDGLSVYVDGADEINPANEMIKGGGAALTREKIVAAVAKKFVCIVDSSKQVDVLGNFPLPVEVIPMARSYVARELVKLGGDPMYRQGVVTDNGNVILDVFNLQISQAKQLEQQINQIVGVVTNGLFAARGADVVIVGTPDGPKILK

SEQ ID NO: 1052 - protein, 218 aa, Shewanella sediminis HAW-EB3
MTQDEMKKAAGWAALEYVEKDSIVGVGTGSTVNHFIDALATMKADIDGAVSSSEASTEKMKALGIPVYDLNSVDELSVYVDGADEINAHMDMIKGGGAALTREKIVAAVADKFICIVDNTKEVDVLGEFPLPVEVIPMARSYVARQLVKLGGDPVYREGVVTDNGNVILDVYNMKIMNPKELEEQINAIVGVVTNGLFAMRGADVLLVGSPEGVKTVK

SEQ ID NO: 1053 - protein, 218 aa, Shewanella piezotolerans WP3
MTQDEMKKAAGWAALQYVEKDSIVGVGTGSTVNHFIDALATMKADIDGAVSSSEASTEKMKSLGIPVYDLNSVDDLSVYVDGADEINGHMDMIKGGGAALTREKIVAAVADKFICIVDNTKQVDILGEFPLPVEVIPMARSYVARQLVKLGGDPVYREGVVTDNGNIILDVYNMKIMTPKELEEQINAIVGVVTNGLFAMRGADVLLVGTPEGVKTVK

SEQ ID NO: 1054 - protein, 218 aa, Shewanella woodyi ATCC 51908
MTQDEMKKAAGWAALEYVEKDSIVGVGTGSTVNHFIDALATMKAEIEGAVSSSEASTQKMKDLGIPVFDLNSVDELSVYVDGADEINAHMDMIKGGGAALTREKIVAAVADKFICIVDNTKQVDVLGEFPLPVEVIPMARSYVARQLVKLGGDPVYREGVITDNGNIILDVYNMKIVNPKELEQQINKIVGVVTNGLFANRGADVLLVGSPDGVKTLK

SEQ ID NO: 1055 - protein, 219 aa, Shewanella loihica PV-4
MTQDEMKKAAGWAALEYVEKDSIVGVGTGSTVNHFIDALATMKADIEGAVSSSEASTEKMKALGIPVFDLNSVDQLSVYVDGADEINGHMDMIKGGGAALTREKIVAAVADKFVCIVDNTKEVEVLGEFPLPVEVIPMARSYVARELVKLGGDPVYREGVVTDNGNVILDVYNMKIFNPKALEEQINQIVGVVTNGLFANRGADVLLVGTPEGVKTVKP

SEQ ID NO: 1056 - protein, 220 aa, Shewanella halifaxensis HAW-EB4
MMTQDEMKKAAGWAALQYVEENSIVGVGTGSTVNHFIDALATMKFDIEGAVSSSEASTEKMKALGIPVFDLNSVDELSVYVDGADEINGHMDMIKGGGAALTREKIVAAVAEKFICIVDNTKQVDILGDFPLPIEVIPMARSYVARQIVKLGGDPVYREGCVTDNGNIILDVYNMKIMNPKALEEQINGIVGVVTNGLFAMRGADVLLVGTPDGVKTITY

SEQ ID NO: 1057 - protein, 219 aa, Shewanella pealeana ATCC 700345
MTQDEMKKAAGWAALQYVEENSIVGVGTGSTVNHFIDALATMKFDIEGAVSSSEASTEKMKALGIPVFDLNSVNELSVYVDGADEINSQMDMIKGGGAALTREKIVAAVADKFICIVDNTKQVDILGEFPLPIEVIPMARSYVARQIVKLGGDPVYREGCVTDNGNIIIDVYNMKIMKPKELEQQIDGIVGVVTNGLFAKRGADILLVGTPEGVKTVTF

SEQ ID NO: 1058 - protein, 218 aa, Shewanella benthica
MTQDEMKKAAGWAALQYVEKDTIVGVGTGSTVNHFIDALATMKADIEGAVSSSAASTEKMKALGIPVYDLNSVNELSVYVDGADEINERMDMIKGGGAALTREKIIAAVAEKFICIVDNTKQVAILGEFPLPVEVIPMARSYVARQLVKLGGDPVYREGCLTDNGNIILDVYNMKIMKPKELEEQINQIVGVVTNGLFANRGADVLLVGTPEGVKTVK

SEQ ID NO: 1059 - protein, 220 aa, Shewanella sp. W3-18-1
MTQDEMKKAAGWAALKYVEEGSIVGVGTGSTVNHFIDALATMKDDIEGAVSSSEASTQKMKALGIPVYDLNSVDRLSVYVDGADEINDRMDMIKGGGAALTREKIVAAVAEKFICIVDNTKQVNILGEFPLPVEVIPMARSYVARQLVKLGGDPVYRQGVVTDNGNVILDVYNLKILNPKELESQINEIVGVVTNGLFAKRGADVLLVGTPDGVKTFTTK

SEQ ID NO: 1060 - protein, 220 aa, Shewanella putrefaciens
MTQDEMKKAAGWAALKYVEEGSIVGVGTGSTVNHFIDALATMKDDIEGAVSSSEASTQKMKALGIPVYDLNSVDRLSVYVDGADEINDRMDMIKGGGAALTREKIVAAVAEKFICIVDNTKQVNILGEFPLPVEVIPMARSYVARQLVKLGGDPVYRQGVVTDNGNVILDVYNLKILNPKELESQINEIVGVVTNGLFAKRGADVLLVGTPDGVKTFTAK

SEQ ID NO: 1061 - protein, 220 aa, Shewanella putrefaciens
MTQDEMKKAAGWAALKYVEEGSIVGVGTGSTVNHFIDALATMKDDIEGAVSSSEASTQKMKALGIPVYDLNSVDRLSVYVDGADEINDRMDMIKGGGAALTREKIVAAVAEKFICIVDNTKQVNILGEFPLPVEVIPMARSYVARQLVKLGGDPVYREGVVTDNGNVILDVYNLKILNPKELESQINEIVGVVTNGLFAKRGADVLLVGTPDGVKTFTAK

SEQ ID NO: 1062 - protein, 220 aa, Shewanella baltica OS155
MTQDEMKKAAGWAALKYVERDSIVGVGTGSTVNHFIDALATMKADIEGAVSSSEASTQKMKALGIPVYDLNSVDRLSVYVDGADEINDRMDMIKGGGAALTREKIVAAVAEKFICIVDNTKQVDILGEFPLPVEVIPMARSYVARQLVKLGGDPVYREGVVTDNGNVILDVYNLKILNPKELESQINEIVGVVTNGLFAKRGADVLLVGTPDGVKTFTAE

SEQ ID NO: 1063 - protein, 220 aa, Shewanella baltica OS185
MTQDEMKKAAGWAALKYVEKDSIVGVGTGSTVNHFIDALATMKADIEGAVSSSEASTQKMKALGIPVYDLNSVDRLSVYVDGADEINDHMDMIKGGGAALTREKIVAAVAEKFICIVDNTKQVDILGEFPLPVEVIPMARSYVARQLVKLGGDPVYREGVVTDNGNVILDVYNLKILNPKELESQINEIVGVVTNGLFAKRGADVLLVGTPDGVKTFTAK

SEQ ID NO: 1064 - protein, 219 aa, Shewanella sp. ANA-3
MTQDEMKKAAGWAALKYVEKDSIVGVGTGSTVNHFIDALATMKADIEGAVSSSEASTQKMKALGIPVYDLNSVDKLSVYVDGADEINGHMDMIKGGGAALTREKIVAAVAEKFVCIVDNTKQVDILGKFPLPVEVIPMARSYVARELVKLGGDPVYREGVVTDNGNVILDVYNLKIINPKELEEKINAIVGVVTNGLFAKRGADVLLVGTPEGVKTFTA

SEQ ID NO: 1065 - protein, 219 aa, Shewanella sp. MR-4
MTQDEMKKAAGWAALKYVEKDSIVGVGTGSTVNHFIDALATMKADIEGAVSSSEASTQKMKALGIPVYDLNSVDKLSVYVDGADEINGHMDMIKGGGAALTREKIVAAVAEKFVCIVDNTKQVDILGEFPLPVEVIPMARSYVARELVKLGGDPVYREGVVTDNGNVILDVYNLKIINPKELEEKINAIVGVVTNGLFAKRGADVLLVGTPEGVKTFTA

SEQ ID NO: 1066 - protein, 219 aa, Shewanella oneidensis MR-1
MTQDEMKKAAGWAALKYVEKDSIVGVGTGSTVNHFIDALATMKADIEGAVSSSEASTQKMKALGIPVYDLNSVDKLSVYVDGADEINGHMDMIKGGGAALTREKIVAAVAEKFVCIVDNTKQVDILGEFPLPVEVIPMARSYVARQLVKLGGDPVYREGVITDNGNVILDVYNLKILNPKELEDKINAIVGVVTNGLFAKRGADVLLVGTPEGVKTFTA

SEQ ID NO: 1067 - protein, 219 aa, Shewanella amazonensis SB2B
MTQDEMKKAAAWAALKYVEKDSIVGVGTGSTVNHFIDALGTIKADIEGAVSSSEASTAKLKALGIPVYDLNSVDRLSVYVDGADEINGQMDMIKGGGAALTREKIVAAVADKFICIVDNTKEVAILGEFPLPVEVIPMARSYVARELVKLGGDPVYREGVVTDNGNVILDVHNMKIMEPKKLEAQINGIVGVVTNGLFAHRGADVLLVGTPDGVKTVTA

SEQ ID NO: 1068 - protein, 219 aa, Shewanella denitrificans OS217
MTQDEMKKAAGWAALKYVEVDSIVGVGTGSTVNHFIDALATMKHNIKGAVSSSVASTEKMKALGIDVFDLNEVSELSIYVDGADEINAHMDMIKGGGAALTREKIVAAVADKFICIVDNTKQVDVLGQFPLPVEVIPMARSYVARELVKLGGDPVYRQGVITDNGNVILDVYNLKILNPKALETQINAIVGVVTNGLFANRGADILLMGTPDGVKTSTN

SEQ ID NO: 1069 - protein, 219 aa, Shewanella frigidimarina
MTQDEMKKAAGWAALQYVKKDTIVGVGTGSTVNHFIDALATMKDDIEGAVSSSEASTKKLIELGIEVFDLNSVDLIDVYVDGADEINDRMDMIKGGGAALTREKIVAAVAKRFICIVDNTKQVPILGEFPLPVEVIPMARSYVARELVKLGGDPVYRQGVITDNGNVILDVYNMKILDPKVMETKINAIVGVVTNGLFANRGADVLLVGTPDGVNTITL

SEQ ID NO: 1070 - protein, 219 aa, Photobacterium sp. SKA34
MTQDEMKKAAGWAALEYVQKGTIVGVGTGSTVNHFIDALATRKEEIKGAVSSSVASTERLEQLGITVFDANEVASLDIYVDGADEINADYDMIKGGGAALTREKIVAAIAKKFICIVDDTKQVDVLGQFPLPVEVIPMGRSFIGRELVKLGGDPAYREGVVTDNGNMILDVYNMKITDPKTMEDKINALPGVVTVGLFAHRGADVLLVGSPDGVKKFEK

SEQ ID NO: 1071 - protein, 219 aa, Vibrio angustum S14
MTQDEMKKAAGWAALEYVQKGTIVGVGTGSTVNHFIDALATRKEEIKGAVSSSVASTERLEQLGITVFDANEVASLDIYVDGADEINADYDMIKGGGAALTREKIVAAIAKKFICIVDDTKQVDVLGQFPLPVEVIPMGRSFIGRELVKLGGDPAYREGVVTDNGNMILDVYNMKITDPKAMEDKINALPGVVTVGLFAHRGADVLLVGSPDGVKKFEK

SEQ ID NO: 1072 - protein, 219 aa, Photobacterium profundum SS9
MTQDEMKKAAGWAALEYVTKGSIVGVGTGSTVNHFIDALETRKEEIKGAVSSSVASTERLEKLGIPVFEANEVAGLDIYVDGADEINAEYDMIKGGGAALTREKIVAAISDKFICIVDDTKQVDVLGQFPLPVEVIPMARSFIGRELVKLGGDPEYREGVVTDNGNIIIDVHNMAITDAKDMEKKINALPGVVTVGLFAARGADVLLVGAPEGVRKFEK

SEQ ID NO: 1073 - protein, 219 aa, Photobacterium profundum 3TCK
MTQDEMKKAAGWAALEYVTKGSIVGVGTGSTVNHFIDALETRKEEIKGAVSSSVASTERLEKLGITVFDANEVAGLDIYVDGADEINAEYDMIKGGGAALTREKIVAAISDKFICIVDDTKQVDVLGQFPLPVEVIPMARSFIGRELVKLGGDPEYRQGVVTDNGNIIIDVHNMAITDAKDIEKKINALPGVVTVGLFAARGADVLLVGAPEGVRKFEK

SEQ ID NO: 1074 - protein, 219 aa, Photobacterium damselae subsp. damselae CIP 102761
MTQDEMKKAAGWAALEYVKKGSIVGVGTGSTVNHFIDALATRKEEIKGAVSSSVASTERLKQIGIPVFDANEVASLDIYVDGADEINGEFDMIKGGGAALTREKIVAAIAKTYVCIVDNTKEVDVLGQFPLPVEVIPMARSYVARELVKLGGDPVYRQGVTTDNGNIILDVHNMQITNPKAMEDAINGIAGVVTVGLFAHRGADILLVGAPDGVKKVEK

SEQ ID NO: 1075 - protein, 218 aa, Aliivibrio salmonicida LFI1238
MTQDEMKKAAGWAALEYVEVGSIVGVGTGSTVNHFIDALATMKDDIKGAVSSSVASTEKLKELGIEVFDCNDVAGLDVYVDGADEINGLNEMIKGGGAALTREKIVAAISDKFICIVDNTKQVDILGEFPLPVEVIPMARSYVARELVKLGGDPAYREGVVTDNGNMILDVHNMKITNAKELEDKINALPGVVTVGLFAHRGADVLLVGAPDGVKKFV

SEQ ID NO: 1076 - protein, 218 aa, Vibrio fischeri
MTQDEMKKAAGWAALEYVEAGSIVGVGTGSTVNHFIDALATMKNEIKGAVSSSVASTEKLKELGIEVFDCNDVAGLDVYVDGADEINGKNEMIKGGGAALTREKIVAAISDKFICIVDDTKQVDVLGQFPLPVEVIPMARSYVARELVKLGGDPAYREGVITDNGNVILDVHGMKITDAKDLEDKINALPGVVTVGLFAHRGADVLLVGAPEGVKKFD

SEQ ID NO: 1077 - protein, 217 aa, Grimontia hollisae CIP 101886
MTQDEMKKAAGWAALEYVTKGSIVGVGTGSTVNHFIDALETIKEQIKGAVSSSVASTERLEKIGIPVFDANEVDSLDIYVDGADEINPNNEMIKGGGAALTREKIVAAIAKQFICIIDDSKKVDVLGQFPLPVEVIPMARSYVARELVKLGGDPCYREGCITDNGNVILDVHNLKITNAKELEDKINAIPGVVTVGLFANRGADVVLEGTANGVVKS

SEQ ID NO: 1078 - protein, 220 aa, Vibrio vulnificus
MSMTQDEMKKAAGWAALKYVEKGSIVGVGTGSTVNHFIDALGTMSEEIKGAVSSSVASTEKLEALGIKIFDCNEVASLDIYVDGADEINADREMIKGGGAALTREKIVAAIADKFICIVDGTKAVDVLGTFPLPVEVIPMARSYVARQLVKLGGDPCYREGVITDNGNVILDVYGMKITNPKQLEDQINAIPGVVTVGLFAHRGADVVITGTPEGAKIEE

SEQ ID NO: 1079 - protein, 220 aa, Vibrio vulnificus
MSMTQDEMKKAAGWAALKYVEKGSIVGVGTGSTVNHFIDALGTMSEEIKGAVSSSVASTEKLEALGIKIFDCNEVASLDIYVDGADEINADREMIKGGGAALTREKIVAAIADKFICIVDGTKAVDVLGTFPLPVEVIPMARSYVARQLVKLGGDPCYREGVITDNGNVILDVYGMKITNPKQLEDQINGIPGVVTVGLFAHRGADVVITGTPEGAKIEE

SEQ ID NO: 1080 - protein, 218 aa, Vibrio vulnificus
MTQDEMKKAAGWAALKYVEKGSIVGVGTGSTVNHFIDALGTMSEEIKGAVSSSVASTEKLEALGIKIFDCNEVASLDIYVDGADEINADREMIKGGGAALTREKIVAAIADKFICIVDGTKAVDVLGTFPLPVEVIPMARSYVARQLVKLGGDPCYREGVITDNGNVILDVYGMKITNPKQLEDQINGIPGVVTVGLFAHRGADVVITGTPEGAKIEE

SEQ ID NO: 1081 - protein, 220 aa, Vibrio parahaemolyticus
MSMTQDEMKKEAGWAALKYVEKGSIVGVGTGSTVNHFIDALGTIKEEIKGAVSSSEASTQRLKELEIEVFDCNEVAGLDIYVDGADEINANREMIKGGGAALTREKIVAAISDKFICIVDDTKAVDVLGEFPLPVEVIPMARSYVARELVKLGGDPAYREGCITDNGNVILDVYGMQITNPKELEDKINALPGVVTVGLFAHRGADVVITGTQQGAKIEE

SEQ ID NO: 1082 - protein, 218 aa, Vibrio orientalis
MTQDEMKKEAGWAALKYVEKGSIVGVGTGSTVNHFIDALGTMKEEIKGAVSSSVASTERLKELEIEVFDCNEVAGLDIYVDGADEINADREMIKGGGAALTREKIVAAISDKFICIVDNTKAVDVLGEFPLPVEVIPMARSYVARELVKLGGDPAYREGVTTDNGNVILDVYGLKITNPKDLENKINALPGVVTVGLFAHRGADVVITGTPEGAKIEE

SEQ ID NO: 1083 - protein, 218 aa, Vibrio sp. MED222
MTQDEMKKAAGWAALQYVEEGSIVGVGTGSTVNHFIDALGTMKDKIKGAVSSSVASTEKLEALEIKVFECNDVFKLDIYVDGADEINGSRDMIKGGGAALTREKIVAAISDKFICIVDGTKAVDVLGKFPLPVEVIPMARSYVARELVKLGGDPVYREGCTTDNGNVILDVYGMAIENPKQLEDIINGIAGVVTVGLFAHRGADVVITGTPEGAKIEE

SEQ ID NO: 1084 - protein, 218 aa, Vibrio splendidus
MTQDEMKKAAGWAALQYVEEGSIVGVGTGSTVNHFIDALGTMKDKIKGAVSSSIASTEKLEALEIKVFECNDVFKLDIYVDGADEINGSRDMIKGGGAALTREKIVAAISDKFICIVDGTKAVDVLGKFPLPVEVIPMARSYVARELVKLGGDPVYREGCTTDNGNVILDVYGMAIENPKQLEDIINGIAGVVTVGLFAHRGADVVITGTPEGAKIEE

SEQ ID NO: 1085 - protein, 218 aa, Vibrio splendidus
MTQDEMKKAAGWAALQYVEEGSIVGVGTGSTVNHFIDALGTMKEKIKGAVSSSVASTEKLEALEIKVFECNDVFKLDIYVDGADEINASRDMIKGGGAALTREKIVAAISDKFICIVDGTKAVDVLGKFPLPVEVIPMARSYVARELVKLGGDPVYREGCTTDNGNMILDVYGMAIENPKQLEDIINGIAGVVTVGLFAHRGADVVITGTPEGAKIEE

SEQ ID NO: 1086 - protein, 218 aa, Vibrionales bacterium SWAT-3
MTQDEMKKAAGWAALKYVEEGSIVGVGTGSTVNHFIDALGTMKDKIKGAVSSSVASTQRLEELEIKVYECNDVAKLDIYVDGADEINPTRDMIKGGGAALTREKIVAAISDKFVCIVDGTKAVDVLGKFPLPVEVIPMARSYVARELVKLGGDPVYREGCTTDNGNVILDVYGMAIENPKQLEDIINGIAGVVTVGLFAHRGADVVITVPLKCKIEDK

SEQ ID NO: 1087 - protein, 218 aa, Vibrio cholerae
MTQDEMKKAAGWAALKYVEKGSIVGVGTGSTVNHFIDALGTIKDEIKGAVSSSIASTAKLEALGIRVYDCNDVSELDIYVDGADEINPERDMIKGGGAALTREKIVAAIAKKFVCIVDGTKAVDVLGNFPLPVEVIPMARSYVARELVKLGGDPVYREGVITDNGNVILDVYNMKITHPKDLESKINGIAGVVTVGLFAHRGADVVITGTPQGAKIEE

SEQ ID NO: 1088 - protein, 218 aa, Vibrio cholerae
MTQDEMKKAAGWAALKYVEKGSIVGVGTGSTVNHFIDALGTIKDEIKGAVSSSIASTAKLEALGIRVYDCNDVSELDIYVDGADEINPERDMIKGGGAALTREKIVAAIAKKFVCIVDGTKAVDVLGNFPLPVEVIPMARSYIARELVKLGGDPVYREGVITDNGNVILDVYNMKITHPKDLESKINGIAGVVTVGLFAHRGADVVITGTPQGAKIEE

SEQ ID NO: 1089 - protein, 218 aa, Vibrio cholerae
MTQDEMKKAAGWAALKYVEKGSIVGVGTGSTVNHFIDALGTIKDEIKGAVSSSIASTAKLEALGIRVYDCNDVSELDIYVDGADEINPERDMIKGGGAALTREKIVAAIAKKFVCIVDGTKAVDVLGNFPLPVEVIPMARSYVARELVKLGGDPVYREGVITDNGNVILDVYNMKITHPKDLESKINCIAGVVTVGLFAHRGADVVITGTPQGAKIEE

SEQ ID NO: 1090 - protein, 218 aa, Vibrio cholerae
MTQDEMKKAAGWAALKYVEKGSIVGVGTGSTVNHFIDALGTIKDEIKGAVSSSIASTAKLEALGIRVYDCNDVSELDIYVDGADEINPERDMIKGGGAALTREKIVAAIAKKFVCIVDGTKAVDVLGNFPLPVEVIPMARSYVARELVKLGGDPVYREGVITDNGNVILDVHNMKITHPKDLETKINGIAGVVTVGLFAHRGADVVITGTPQGAKIEE

SEQ ID NO: 1091 - protein, 218 aa, Vibrio mimicus
MTQDEMKKAAGWAALKYVEKGSIVGVGTGSTVNHFIDALGSIKEEIKGAVSSSIASTEKLEALGIRVYDCNDVSELDIYVDGADEINPKRDMIKGGGAALTREKIVAAIAKKFVCIVDGTKAVDVLGNFPLPVEVIPMARSYVARELVKLGGDPVYREGVITDNGNVILDVYNMKITHPKDLETKINGIPGVVTVGLFAHRGADVVITGTPQGAKIEE

SEQ ID NO: 1092 - protein, 218 aa, Vibrio mimicus
MTQDEMKKAAGWAALKYVEKGSIVGVGTGSTVNHFIDALGSIKEEIKGAVSSSIASTEKLEALGIRVYDCNDVSELDIYVDGADEINPERDMIKGGGAALTREKIVAAIAKKFVCIVDGTKAVDVLGNFPLPVEVIPMARSYVARELVKLGGDPVYREGVITDNGNVILDVYNMKITHPKDLETKINGIPGVVTVGLFAHRGADVVITGTPQGAKIEE

SEQ ID NO: 1093 - protein, 218 aa, Vibrio sp. RC586
MTQDEMKKAAGWAALKYVEKGSIVGVGTGSTVNHFIDALGSIKEEIKGAVSSSIASTEKLEALGIRVYDCNDVAALDIYVDGADEINPERDMIKGGGAALTREKIVAAIAKKFVCIVDGTKAVDVLGNFPLPVEVIPMARSYVARELVKLGGDPVYREGVITDNGNMILDVHNMKIIHPKDLETKINGIAGVVTVGLFAHRGADVVITGTPQGAKIEE

SEQ ID NO: 1094 - protein, 218 aa, Vibrio sp. RC341
MTQDEMKKAAGWAALKYVEKGSIVGVGTGSTVNHFIDALGTIKEEIKGAVSSSIASTEKLEALGIRVYDCNEVAALDIYVDGADEINPERDMIKGGGAALTREKIVAAIAKKFVCIVDGTKAVDVLGNFPLPVEVIPMARSYVARELVKLGGDPVYREGVITDNGNVILDVHNMKITHPKDLETKINGIAGVVTVGLFAHRGADVVITGTPQGAKIEE

SEQ ID NO: 1095 - protein, 218 aa, Vibrio furnissii
MTQDEMKKAAGWAALKYVEKGSIVGVGTGSTVNHFIDALGSIKDGIKGAVSSSIASTEKLKGLGIEVFDCNDVAGLDVYVDGADEINPQREMIKGGGAALTREKIVAAIADKFICIVDGTKAVDVLGGFPLPVEVIPMARSYVARELVKLGGDPVYREGVLTDNGNIILDVHNMRITDAKDLESKINAIAGVVTNGLFAHRGADVVITGTPEGAKIEE

SEQ ID NO: 1096 - protein, 218 aa, Vibrio parahaemolyticus
MTQDEMKKAAGWAALKYVEKGSIVGVGTGSTVNHFIDALGTIKDDIKGAVSSSVASTERLKELGIEVFECNDVIKLDVYVDGADEINHAREMIKGGGAALTREKIVAAISEKFVCIVDDTKAVDVLGQFPLPVEVIPMARSYVARELVKLGGDPAYREGVVTDNGNIILDVHNMQITNPKEMEDKINGIAGVVTVGLFAHRGADVVITGTPEGAKIEE

SEQ ID NO: 1097 - protein, 218 aa, Vibrio parahaemolyticus
MTQDEMKKAAGWAALKYVEKGSIVGVGTGSTVNHFIDALGTIKDDIKGAVSSSVASTERLKELGIEVFECNDVIKLDVYVDGADEINPAREMIKGGGAALTREKIVAAISEKFVCIVDDTKAVDVLGQFPLPVEVIPMARSYVARELVKLGGDPAYREGVVTDNGNIILDVHNMQITTPKEMEDKINGIAGVVTVGLFAHRGADVVITGTPEGAKIEE

SEQ ID NO: 1098 - protein, 218 aa, Vibrio alginolyticus
MTQDEMKKAAGWAALKYVEKGSIVGVGTGSTVNHFIDALGTIKDDIKGAVSSSVASTERLKELGIEVYECNDVMKLDVYVDGADEINPAREMIKGGGAALTREKIVAAISDKFVCIVDGTKAVDVLGQFPLPVEVIPMARSYVARELVKLGGDPAYREGVVTDNGNVILDVHNMQITNPKEMEDKINGIAGVVTVGLFAHRGADVVITGTPEGAKIEE

SEQ ID NO: 1099 - protein, 218 aa, Vibrio harveyi
MTQDEMKKAAGWAALKYVEKGSIVGVGTGSTVNHFIDALGSIKDDIKGAVSSSVASTERLKELGIEVYECNDVAMLDIYVDGADEINAAREMIKGGGAALTREKIVAAISEKFVCIVDGTKAVDVLGQFPLPVEVIPMARSYVARELVKLGGDPAYREGVTTDNGNVILDVHNMQITNPKELEDKINGIAGVVTVGLFAHRGADVVITGTPEGAKIEE

SEQ ID NO: 1100 - protein, 218 aa, Vibrio sp. AND4
MTQDEMKKAAGWAALKYVEKGSIVGVGTGSTVNHFIDALGSIKDDIKGAVSSSIASTERLKALGIEVYECNDVAMLDIYVDGADEINAAREMIKGGGAALTREKIVAALSEKFICIVDGTKAVDVLGQFPLPVEVIPMARSYVARELVKLGGDPAYREGVTTDNGNVILDVHNMQITNPRELEDKINAIAGVVTVGLFAHRGADVVITGTPEGAKIAE

SEQ ID NO: 1101 - protein, 218 aa, Vibrio shilonii AK1
MTQDEMKKAAGWAALKYVEKDSIVGVGTGSTVNHFIDALGTIKEDIKGAVSSSIASTEKLEALGIEVFDCNDVAYLDVYVDGADEINPTRDMIKGGGAALTREKIVAAISDKFVCIVDGTKAVDVLGQFPLPVEVIPMARSYVARELVKLGGDPVYREGVITDNGNVILDVHGMQITDAKDMEDKINALAGVVTVGLFAHRGADVIITGTPEGAKIEE

SEQ ID NO: 1102 - protein, 218 aa, Vibrio coralliilyticus ATCC BAA-450
MTQDEMKKEAGWAALKYVEKDSIVGVGTGSTVNHFIDALGTIKDDIKGAVSSSEASTEKLKGLGIEVFDCNEVSNLDVYVDGADEINAARDMIKGGGAALTREKIVAAISDKFVCIVDGTKAVDVLGEFPLPVEVIPMARSYVAREMVKLGGDPVYREGVVTDNGNVILDVHGMQITHPKEMEDKINAIAGVVTVGLFAHRGADVVITGTPQGAKIED

SEQ ID NO: 1103 - protein, 218 aa, Vibrio metschnikovii
MTQDEMKKAAGWAALNYVKKGSIVGVGTGSTVNHFIDALGSIKDDIQGAVSSSLASTEKLQALGIKVYDCNDIEALDVYVDGADEINAQREMIKGGGAALTREKIVAAIAKQFICIVDGSKAVPVLGKFPLPVEVIPMARSYVSRELSKLGGKPVYREGVITDNGNIILDVHDLHITQAKALEDKINSITGVVTNGLFAHRGADVVITGTEQGAKIEE

SEQ ID NO: 1104 - protein, 217 aa, Aeromonas salmonicida
MTQDEMKKAAGWAALKYVVPGTIVGVGTGSTVNHFIDALATMKDQINGAVSSSIASTERLKEFGINVYDLNDIDALSVYVDGADEINASRDMIKGGGAALTREKIVAAVADKFICIIDNTKTVDVLGQFPLPVEVIPMAREYVAREIRKLGGNPEWREGVVTDNGNIILDVKGMAIKDAKALEVQLNGIVGVVTNGLFAHRGADVVLIGTPDGVITQ

SEQ ID NO: 1105 - protein, 217 aa, Aeromonas hydrophila
MTQDEMKKAAGWAALKYVVPGTIVGVGTGSTVNHFIDALATMKDEIKGAVSSSVASTERLKGFGITVYDLNEIDALSVYVDGADEINGTRDMIKGGGAALTREKIVAAVADKFICIIDNTKTVDVLGTFPLPVEVIPMAREYVAREIRKLGGNPVWREGVVTDNGNHILDVKGMAITDAKGLEVQLNAIVGTVTNGLFAHRGADVVLIGTPDGVITQ

SEQ ID NO: 1106 - protein, 218 aa, Moritella sp. PE36
MTQDELKKAAGWAALEYVKKDSIVGVGTGSTVNHFIDALGTIREDIKGAVSSSIESTKRLEAMGIEVFDLNSVPHLDIYVDGADEIDSNNNMIKGGGAALTREKIVAAVADQFVCIIDDTKNVAVLGDFPLPVEVIPMARSYVGRELVQLGGDPVYREGVVTDNGNIILDVYNMQITDPKALEIAINGLVGVVTNGLFAARGADIVLTGTQNGVKTTK

SEQ ID NO: 1107 - protein, 218 aa, Psychromonas ingrahamii 37
MTQDEMKKAAAYAALEYVQPDSIVGVGTGSTVTHFIDALATIKDLIKGAVSSSDESTARLQSYGIDVFDLNEVSELSIYVDGADEINPYNHMIKGGGAALTREKIISAVAEKFICIVDNTKNVDILGDFPLPIEVIPMARSYVARELVKLGGDPVYRQGVVTDNGNVILDVHNLKIAEPLKLEAQINAIVGVVTNGLFANRAADVVLVGTPEGVKTLK

SEQ ID NO: 1108 - protein, 218 aa, Psychromonas sp. CNPT3
MTQDEMKKAAAYAALEYVESGSIIGVGTGSTVNHFIDALKTIKGSIKGAVSSSEESTKRLRAYGIEVFDLNEVTELSVYVDGADEINPYNAMIKGGGAALTREKIVAAVAKKFICIVDNTKNVDVLGGFPLPVEVIPMARSYVARELVKLGGTPIYRQGVITDNGNIILDVHAMKISEPLKTETAINALAGVVTNGLFANRGADVVLVGTPEGVKTLK

SEQ ID NO: 1109 - protein, 218 aa, Pseudoalteromonas atlantica
MNQDDKKKAVAQAAVRYVEQDSIIGVGTGSTVNYFIEALAPIKNDIVGAVSSSEASTERLTALGIEVFDLNSVDQLSVYVDGADEITEHRHMIKGGGAALTREKIVAAVAQKFVCIIDDTKNVGVLGAFPLPVEVIPMARSYVAREIVKLGGDPVYRQGVVTDNGNVILDVHNLKILNPVELERQLNNIVGVVTNGLFAARGADVVLTGSESGVQVNE

SEQ ID NO: 1110 - protein, 217 aa, alpha proteobacterium HTCC2255
MTQDDKKRAAAQAALAYVKPDDIVGVGTGSTVNYFIEALAAKKDLIEGAVSSSDASTQQLKALGIEVFDLNSVDQFDIYIDGADEITEHKHMIKGGGAALTREKIVSAVAKTFVCIIDDTKQVGMLGDFPLPVEVIPMARSYVARELVKLGGDPVYRQGVITDNGNVILDVHNLTILDPRALETKINQIVGVVTNGLFAHRGADILIVGGEDGVKTL

SEQ ID NO: 1111 - protein, 220 aa, Alteromonas macleodii
MTMDQNAKKQAVAKAAIDYVESDSIVGVGTGSTVNFFIEELGKIKHKIEGAVSSSEASTARLKALGIEVFALNEVSNLSVYIDGADEVTEHKHMIKGGGAALTREKIVAGAATTFVCIVDETKRVPVLGAFPLPVEVIPMARSFVARELVKLGGDPEYRQGVITDNGNVILDVHNLEILNPRELEQKINNIPGVVTNGIFALRGADIVLSATENGVETFK

SEQ ID NO: 1112 - protein, 218 aa, Alteromonas macleodii
MDQNAKKQAVAKAAIEYVEADSIVGVGTGSTVNFFIEELGKIKHKIEGAVSSSEASTERLKALGIEVFELNEVSNLSVYIDGADEVTEHKHMIKGGGAALTREKIVAGAATTFVCIVDESKRVPVLGSFPLPVEVIPMARSFVARELVKLGGDPEYRQGVVTDNGNVILDVHNLEILNPRELEQKINNIPGVVTNGIFALRGADIVLSATDSGVETFK

SEQ ID NO: 1113 - protein, 218 aa, Colwellia psychrerythraea 34H
MTQDEMKNAAAIKALEFIENDTIVGVGTGSTVNFFIEALASMKDKIAGAVSSSEESTKRLKAHGIEVFDLNSVDVLDVYVDGADEITRHMSMIKGGGAALTREKIVAAVAKKFICIADDSKQVKVLGNFPLPVEVIPMARSYVARELVKLGGDPVYRQGVTTDNGNVILDVYNLEILDPKALETQINAIVGVVTNGLFALRGADILVLGSKDGIQVIQ

SEQ ID NO: 1114 - protein, 218 aa, Aggregatibacter aphrophilus NJ8700
MDQLEMKKIAAQAALQFVKPEMIVGVGSGSTVNCFIEALGSMKDEIKGAVAASKNSEELLKKHGIEVFSANDVTSLDIYVDGADEINPQKMMIKGGGAALTREKIVAALAKNFICIVDSSKQVDVLGSTFPLPVEVIPMARSQVARKLVALGGAPEYREGVVTDNGNIILDVHNFEILNPVEMEKELNNIAGVVTNGIFALRPANTVIVGTPNGAKII

SEQ ID NO: 1115 - protein, 218 aa, Aggregatibacter actinomycetemcomitans D11S-1
MDQLEMKKIAAQAALQFVKPEMIVGVGSGSTVNCFIEALGALKNQIKGAVAASKKSEELLRQQGIEVFSTNDVSGLDIYVDGADEINPQKMMIKGGGAALTREKIVAALAKNFICIVDSSKQVDVLGSTFPLPIEVIPMARSQVARKLVALGGAPEYREGVVTDNGNIILDVHNFEIMNPVAMEKELNDIAGVVTNGIFALRSADTVIVGTPSGAKII

SEQ ID NO: 1116 - protein, 219 aa, Mannheimia succiniciproducens MBEL55E
MNQLEMKKVAAKAALQFVKPDMIVGVGSGSTVNCFIEELGAFRDQIKGAVAASKASEELLRKQGIEVFSANDVSSLDIYVDGADEINPQKMMIKGGGAALTREKIVSSLAKNFICIVDSSKQVDILGSTFPLPVEVIPMARSQVARKLVALGGSPEWREGVITDNGNVILDVHNFIIMNPIEMEKELNNVAGVVTNGIFALNAAHTVIVGTPDGAKIIE

SEQ ID NO: 1117 - protein, 219 aa, Actinobacillus succinogenes 130Z
MDQLEMKKMAAQAALQFVQPDSIVGVGSGSTVNCFIEALGAMRDQIKGAVAASKASEELLRKQGIEVFSANDVSSLDIYVDGADEINPQKMMIKGGGAALTREKIVASLTKNFICIVDSSKQVDVLGSTFPLPVEVIPMARSQVARKLVALGGSPEWRQGVVTDNGNVILDVHNFPIMNPPEMEKELNNVAGVVTNGIFALNAANTVIVGTPEGAKIIK

SEQ ID NO: 1118 - protein, 219 aa, Haemophilus somnus
MDQLSMKKMAAQAALQYVKPDSIIGVGSGSTVNCFIEVLGTIKETIKGAVAASKASEELLLRQGIEVFSANDVSGLDIYVDGADEINPQKMMIKGGGAALTREKIVAALAKKFICIVDSSKQVDVLGSTFALPIEVIPMARSQVARKLVALGGSPEYRENVVTDNGNVILDVYNFKIMNPIEMEKELNNVAGVVTNGIFALRSADIVIVGTPEGTKIIE

SEQ ID NO: 1119 - protein, 219 aa, Haemophilus somnus
MDQLSMKKMAAQAALQYVKPDSIIGVGSGSTVNCFIEVLGTIKETIKGAVAASKASEELLLRQGIEVFSANDVSGLDIYVDGADEINPQKMMIKGGGAALTREKIVAALAKKFICIVDSSKQVDVLGSTFALPIEVIPMARSQVARKLVALGGSPEYRENVVTDNGNVILDVYNFKIMNPIEMEKELNNVAGVVTNGIFALRSADIVIVGTPEGTKIIG

SEQ ID NO: 1120 - protein, 219 aa, Pasteurella dagmatis
MDQLEMKKQAAKAALKYVKPDTIVGVGSGSTVNCFIEALGAMKNEIKGAVAASKASEELLRKQGIEVFSANEVSSLDIYVDGADEVNPQKMMIKGGGAALTREKIVAALAKKFICIVDKSKQVDVLGSTFALPVEVIPMARSQVARKLVSLGGSPEYREGVVTDNGNVILDVYNFAIMNPVEMEKELNNVAGVVTNGIFALRAADIIIVGTPEGAKIIE

SEQ ID NO: 1121 - protein, 219 aa, Pasteurella multocida
MDQLEMKKMAAAAALQYVKPDSIIGVGSGSTVNCFIEALGSMRDQIKGAVAASKASEALLAKQGIEVFSANEVSSLDIYVDGADEINPQKMMIKGGGAALTREKIVAALAKKFICIVDTSKQVDVLGSTFALPVEVIPMARSQVARKLVALGGSPEYREGVVTDNGNVILDVYHFAIMNPVEMEKELNNVPGVVTNGIFALRAADIIIVGTPEGAKVIE

SEQ ID NO: 1122 - protein, 219 aa, Haemophilus influenzae
MNQLEMKKLAAQAALQYVKADTIVGVGSGSTVNCFIEALGTIKDKIQGAVAASKESEELLRKQGIEVFNANDVSSLDIYVDGADEINPQKMMIKGGGAALTREKIVAALAKKFICIVDSSKQVDVLGSTFPLPVEVIPMARSQVGRKLVALGGSPEYREDVVTDNGNVILDVHNFSILNPVEMEKELNNVSGVVTNGIFALRGADVVIVGTPEGAKIID

SEQ ID NO: 1123 - protein, 219 aa, Haemophilus influenzae
MNQLEMKKLAAQAALQYVKADTIVGVGSGSTVNCFIEALGTIKDKIQGAVAASKESEELLRKQGIEVFNANDVSSLDIYVDGADEINPQKMMIKGGGAALTREKIVAALAKKFICIVDSSKQVDVLGSTFPLPVEVIPMARSQVGRKLVALGGSPEYREDVVTDNGNVILDVHNFSILNPVEMEKELNNVAGVVTNGIFALRGADVVIVGTPEGAKVID

SEQ ID NO: 1124 - protein, 219 aa, Haemophilus influenzae
MNQLEMKKLAAQAALQYVKADTIVGVGSGSTVNCFIEALGTIKDKIQGAVAASKESEELLRKQGIEVFNANDVSSLDIYVDGADEINPQKMMIKGGGAALTREKIVAALAKKFICIVDSSKQVDVLGSTFPLPVEVIPMARSQVGRKLAALGGSPEYREGVVTDNGNVILDVHNFSILNPVEIEKELNNVAGVVTNGIFALRGADVVIVGTPEGAKVID

SEQ ID NO: 1125 - protein, 219 aa, Haemophilus influenzae
MNQLEMKKLAAQAALQYVKADTIVGVGSGSTVNCFIEALGTIKDKIQGAVAASKESEELLRKQGIEVFNANDVSSLDIYVDGADEINPQKMMIKGGGAALTREKIVAALAKKFICIVDSSKQVDVLGSTFPLPVEVIPMARSQVGRKLAALGGSPEYREGVVTDNGNVILDVHNFSILNPVEMEKELNNVAGVVTNGIFALRGADVVIVGTPEGAKVID

SEQ ID NO: 1126 - protein, 219 aa, Haemophilus influenzae
MNQLEMKKLAAQAALQYVKADTIVGVGSGSTVNCFIEALGTIKDKIQGAVAASKESEELLRKQGIEVFNANDVSSLDIYVDGADEINPQKMMIKGGGAALTREKIVAALAKKFICIVDSSKQVDVLGSTFPLPVEVIPMARSQVGRKLAALGGSPEYREGGVTDNGNVILDVHNFSILNPVEMEKELNNVAGIVTNGIFALRGADVVIVGTPEGAKIID

SEQ ID NO: 1127 - protein, 219 aa, Haemophilus influenzae
MNQLEMKKLAAQAALQYVKADTIVGVGSGSTVNCFIEALGTIKDKIQGTVAASKESEELLRKQGIEVFNANDVSSLDIYVDGADEINPQKMMIKGGGAALTREKIVTALAKKFICIVDSSKQVDVLGSTFPLPVEVIPMARSQVGRKLAALGGAPEYREGVVTDNGNVILDVHNFSILNPVEMEKELNNVAGIVTNGIFALRGADVVIVGTPEGAKVID

SEQ ID NO: 1128 - protein, 219 aa, Haemophilus influenzae
MNQLEMKKLAAQAALQYVKADTIVGVGSGSTVNCFIEALGTIKNKIQGAVAASKESEELLRKQGIEVFSANDVSSLDIYVDGADEINPQKMMIKGGGAALTREKIVAALAKKFICIVDSSKQVDVLGSTFPLPVEVIPMARSQVGRKLAALGGAPEYREGVVTDNGNVILDVHNFSILNPVEMEKELNNVAGIVTNGIFALRGADVVIVGTPEGAKIID

SEQ ID NO: 1129 - protein, 219 aa, Haemophilus influenzae
MNQLEMKKLAAQAALKYVKADTIVGVGSGSTVNCFIEALGTIKDKIQGAVAASKASEELLRKQGIEVFNANDVSSLDIYVDGADEINPQKMMIKGGGAALTREKIVAALAKKFICIVDSSKQVDVLGSTFPLPVEVIPMARSQVGRKLAALGGSPEYREGVVTDNGNVILDVHNFSILNPVEMEKELNNVAGIVTNGIFALRGADVVIVGTPEGAKIID

SEQ ID NO: 1130 - protein, 219 aa, Haemophilus influenzae
MDQLEMKKLAAQAALEYVKADTIVGVGSGSTVNCFIEALGTIKNKIQGAVAASKASEELLRKQGIEVFNANDVSSLDIYVDGADEINPQKMMIKGGGAALTREKIVAALAKKFICIVDSSKQVDVLGSTFPLPVEVIPMARSQVGRKLVALGGAPEYREGVVTDNGNVILDVHNFSILNPVEMEKELNNVAGVATNGIFALRGADVVIVGTPEGAKIID

SEQ ID NO: 1131 - protein, 219 aa, Haemophilus influenzae
MNQLEMKKLAAQAALEYVTADTIVGVGSGSTVNCFIEALGTIKNKIQGVVAASKASEELLRKQGIEVFNANDVSSLDIYVDGADEINPQKMMIKGGGAALTREKIVAALAKKFICIVDSSKQVDVLGSTFPLPVEVIPMARSQVGRKLVALGGAPEYREGVVTDNGNVILDVHNFSILNPVEMEKELNNVAGVVTNGIFALRGADVVIVGTPEGAKIID

SEQ ID NO: 1132 - protein, 219 aa, Haemophilus parasuis
MDQLEMKKIAARAALQYVKPDTIVGVGSGSTVNCFIDALGEMAGDIKGAVAASKASEERLRALGIEVFSANEVTELDVYIDGADEITPQGYMIKGGGAALTREKIVSSLAKKFICIVDASKQVDVLGSTFALPVEVIPMARSYVARQLVALGGSPEYRESVVTDNGNVILDVYNFKIFEPLKMEHTINNIAGVVTNGIFAQRYANVTIVGTPDGAKIIE

SEQ ID NO: 1133 - protein, 219 aa, Haemophilus parasuis
MDQLEMKKIAARAALQYVKPDTIVGVGSGSTVNCFIDALGEMADKIKGAVAASKASEERLRALGIEVFSANEVTELDVYIDGADEITPQGYMIKGGGAALTREKIVSSLAKKFICIVDASKQVDVLGSTFALPVEVIPMARSYVARQLVALGGSPEYRESVVTDNGNVILDVYNFKIFEPLKMEHTINNIAGVVTNGIFAQRYANVTIVGTPDGAKIIE

SEQ ID NO: 1134 - protein, 219 aa, Mannheimia haemolytica serotype A2 str. BOVINE
MDQQEMKKIAAQAALKFVKSDTIVGVGSGSTVNCFIDALASMKDEIKGAVAASKASEQRLRDIGIEVFSANEVTELDVYIDGADEITPQGAMIKGGGAALTREKIVSSLAKKFICIVDKSKQVDVLGSTFPLPVEVIPMARSYVARQLVALGGSPEYREGVVTDNGNVILDVHNFKIMEPLKMEHTINNIAGVVTNGIFAQRFANVTIVGTPEGAVILE

SEQ ID NO: 1135 - protein, 219 aa, Mannheimia haemolytica PHL213
MDQQEMKKIAAQAALKFVKPDTIVGVGSGSTVNCFIDALASMKDEIKGAVAASKASEQRLRDIGIEVFSANEVTELDVYIDGADEITPQGAMIKGGGAALTREKIVSSLAKKFICIVDKSKQVDVLGSTFPLPVEVIPMARSYVARQLVALGGSPEYREGVVTDNGNVILDVHNFKIMEPLKMEHTINNIAGVVTNGIFAQRFANVTIVGTPEGAVILE

SEQ ID NO: 1136 - protein, 219 aa, Actinobacillus minor
MNQQEMKKIAAKAALKFVTPDTIVGVGSGSTVNCFIDELASMKDQIKGAVAASKASEERLKALGIEVFSANEVSELDVYIDGADEITPQGYMIKGGGAALTREKIVSSLAKKFVCIVDSSKQVDVLGSTFPLPVEVIPMARSYVARQLVALGGSPEYREGVVTDNGNVILDVHNFKILEPLKMEHTINNIAGVVTNGIFAQRFANVTIVGTPEGAKILE

SEQ ID NO: 1137 - protein, 219 aa, Actinobacillus minor
MNQQEMKKIAAKAALKFVTPDTIVGVGSGSTVNCFIDELASMKDQIKGAVAASKASEERLKALGIEVFSANEVSELDVYIDGADEITPQGYMIKGGGAALTREKIVSSLAKKFVCIVDSSKQVDVLGSIFPLPVEVIPMARSYVARQLVALGGSPEYREGVVTDNGNVILDVHNFKILEPLKMEHTINNIAGVVTNGIFAQRFANVTIVGTPEGAKILE

SEQ ID NO: 1138 - protein, 219 aa, Actinobacillus pleuropneumoniae
MTQQEMKKIAAQAALQFVKPDTIVGVGSGSTVNCFIDALASMKDQIKGAVAASKASEERLRAIGIEVFNANEVSELDVYIDGADEITPQGAMIKGGGAALTREKIVSSLAKKFVCIVDGSKQVDVLGTTFPLPVEVIPMARSYVARQLVALGGSPEYREGVVTDNGNVILDVHNFHIIEPLKMEHTINNIAGVVTNGIFAQRYANVTIVGTPEGAKIIE

SEQ ID NO: 1139 - protein, 219 aa, Actinobacillus pleuropneumoniae
MTQQEMKKIAAQAALQFVKPDTIVGVGSGSTVNCFIDALASMKDQIKGAVAASKASEGRLRAIGIEVFNANEVSELDVYIDGADEITPQGAMIKGGGAALTREKIVSSLAKKFVCIVDGSKQVDVLGTTFPLPVEVIPMARSYVARQLVALGGSPEYREGVVTDNGNVILDVHNFHIIEPLKMEHTINNIAGVVTNGIFAQRYANVTIVGTPEGAKIIE

SEQ ID NO: 1140 - protein, 219 aa, Haemophilus ducreyi
MTQQEMKKIAAQAALQFVKPDTIIGVGSGSTVNCFIDALASIKDEIKGAVAASKASEDQLRAMGIEVFNANEVAGLDVYIDGADEITPQGAMIKGGGAALTREKIVSSLAKQFICMVDSSKQVDVLGSSFPLPVEVIPMARSYVARQLVALGGSPEYREGVVTDNGNVILDVHNFNIYEPLKMEHTINNIAGVVTNGIFAQRYANIIIVGTAEGAKIIK

SEQ ID NO: 1141 - protein, 219 aa, Tolumonas auensis
MTQDEMKKAVGQAALAYVQPNTIIGVGTGSTVNCFIDALASIKDQIKAAVSSSEASTARLQALGITVVDLNDVTEFDIYVDGADEINPHMEMIKGGGAALTREKIVAAVAKRFICIADATKQVEVMGKFPLPVEVIPLAREYVARELRKLGGNPVYREGVITDNQCQILDVHGLQITNAKALELVINQIPGVVTVGLFAQRGADVALIGSPDGVTTITK

SEQ ID NO: 1142 - protein, 224 aa, Pseudomonas putida
MTQDQLKQAVAQAAVDFILPKLDEKSVVGVGTGSTANFFIDALAQHKTAFDGAVASSEATAQRLKGHGIPVYELNSVSELEFYVDGADESDAHLHLIKGGGAALTREKIVAAVAKTFICIADGSKLVPVLGAFPLPVEVIPMARSHVARQLVKLGGDPVYREGVVTDNGNVILDVYNLQITNPVELEAQINAIVGVVTNGLFAARPADLLLLGTAEGVKSLKAE

SEQ ID NO: 1143 - protein, 224 aa, Pseudomonas putida
MTQDQLKQAVAQAAVDFILPKLDEKSVVGVGTGSTANFFIDALAQHKTAFDGAVASSEATAQRLKGHGIPVYELNSVSELEFYVDGADESDAHLNLIKGGGAALTREKIVAAVAKTFICIADGSKLVPVLGAFPLPVEVIPMARSHVARQLVKLGGDPVYREGVVTDNGNVILDVHNLQITNPVELEAQINAIVGVVTNGLFAARPADLLLLGTSEGVKSLKAE

SEQ ID NO: 1144 - protein, 224 aa, Pseudomonas putida
MTQDQLKQAVAQAAVDFILPKLDEKSVVGVGTGSTANFFIDALAQHKTAFDGAVASSEATAQRLKGHGIPVYELNSVSELEFYVDGADESDAHLNLIKGGGAALTREKIVAAVAKTFICIADASKLVPVLGAFPLPVEVIPMARSHVARQLVKLGGDPVYREGVVTDNGNVILDVYNLQITNPVELEAQINAIVGVVTNGLFAARPADLLLLGTPEGVKSLKAE

SEQ ID NO: 1145 - protein, 224 aa, Pseudomonas entomophila L48
MTQDQLKQAVAQAAVDLILPKLDEKSVVGVGTGSTANFFIDALAQHKTAFDGAVASSEATAQRLKGHGIPVYELNSVSELEFYVDGADESDAHLNLIKGGGAALTREKIVAAVAKTFICIADASKLVPVLGAFPLPVEVIPMARSHVARQLVKLGGDPVYREGVVTDNGNVILDVHNLQITNPVELESQINAIVGVVTNGLFAARPADVLLLGTAEGVKTLKAE

SEQ ID NO: 1146 - protein, 223 aa, Pseudomonas fluorescens
MTQDQLKQAVAQAAVDLILPKLDDKSIVGVGTGSTANCFIDALAQHKGAFDGAVASSEATAARLKGHGIPVYELNTVSDLEFYVDGADESDEHLNLIKGGGAALTREKIVAAVAKTFICIADASKLVPVLGAFPLPVEVIPMARSHVARELVKLGGDPVYREGVLTDNGNIIIDVFNLQITNPVELETQINAIVGVVTNGLFAARPADVLLLGTSEGVKTLKA

SEQ ID NO: 1147 - protein, 224 aa, Pseudomonas fluorescens
MTQDQLKQAVAQAAVDFILPKLDDKSIVGVGTGSTANCFIDALAQHKGAFDGAVASSEATAARLKGHGIPVYELNTVSNLEFYVDGADESDEHLNLIKGGGAALTREKIVAAVAQTFICIADASKLVPVLGAFPLPVEVIPMARSHVARQLVKLGGDPVYREGVLTDNGNIILDVHNLQITNPVELEAQINAIVGVVTNGLFAARPADLLLLGTSEGVKTLKAE

SEQ ID NO: 1148 - protein, 223 aa, Pseudomonas fluorescens
MTQDQLKQAVAQAAVDLILPKLDDKSIVGVGTGSTANCFIDALALHKGTFDGAVASSEATAARLKGHGIPVYELNTVSDLEFYIDGADESDEHLNLIKGGGAALTREKIVAAVAKTFICIADASKLVPVLGNFPLPVEVIPMARSHVARELVKLGGDPVYREGVITDNGNIILDVHNMQITNPVELESQINAIVGVVTNGLFAARPADVLLLGTAEGVKTLKA

SEQ ID NO: 1149 - protein, 223 aa, Pseudomonas syringae
MTQDQLKQAVAQAAVDFILPKLDDKSIVGVGTGSTANCFIDALAKHKAAFDGAVASSEATAARLKGHGIPVYELNTVSDLEFYVDGADESDEHLNLIKGGGAALTREKIVAAVAKTFICIADGSKLVPVLGAFPLPVEVIPMARSHVARQLVKLGGDPVYREGVLTDNGNIIIDVHNMSITNPVELEAQINAIVGVVTNGLFAARPADLLLLGTTEGVKTLTR

SEQ ID NO: 1150 - protein, 223 aa, Pseudomonas syringae
MTQDQLKQAVAQAAVDFILPKLDDKSIVGVGTGSTANCFIDALAKHKAAFDGTVASSEATAARLKGHGIPVYELNTVSDLEFYVDGADESDEHLNLIKGGGAALTREKIVAAVAKTFICIADGSKLVPVLGAFPLPVEVIPMARSHVARQLVKLGGDPVYREGVLTDNGNIIIDVHNMSITNPVELEAQINAIVGVVTNGLFAARPADLLLLGTTEGVKTLTR

SEQ ID NO: 1151 - protein, 223 aa, Pseudomonas syringae
MTQDQLKQAVAQAAVDFILPKLDDKSIVGVGTGSTANCFIDALAKHKGAFDGAVASSEATAARLKGHGIPVYELNTVSDLEFYVDGADESDEHLNLIKGGGAALTREKIVAAVAKTFICIADGSKLVPVLGAFPLPVEVVPMARSHVARQLVKLGGDPVYREGVLTDNGNIIIDVHNMSITNPVELEASINAIVGVVTNGLFAARPADLLLLGTAEGVKTLTR

SEQ ID NO: 1152 - protein, 223 aa, Pseudomonas syringae
MTQDQLKQAVAQAAVDFILPKLDDKSIVGVGTGSTANCFIDALAKHKAAFDGAVASSEATAARLKGHGIPVYELNTVSDLEFYVDGADESDEHLNLIKGGGAALTREKIVAAVAKTFICIADGSKLVPVLGAFPLPVEVIPMARSHVARQLVKLGGDPVYREGVLTDNGNIIIDVHNMSITNPVELEASINAIVGVVTNGLFAARPADLLLLGTDEGVKTLKR

SEQ ID NO: 1153 - protein, 223 aa, Pseudomonas syringae
MTQDQLKQAVAQAAVDFILPKLDDKSIVGVGTGSTANCFIDALAKHKAAFDGAVASSQATAARLKAHGIPVYELNTVSDLEFYVDGADESDEHLNLIKGGGAALTREKIVAAVANTFICIADGSKLVPVLGAFPLPVEVIPMARSHVARQLVKLGGDPVYREGVLTDNGNIIIDVHNMSITNPVELEAQINAIVGVVTNGLFAARPADLLLLGTAEGVKTLTR

SEQ ID NO: 1154 - protein, 237 aa, Pseudomonas mendocina
MDGYNCAFPVRQNSMTQDQLKQAVAQAAVDHILPRLDSKSIVGVGTGSTANFFIDALARHKMDFDGAVASSEATAARLKGHGIPVYDLNSVSELEFYVDGADESDERLHLIKGGGAALTREKIVAAVAKTFICIADASKLVPVLGAFPLPVEVIPMARSHVARELVKLGGDPVYREGVLTDNGNVILDVHNLSITDPVKLEADINAIVGVVTNGLFAARPADLLLLGTAEGVKTLKR

SEQ ID NO: 1155 - protein, 224 aa, artificial sequence
  synthetic construct
MNQDQLKQAVAQAAVDHILPHLDSKSIVGVGTGSTANFFIDALARHKAEFDGAVASSEATAKRLKEHGIPVYELNTVSELEFYVDGADESNERLELIKGGGAALTREKIVAAVAKTFICIADASKLVPILGQFPLPVEVIPMARSHVARQLVKLGGDPVYREGVLTDNGNIILDVHNLRIDSPVELEEKINAIVGVVTNGLFAARPADLLLLGTADGVKTLKAG

SEQ ID NO: 1156 - protein, 223 aa, Pseudomonas aeruginosa
MNQDQLKQAVAQAAVDHILPHLDSKSIVGVGTGSTANFFIDALARHKAEFDGAVASSEATAKRLKEHGIPVYELNTVSELEFYVDGADESNERLELIKGGGAALTREKIVAAVAKTFICIADASKLVPILGQFPLPVEVIPMARSHVARQLVKLGGDPVYREGVLTDNGNIILDVHNLRIDSPVELEEKINAIVGVVTNGLFAARPADLLLLGTADGVKTLKA

SEQ ID NO: 1157 - protein, 223 aa, Pseudomonas aeruginosa
MNQDQLKQAVAQAAVDHILPHLDSKSIVGVGTGSTANFFIDALARHKAEFDGAVASSEATAKRLKEHGIPVYELNTVSELEFYVDGADESNERLELIKGGGAALTREKIVAAVARTFICIADASKLVPILGQFPLPVEVIPMARSHVARQLVKLGGDPVYREGVLTDNGNIILDVHNLRIDSPVELEEKINAIVGVVTNGLFAARPADLLLLGTADGVQTLKA

SEQ ID NO: 1158 - protein, 223 aa, Pseudomonas stutzeri
MTQDQLKQAVAQAAVDHILPKLNDRSIVGVGTGSTANFFIDLLAKHKGFFDGAVASSEATAERLKQHGIPVYDLNSVSELEFYVDGADEANKHLELIKGGGAALTREKIVAAVAKTFICIADGSKLVEQLGAFPLPVEVIPMARSHVARELVKLGGDPVYRDGVVTDNGNVILDVHNLMIGFAPELEGKINDIVGVVSNGLFAMRPADLLLLGTQDGVQTLTR

SEQ ID NO: 1159 - protein, 226 aa, Azotobacter vinelandii
MTQDQLKQAVAQAALDHILPQLTRQSIIGVGTGSTANFFIDLLARYRMDFDGAVASSEATAARLKGHGIEVHDLNNVVELEFYVDGADECNKHLELIKGGGAALTREKIVAAVARTFICIADESKRVDFLGDFPLPVEVIPMARSHVARQLVMLGGDPVYREGVVTDNGNVILDVYNMQITNPRQLESDINNIVGVVCNGLFAARPADLLLLGTRNGVERIERPRR

SEQ ID NO: 1160 - protein, 224 aa, Azotobacter vinelandii
MIQDQLKQAVAQAALDHILPHLTRQSIVGVGTGSTANFFIDLLARHRMDFDGAVASSEATAARLRSHGIEVHDLNSIAELEFYVDGADECNGHLELTKGGGGALTREKIVAAVAKTFVCIADESKRVDFLGGFPLPVEVIPMARGHVARQLVMLGGNPVHREGVVTDNGNVILDVYDMRIIDPRQLESDINGIVGVVCNGLFAARPADLLLLGTHNGVEKFGRR

SEQ ID NO: 1161 - protein, 224 aa, Marinobacter sp. ELB17
MNQDELKQAVAKSAIDYISPRLNSSSVIGVGTGSTANCFIDFLAAIRNDFDGAVASSEATAERLKSHGIPVYELNSTADLEFYVDGADEVNEQLELIKGGGGALTREKIVAEVAQTFICIADESKKVDILGEFPLPLEVLPMARSHVGREIVKLGGDPVYRDNFTTDNGNIIIDVYNLDLSRPIQVEERLNQIVGVVTNGLFARRPADLLLLGTKTGVRTLKRG

SEQ ID NO: 1162 - protein, 226 aa, Marinobacter algicola DG893
MNQDELKKAVAKAALDHIRPHLDQESVIGVGTGSTANCFIDLLADIRTDFDGAVASSDATAERLKSHGIPVYDLNSAGPLEFYVDGADETNERLELIKGGGGALTREKIVAAVAKTFICIADGSKEVDILGAFPLPVEVVPMARSHVGREIVKLGGDPVYREGFTTDNGNIILDIHNLDISRPIQVEEQLNNIVGIVTNGLFARRPADLLLLGTEDGVKTISRKDG

SEQ ID NO: 1163 - protein, 225 aa, Marinobacter aquaeolei VT8
MTQDELKQAVAKAAVDHIAPHLEPSSIVGVGTGSTANFFIDYLAEYRNDFDGAVASSEATAERLKKHGIPVYDLNAVNEIEFYVDGADETNESLELIKGGGGALTREKIVAAVAKTFICIADESKQVGILGEFPLPVEVIPMARSHVGREIVKLGGDPVYRDGFVTDNGNIIIDIHNMDISRPLVVEEKLNNIVGVVTNGLFARRPADLLLLGTRDGVKSIARGA

SEQ ID NO: 1164 - protein, 225 aa, Oceanobacter sp. RED65
MNQDQLKQAVGQAAVDYIKPHLQKDSIIGVGTGSTANCFIDALAELKNDFDGAVASSEATAERLKSHGIPVYDLNSSGTLDFYIDGADETNDHLQLIKGGGGALTREKIVAACAKEFICIADESKWVDLLGTFPLPVEVIPMARSYVARELVALGGDPVYRQGFVTDNGNVILDVHNMSIQSATALEERINNIVGVVTNGLFACRPADVLLMGTADGVKTIKAKN

SEQ ID NO: 1165 - protein, 225 aa, Hahella chejuensis KCTC 2396
MNQDELKQAVAKAALDYIKPHLQSDTILGIGTGSTANYFIDALAEVRTQFEGAVASSEASAERLKKHNIPVYELNSVSGLEFYIDGADETNPRLELIKGGGAALTREKIVAANAKTFICIADESKWVDVLGDFPLPIEVIPMARSYVARELVKLGGDPVYREGCVTDNGNIILDVFNLRILEPVKLEQQINQITGVVTNGLFAMRPADVLLLGSQEGVKTIKVDA

SEQ ID NO: 1166 - protein, 223 aa, Marinomonas sp. MWYL1
MTQDELKQAVAKAAMAYIQPMLEADTIVGVGTGSTANLFIDELAKHKGLFDGTVASSEASAERLKKHGIPVYDLNSVDSIRVYVDGADESNDNLHLIKGGGAALTREKIVAACSDEFVCIADESKLVKVLGDFPLPVEIIPMARGHVARELVKLGGDPVYREGVVTDNGNHILDVYNLEILDPIALEKSIDGIVGVVTNGLFAKRSADVLLLATKEGIKTLKK

SEQ ID NO: 1167 - protein, 223 aa, Marinomonas sp. MED121
MTQDELKLAVAKAAVEYILPLLEDDTIVGVGTGSTANLFIDELAQHKLKFEATVASSEASAERLKSHGIPVYDLNSVADIAVYVDGADESNNHLHLIKGGGAALTREKIVAAVSKQFVCIADQSKLVNVLGDFPLPVEVIPMSRSYVARELVKLGGDPVYREGVVTDNGNQILDVYNLKIEDAVALENKINSLVGVVTNGLFASRPADVLLLGTEEGVKTLKA

SEQ ID NO: 1168 - protein, 230 aa, Congregibacter litoralis KT71
MDQDSLKLKVARAALDIVQPGLESGTVLGIGTGSTANMFIDLLGEVAHLFDGAVASSEASAERLKSHNIPVYDLNAVDRISVYVDGADECNEALQLIKGGGAALTREKIVAAVAKEFICIADESKWVPVLGAFPLPVEVIPMARSHVAREIVKLGGDPILREGVVTDNGNVILDVYNFSIAQPLAMEARINGIVGVVCNGLFALRPADRLLLGTADGVRDLRRPASSLDS

SEQ ID NO: 1169 - protein, 230 aa, unknown
  Gamma proteobacterium NOR-3
MDQDSLKLSVAKAALDIIVPQLEPDTILGIGTGSTANMFIDLLADVAHLFDGAVASSQASAERLKSHNIPVYDLNAVNQVAVYIDGADECNEALELIKGGGAALTREKIVAAVAREFICIADGSKWVHTLGEFPLPVEVIPMARSHVARELVKLGGDPVLREGVVTDNGNVILDIYNFAIPQPLATEAKINGIVGVVCNGLFALRPADRLLLGTAEGVRDIKRPESFLDS

SEQ ID NO: 1170 - protein, 247 aa, unknown
  Marine gamma proteobacterium HTCC2148
MLSVTGRWPILVSHHRTRSIEPMNQDELKQAVAQAALDYVRPKIDDDTVLGIGTGSTANLFIDCLAEIRGSINATVASSEASAERLKAHGIPVYDLNAVDQVDFYIDGADESNSALQLIKGGGAALTREKIVTAVAREFICIADESKLVHTLGEFPLPVEVVPMARSHVARELVKLGGDPVYRDGVVTDNGNIILDVYNFAIPQPLATEAKINGITGVVTNGLFALKPADVLLLGTAEGVKTLYPVA

SEQ ID NO: 1171 - protein, 225 aa, Teredinibacter turnerae
MNQQELKQAVAQAAVDYILPKLESDTILGIGTGSTAALFIDALAQHKGLFQGAVSSSEASARQLEGHGIPVYDLNEVDRLVAYVDGADEANARLQLIKGGGAALTREKIVTACADEFVCIADESKWVPVLGKFPLPVEVIPMARSFVARELVKMGGSPEHRHGCTTDNGNHILDVHGLEIHQPAELESAINQIPGVVTNGLFALRPADVLLLGTNDGVKTLYPHS

SEQ ID NO: 1172 - protein, 226 aa, Saccharophagus degradans 2-40
MTQDELKQAVAQAALDYILPHLEDDMILGIGTGSTARLFIDLLAAHKGKFDGAVSSSEASSEQLKGHGIPVYDLNSVDSLPFYIDGADEANAQLHLIKGGGAALTREKIITAVADKFICIADASKDVDVLGKFPLPVEVIPMARAHVAREIVKLGGNPVHRQDCVTDNGCQILDVYDLAIHDAPALEAKLNNIAGVVTNGLFALRPADVLLLGTTNGVETRFAAKP

SEQ ID NO: 1173 - protein, 225 aa, Cellvibrio japonicus Ueda107
MSPQDQLKHAVARAAIEYIKPKLTPDAVLGIGTGSTANFFIDMLGELKYDFAAAVASSDASAQRLQTLGIEVLDCNAVSELLVYVDGADESNPNLHLIKGGGAALTREKIVCAVAREFVCIADESKWVDILGRFPLPVEVIPMARSFVARELVKLGGAPVYREGVITDNGNVILDVHNLQILNPVELETKINQITGVVANGLFAIKPADVLLLGTKEGVKVIRPQ

SEQ ID NO: 1174 - protein, 226 aa, unknown
  Marine gamma proteobacterium HTCC2207
MDQNQLKLAVAAAAVEYTLSKINPDSIVGIGTGSTANCFIDLLAEHKNSFQAAVASSDASAERLRGHGIEVIELNAAAEITIYIDGADEANPHLELIKGGGAALTREKIVTAVANEFVCIADESKWVDFLGQFPLPVEVIPMARSHVARELVKLGGDPVWRENVITDNGNQILDVHHLYPVASAQALEEKINQITGVVTNGFFALKAADVLFLATQQGIVTHYPKA

SEQ ID NO: 1175 - protein, 224 aa, unknown
  Marine gamma proteobacterium HTCC2143
MTQDDLKKAVARAALDYIKPKIENDSVIGIGTGSTANYFIDYLAEIKSHINATVASSEASADRLRKHGIPVFELTSVNEITVYVDGADESDPNLALIKGGGAALTREKIVAASAREFVCIADESKCVAQLGNFPLPVEVIPMARSFVARELVKMGGDPVYREGVVTDNGNIIIDVFNFMIPNPIETEQHINNITGVVTNGIFAQRPADILLVATSEGIKTLHKA

SEQ ID NO: 1176 - protein, 223 aa, unknown
  gamma proteobacterium NOR51-B
MDKAQLKAQVAAAAIERVAALHNDDLVLGIGTGSTAEAFIQLLGPLRARIDTTVSSSERSSTLLREMNIPVSDLNAVGEVDIYVDGADEANADLQLIKGGGAALTREKIVAGASRQFICIADESKLVPTLGAFPLPVEVIPMARSYVARQIVALGGQPVWREDVVTDNGNVILDVFNLLIDQPLTLEGQLNDIPGVVCNGLFALRAADELLLGTPDGVRSLTR

SEQ ID NO: 1177 - protein, 224 aa, marine gamma proteobacterium HTCC2080
MDQQGMKEAVALAALEWVKALPGDNLVLGIGTGSTAECFIRLLPAIKQRINITVSSSQRSAALLQELQIPLGDLNDVGQLDAYIDGADEANQRLQLIKGGGAALTREKIIAAAAKRFLCIADASKKVATLGAFPLPVEVIPMARSFVARELVKLGGQPIWRDGVVTDNGNVILDVHGLSIDHALETEEAINHITGVVCSGLFARRPADVLMLGTPQGVETLQAN

SEQ ID NO: 1178 - protein, 220 aa, Nitrosococcus oceani ATCC 19707
MSPDEMKKLAAKAALEHVEPGTIVGTGTGSTVNHFIDLLGTIKGKIEGAVSSSEASTARLKALNIPVYELNAVGEIPLYIDGADESNHYLQLIKGGGGALTREKIIAAASKKFVCIADQSKLVDILGTFPLPVEVIPMARSYVARQIVKLGGEPVYREGFITDNGNQILDTHGLSIMEPAKLEGQLNNIPGVVTNGLFAIYPADVLILGSPEGVKTIYPK

SEQ ID NO: 1179 - protein, 222 aa, Idiomarina baltica OS145
MSASDKLKQQAAQAAIKYVEKGAIVGVGTGSTVNFFIDELAKIKDDIEGAVSSSDASTERLKQHGIEVFELNNAPEVPVYIDGADEIDEHGQMIKGGGAALTREKIVAAVAKKFVCIADESKLVGRLGTFPLPVEVIPMARSYVAREIVKLGGDPVWRQGVTTDNGNWILDVHNFDILNAVELEEQLNNVVGVVTNGLFAARSADVALLATSEGVKELTWGN

SEQ ID NO: 1180 - protein, 223 aa, Idiomarina loihiensis L2TR
MSGNADALKKAAAEAAMQYIEDGTVVGVGTGSTVNFFIDALAERKHDIEGAVSSSEASTERLKSHGIEVFELNSVVEVPIYVDGADEITEHGQMVKGGGGALTREKIIAAVARKFVCVADESKMVGRLGQFPVPVEVIPMARSYVAREIVKLGGDPVWRQGFTTDNGNWILDVHNFDIMEPMKLEAELNNIVGVVTNGLFAQRGADIALIAREDGVQTLKVSG

SEQ ID NO: 1181 - protein, 220 aa, Halothiobacillus neapolitanus c2
MTPQDQLKQQAAKAALQYVQTGSIVGVGTGSTVNFFIDELATIKHKIEGAVSSSEASTKRLRAHGIEVFDLNGVGDIPVYIDGADETNANLQLIKGGGGALTREKIIAHMAKKFVCVADETKLVPRLGKFPLPIEVIPMARSMVARELVKRGGQPVYRDGFVTDNGNQILDIHNMDIMEPAKLEAELNNIPGIVTVGLFALRPADVLILAAAEGVRTLTI

SEQ ID NO: 1182 - protein, 221 aa, Alkalilimnicola ehrlichii MLHE-1
MMSADQGKRMAAEAAMEYVEENTVIGVGTGSTVNFFIDALADMKARIDGTVSSSEASTARLRQYGIPVLDLNEVGTMPIYVDGADESNRFLQLIKGGGGALTREKIVAAAAERFVCVADESKLVDVLGEFPLPVEVIPMARSYVARELVKLGGRPQLRSGFTTDNGNVILDVRGLKIMEPIKLEQQINNIPGVVTNGLFALRPADVLLLGTAEGVRKLTAE

SEQ ID NO: 1183 - protein, 219 aa, Halorhodospira halophila SL1
MSDQGKRLAAEAALEYVEEDAYVGVGTGSTVNLFIDALADMRDRIAGAVSSSEASTQRLRDRGIDVIDLNSAGRLPVYVDGADEANRFLQLIKGGGGALTREKIVASASDRFVCVADDGKMVDVLGAFPLPVEVIPMARSTVARELVRLGGRPELREGFTTDNGNVILDVHGLSITEPIKLEQTLNNIPGVVTNGIFALRPADLLLLGSDSGVRRLKAE

SEQ ID NO: 1184 - protein, 220 aa, Nitrococcus mobilis
MASDQQKKAAAEAALSHLQHANIVGIGTGSTVNFFIDALTSIKGSIDAVVSSSEASTERLRRHGFEVRELNAVDEIPVYVDGADEINRYLQMIKGGGGALTREKIIAAVSRRFICIADASKRVDVLGGFPLPVEVIPMARSYVAREMVKLGGWPALREGFATDNGNLILDVRNLQIMEPSHMEQTINNIPGVVTVGIFALRPADMLLLGTDQGVETLTAA

SEQ ID NO: 1185 - protein, 220 aa, Methylophaga thiooxidans DMS010
MNADEMKKQAAWAALEYIKGDGIVGVGTGSTVNHFIDALATIKGRIEGAVSSSEASTKKMQELGIKVFDLNECNEIEVYVDGADEANSLLELVKGGGGALTREKIIAAASKQFVCIVDATKQVDILGKFPLPVEVIPMARSYVAREIVKLGGQPVYREGVITDNGNVILDVHGMDIMEPIKLEKTLNDIVGVVTNGLFAMRPADVLLVGSEDGTQTVHAK

SEQ ID NO: 1186 - protein, 217 aa, Alcanivorax sp. DG881
MDQDALKKQVAEAALRFVPEGEIIGVGTGSTANFFIDGLASLKDRIKGAVASSEATAERLKQHGIEVFSLNDVGNLSVYVDGADEVNSHREMIKGGGGALTREKIVAAAAREFICIVDASKQVKRLGAFPLPVEVIPMARSYVARKLVALGGQPEYREGFVTDNGNIILDVHNLDITNPIELETTLNNIVGVVTNGLFAKRPADVVLVGENGTVNQY

SEQ ID NO: 1187 - protein, 218 aa, Alcanivorax borkumensis SK2
MDQDVLKKQVAEAALRFVPEGDIIGVGTGSTANFFIDALATLKDRIKGTVASSEATAERLKQHGIEVFSLNDVGSLSVYVDGADEVNQHREMIKGGGGALTREKIVAAMAKEFICIVDGSKQVNRLGAFPLPIEVIPMARSYVARKLVALGGQPQYREGFLTDNGNIILDVHNLDISNPIELETTLNNIVGVVTNGLFAKRPADIVLVGEKSGAVNQY

SEQ ID NO: 1188 - protein, 219 aa, Lutiella nitroferrum 2002
MLTQNQLKLAVAQKALEFVPDNCIVGVGTGSTVNLFIEELATIKGRIKGAVSSSEASTERLKAHHIPVYDLNTVDEVPVYIDGADEVNHYLHMIKGGGGALTREKIVGAVANEFICIADETKYVDVLGGFPLPVEVVPMARSYVARELVKLGGHPELREHFVTDNGNIILDVYRLHISKPVELEETINQIAGVVTCGLFARRRADVLILGRQSGIEVLR

SEQ ID NO: 1189 - protein, 219 aa, Chromobacterium violaceum
MLTQDQLKLAVAKKALEFVPEDAIIGVGTGSTVNLFIEELAGIKGRIKGAVSSSEASTARLKAHHIQVFDLNEVEKLSVYIDGADEINHHLHMIKGGGAALTREKIVAGVADEFICIADEKKYVTMLGAFPLPIEVIPMARSYVARELVKLGGHPELRQGVTTDNGNVILDVHGLQIMKPVELEETINHIAGVVTCGLFARRRADVLLLGKQDGVEVLR

SEQ ID NO: 1190 - protein, 220 aa, Laribacter hongkongensis HLHK9
MNEQDKMKAAAARKAIDYVPEGAIIGVGTGSTANFFIDELARIKDRIEGAVASSQATADRLKAIGIQVFDLNGVGELPVYVDGCDEINHYLHMIKGGGGALTREKIVATSSRQFICIADESKLVKRLGAFPLPVEVIPMARSLVARKLVKLGGHPEWRENFVTDNGNLILDVHDLAIDQPLEMEETINRMAGVVTCGLFARRRADVLLLGRSDGTVQTIE

SEQ ID NO: 1191 - protein, 241 aa, Nitrosomonas eutropha
MRKRSESFSMRALFQEPIIKIIMTQDEQKQAVAQAALQYVQVGEIIGIGTGSTTNLFIDELAKIKHKIEGAVASSEATAARLKQHGIEVLSLNSVADLPVYIDGADEITRNMHMIKGGGGALTREKIIAAVARKFICIADQSKLVKVLGKFPLPVEVIPMARSYVAREIALLGGQPAWRQDFTTDNGNVILDIHNLNIMNPVELESTLNQITGVVTNGLFARRGADVLLMGTDQGVETITI

SEQ ID NO: 1192 - protein, 219 aa, Nitrosomonas europaea
MTQDEQKRAVAQAALQYVPTGEIIGIGTGSTANLFIDELAKIKHRIEGAVASSEVTANRLKQHGIEVLDLNSVGELPVYIDGADEITRNMHMIKGGGGALTREKIVAAVARKFICIADQSKLVKVLGKFPLPVEVIPMARSYVAREITLLGGQPAWRQGFTTDNGNIILDVHNLNIMNPVELETALNQIAGVVTNGLFARRAANVLLMGTDQGVETITV

SEQ ID NO: 1193 - protein, 219 aa, Nitrosomonas sp. AL212
MTQDEQKRAAAVAAIQYIPVDCIVGVGTGSTANYFIDELAKIKHKIEGAVASSDATAQRLKEHGIEVHDLNNVIDIPVYVDGADEITENLHMIKGGGGALTREKIVAAVAQKFICITDQSKLVNILGNFPLPVEVIPMARSYVAREIVHLGGHPALRHDFVTDNGNIILDVHGLQIMKPIELETTLNQIAGVVTNGLFARRGADTLLLGTDNDIRVISI

SEQ ID NO: 1194 - protein, 219 aa, Nitrosospira multiformis ATCC 25196
MNQDEQKRAAAHAAIQHIPAGCIVGVGTGSTANYFIDALAGIRSRIDGAVASSEATARRLSAHGIEVMDLNNVDELPLYVDGADEITPHLHMIKGGGGALTREKIVAAVAKKFICIADQSKLVDVLGKFPLPVEVIPMARGHVAREIVRLGGQPMLRQGFTTDNGNVILDVHALQILNPIELETELNQITGIVTNGLFARRPADLLLLGDEGGIRTIAI

SEQ ID NO: 1195 - protein, 221 aa, Sideroxydans lithotrophicus ES-1
MALTQDDMKRAVAQAAIAYVPNDCIVGVGTGSTANFFIDELARIKNKIRGAVASSEASAKRLQGHGIEVLSLNDAGDLPVYVDGADEITRHMHMVKGGGGALTREKIVAAASQKFICVCDASKLVDVLGKFPLPIEVIPMARSYIARELVKLGGQPKLREGFTTDNGNVILDVHNLQIMNPVELETTLNQLAGVVTNGLFARRGADVLLLGTPDGVRTLTA

SEQ ID NO: 1196 - protein, 221 aa, Gallionella ferruginea
MMNQDDLKRAVALAAIQYVPADCIVGVGTGSTANFFIDELAKIKNKIRGAVASSEASAKRLQGHGIEVMSLNEAGALEVYVDGADEITRHMHMLKGGGGALTREKIVAGASRKFICLCDASKLVDVLGKFPLPIEVIPMARSSVARQLVALGGQPMLREGFTTDNGNIIIDVHGLKIMNPVELESELDHIAGVVTNGLFARRAADVLLLGTADGVKTMTVS

SEQ ID NO: 1197 - protein, 219 aa, Methylotenera mobilis JLW8
MAFTQDELKQQVAKAAVEYVKSGIIGVGTGSTANFFIEELAKVKHKIDGAVASSEATAQRLRGHGIEVFDLNSVDNLEIYVDGADEITEHMHMLKGGGGALTREKIVAAVAKKFICICDATKYVPVLGKFPLPVEVLPMAKSHVARELVKLGGQPQLRDFTTDNGNLILDVHGLTITDPVAMEAKINQIVGVVTNGLFAARPANVLLLATAEGVKTYQK

SEQ ID NO: 1198 - protein, 218 aa, Methylovorus sp. SIP3-4
MATQDELKQQVAKAAVEYVKGGIIGVGTGSTANFFIDELAKVKSKIDGAVASSEATAQRLRAHGIEVFDLNSVDGMEIYVDGADEITEHMHMLKGGGGALTREKIVAACAKTFICICDASKYVPVLGKFPLPVEVLPMARSHVARELTKLGGQPKLRDFTTDNGNIILDVHGLEILNPVEMEAKINQIVGVVTNGLFAARPADVLLLATPEGVKTYKR

SEQ ID NO: 1199 - protein, 219 aa, unknown
  beta proteobacterium KB13
MAFTQDELKQQVAKAAVGYVESGIIGVGTGSTANFFIDELAKVKHKIDGAVASSEATANRLKDHGIQVFDLNSVDGMEIYVDGADEITEHMHMLKGGGGALTREKIVAANAKDFICICDESKYVDVLGKFPLPVEVLPMARSYVARELAKLGGNPVLRDFTTDNGNVILDVHNLVISDPIAMEAKINQIVGVVTNGLFAARPANTLLLATTEGVKTIKK

SEQ ID NO: 1200 - protein, 219 aa, Methylobacillus flagellatus KT
MATQDELKQQVAKAAIEYVKGGIIGVGTGSTANFFIDELAKVKDRIDGAVASSEATAQRLRGHGIKVFDLNDVDGMEIYVDGADEITEKLHMLKGGGGALTREKIVAACAKDFICICDQTKLVPVLGKFPLPVEVIPMAREYVARELVKLGGQPKLRDFTTDNGNVILDVHGLTITDPVALESRINEIVGVVTNGLFASRPANVLLLATADGVKTLTAR

SEQ ID NO: 1201 - protein, 219 aa, Methylophilales bacterium HTCC2181
MALSQDELKKQVAKAAIEYVESGVIGVGTGSTANYFIDYLAEVKHKIDGAVASSEATAERLRKHGIEVFDLNSVDGMDIYVDGADEITEHMHMLKGGGGALTREKIVAANAKKFICICDESKFVPTLGKFPLPVEVLPMARSYVARQLSALGGQPQLRDFTTDNGNIILDIHGMNIVDPIDTEARINQIVGVVTNGLFAKRAADILLLATDSGVKTLGK

SEQ ID NO: 1202 - protein, 218 aa, Thiobacillus denitrificans
MTQDEMKRAVARAAVDYAKGGIIGVGTGSTANHFIDALAEVKGRIEGTVASSEATAARLKSHGIQVLDLNSVGELEVYVDGADEITQHFAMIKGGGGALTREKIVAACSKQFVCIADDSKLVDVLGKFPLPVEVIPMARSHVARELVKLGGQPRLREGFTTDNGNVILDVHNLSIIDPVSLETAINQIVGVVTNGLFARRGADVLLLGTSTGVKTFTR

SEQ ID NO: 1203 - protein, 219 aa, Kangiella koreensis DSM 16069
MTQDELKKLVGEAALEYVVDDSIVGVGTGSTVNYFIDALATMKHKIKGAVSSSEASTERLKKHGIEVFELNEVGKLPVYVDGADESNHLLELIKGGGGALTREKIIAAAADQFICIADESKLVRRLGEFPLPVEVIPMARSYVARQIVKLGGDPVYRTGFVTDNGNVILDVHGLVINEPIKLERILNNIVGVVTNGLFAERAADVLLLGKEGKVETITR

SEQ ID NO: 1204 - protein, 218 aa, Allochromatium vinosum DSM 180
MNQDDLKKQAAEAALDYVEGGVIGVGTGSTVNHFIDALAGIKNRIEGAVSSSEVSTERLKRHGIPVFDLNAVGELALYVDGADEANGRLELIKGGGGALTREKIVAAASRKFVCIADESKLVEVLGRFPLPVEVIPMARSYVARELVRLGGTPVWREGFVTDNGNLILDVQNLEITDPQGLEQQVNNIAGVVTVGIFALRPADVLILGSARGPRAIAP

SEQ ID NO: 1205 - protein, 218 aa, Thioalkalivibrio sp. HL-EbGR7
MNQDQMKKAAAEAAIEYVESGMIVGVGTGSTANHFIDLLAAIKDRIDGTVASSEASAQRLRGHGIQVMDLNTAGQLPLYVDGADESNAELHLIKGGGGALTREKIVAAASDKFVCIADESKLVDVLGAFPLPVEVIPMARAYVARELTKLGGQPVLREGFTTDNGNVILDVHNLQISDPVAMEDHINQLPGVVTVGIFAQRPADVLILGSAGGIRKIG

SEQ ID NO: 1206 - protein, 220 aa, Thioalkalivibrio sp. K90mix
MTQDEMKKAVAEAALERIESGWIVGVGTGSTANYFIDALARIKGKIDGAVASSEASAERLRGHGIEVLDLNSAGPLPIYVDGADEATRHLHLTKGGGGALTREKIVAAASKTFVCVVDETKVVDYLGAFPLPVEVIPMARSHVARALSKLGGNPELREGFKTDNGNVILDVHNLRIMNPVELESELDHIAGVVTNGLFARRPADVMLVGSPAGVEEMTAK

SEQ ID NO: 1207 - protein, 218 aa, Methylococcus capsulatus
MTQDELKRKVAEAALDYVKDVTILGVGTGSTVNHFIDLLADLKGGIEGAVSSSQASSERLKKIGIPVLDLNAAGTLDVYVDGADEVNAAKQMIKGGGAALTREKIVAEASRKFVCIVDETKCVDVLGKFPLPVEVIPMARSLVARRLVELGGTPVWRENCITDNGNVILDVHNLTITDPVELERRINDIPGVVCNGVFALRPADVVLIGSPSGVRTLP

SEQ ID NO: 1208 - protein, 220 aa, Coxiella burnetii
MSKNELKKAAAMEAIQFVKNVNIVGVGTGSTVNYFIDALAEIKHQIEGAVASSVATENRLKEHRIPVVDLNSVSNVDVYVDGADEFNKHFYLTKGGGGALTREKIIAAAAKRFICIVDESKQVDVLGQFPLPIEVIPMARSFVAREIVKLKGDPVYRQGFTTDNGNVILDIHNLTILNPVELEAILNNIPGVIANGLFAQQPADDLLIGTPAGVQLHHRK

SEQ ID NO: 1209 - protein, 223 aa, Oceanospirillum sp. MED92
MTQDEMKKAVAEAAVEYIKPKLTEDSIVGVGTGSTANFFIDALAEIKHMFEGAVASSEATAERLKGHGIEVFDMNSVSEMEVYVDGADEFDSGLNLVKGGGGALTREKIVAAVAKEFVCIVDSSKKVDVLGEFPLPVEVIPMARSQVARELVKLDGMPEWRQGFVTDNGNLILDVHDLEIMRPKELEKQLNNIVGVVTNGLFANRGADVVLMGTESGVETIKL

SEQ ID NO: 1210 - protein, 220 aa, Thiomicrospira crunogena
MTQDELKQQVAIAAIEYVVPDTFIGVGTGSTANFFIDELAKIKGKIKGAVASSEATAERLKDHGIPVMELNSVDELSVYIDGADEADPKLNLIKGGGGALTREKIVLAVAKQFVCIADDSKKVAVLGKFPLPIEVIPMARSYVAREVVKRFGGEPVLREGFTTDNGNVILDIHGLEITDPVAMETELNGIVGVVTNGLFAARNADIFLCGTANGVETIKA

SEQ ID NO: 1211 - protein, 200 aa, Beggiatoa sp. PS
MVEDSIIGIGTGSTANYFIDVLASIKHKIEGTVASSKASLERLKWHGISVFDINSVDEISVYIDGADESNQYRHLIKGGGGALTREKIVAAVSRKFVCIADDSKLVEVLGKFPLPVEVIPMARSYVARELVKMGGKPVWREAFTTDNGNVILDVHNLEIIDPVILETELNAITGVVTNGLFAARPADILLLGSDKGVKVL

SEQ ID NO: 1212 - protein, 237 aa, Reinekea sp. MED297
MSVMTQDELKQQVAKAALDYIKPELTSDAIIGVGTGSTAEFFIDGLAAYRDDFKGAVASSDATAKRLAGHGIEVFDMNDVTQLSVYVDGADEANKKLQLIKGGGAALTREKIVASIAKTFVCIADESKAVEVLGAFPLPVEVIPMARSAVARRIRDLGGNPVYREGVVTDNGNVILDVHGLQITDAKELERELNNMVGVVTNGLFAARPADVLLLGTASGVKTLTVINTAASAGEFF

SEQ ID NO: 1213 - protein, 159 aa, Mycobacterium tuberculosis
MRVYLGADHAGYELKQRIIEHLKQTGHEPIDCGALRYDADDDYPAFCIAAATRTVADPGSLGIVLGGSGNGEQIAANKVPGARCALAWSVQTAALAREHNNAQLIGIGGRMHTVAEALAIVDAFVTTPWSKAQRHQRRIDILAEYERTHEAPPVPGAPA

SEQ ID NO: 1214 - protein, 143 aa, Thermotoga maritima
MKIAIASDHAAFELKEKVKNYLLGKGIEVEDHGTYSEESVDYPDYAKKVVQSILSNEADFGILLCGTGLGMSIAANRYRGIRAALCLFPDMARLARSHNNANILVLPGRLIGAELAFWIVDTFLSTPFDGGRHERRIRKIDEV

SEQ ID NO: 1215 - protein, 149 aa, Clostridium thermocellum
MKIGIGSDHGGYNLKREIADFLKKRGYEVIDFGTHGNESVDYPDFGLKVAEAVKSGECDRGIVICGTGLGISIAANKVPGIRAAVCTNSYMARMSREHNDANILALGERVVGLDLALDIVDTWLKAEFQGGRHATRVGKIGEIEKKYSK

SEQ ID NO: 1216 - protein, 149 aa, Escherichia coli
MKKIAFGCDHVGFILKHEIVAHLVERGVEVIDKGTWSSERTDYPHYASQVALAVAGGEVDGGILICGTGVGISIAANKFAGIRAVVCSEPYSAQLSRQHNDTNVLAFGSRVVGLELAKMIVDAWLGAQYEGGRHQQRVEAITAIEQRRN

SEQ ID NO: 1217 - protein, 159 aa, Trypanosoma cruzi
MTRRVAIGTDHPAFAIHENLILYVKEAGDEFVPVYCGPKTAESVDYPDFASRVAEMVARKEVEFGVLACGSGIGMSIAANKVPGVRAALCYDHYTAAISRIHNDANIVCVGERTTGVEVIREIIITFLQTPFSGEERHARRIEKIRAIEASHAGNKGVK

SEQ ID NO: 1218 - protein, 156 aa, Desulfurococcus kamchatkensis 1221n
MNNYFRRDESMRVAVGSDDVYSVARFLVDYLRKKGFEVKLVGALATGKPYPWPDVGFEVGSMVARGEVDYGIVICYTGTGVSIAANKIKGVRAALVTDARNAEGARRWNDANVLALSARLTSEELAKEIVDAFFNTREIDSSEVENIEKLKAIDNA

SEQ ID NO: 1219 - protein, 147 aa, Thermofilum pendens
MKVAFGADDNYSIARFVVEELKRRGHEVVLVGSPLTGKPYPWPKVAVEVAELVASGKVDTGIVMCYTGTGVSIAANKVKGVRAALCTDAKNARGARLWNDANVLALSARLLSEEVAKEILDEWFSVEKPDPSELENIEFVKKLDLSR

SEQ ID NO: 1220 - protein, 156 aa, Acidimicrobium ferrooxidans
MSRIIALGADHAGYALKEAVKRHLVEAGLDVLDFGTDSEESVDYPLFCQPAAEAVATGAAELGIVFGGSGQGEQIVANKVRGVRAALCYNELSARLARAHNDANVLALGARLLGHDLALAIVDAFLAADFDGGRHARRIAQIAEVENGVSFTQTQG

SEQ ID NO: 1221 - protein, 149 aa, Actinomyces coleocanis DSM 15436
MRVHIAADHAGFELREHLIKHLSEKGYEVVDHGATEYDALDAYPTMCIPCGEAVAAEPGSLGIVIGGSGNGEQIAANKVKGVRAALAWSEATAALAREHNDANIVAVGARQHTLEEATHLVDVFLETPFSNDQRHIDRINMMSAYEEAR

SEQ ID NO: 1222 - protein, 169 aa, Actinomyces odontolyticus
MCAILVDVACLRTLQEDPMRVHIGTDHAGFELKEKVVAHLREAGHDVVDHGAHTYDALDDYPPFCIEAAQAVVDEPGSLGIVIGGSGNGEQMAANCVEGVRAALVWSDATARLAREHNDANVVAVGARQHSEEEALALIDAFLETPFSGDERHQRRIDLMKDYERSVRA

SEQ ID NO: 1223 - protein, 155 aa, Actinomyces sp. oral taxon 848 str. F0332
MGLRIVVAADFAGYDYKEAIKRDLEQDERVDEIIDVGVKDGEKTPYPHVGVAGARLIAEGKADRGIFCCGTGMGMAISANKVPGIRASTAHDSFSVERLILSNDAHVLCLGQRVIGLELARRLAREFLGYEFDPSSHSKANVDVLVEYENGSAGC

SEQ ID NO: 1224 - protein, 150 aa, Actinomyces sp. oral taxon 848 str. F0332
MRIHIATDHAGFELKEYIAGKLREGGHEVIDHGAHSYDPMDDYPPMCIACGEAVVADPGSLGIVIGGSGNGEQIAANKVRGVRAALAWNLETARLGREHNDANVVAIGARQHGHEEALSFVELFIGTPFSGDERHQRRIDLVAQYESSER

SEQ ID NO: 1225 - protein, 152 aa, Actinomyces urogenitalis DSM 15434
MRIHIGTDHAGFELKGVLVSHLTEQGHEVVDHGCYVYDRLDDYPEFCFAAAEAVVADPGSLGIVLGGSGNGEQIAANKVDGVRAALVWNVETARLARQHNNANVAGLGARQHSTEEAIEILDAFVAEPFSGEERHQGRIDQVLDYERAHHSA

SEQ ID NO: 1226 - protein, 166 aa, Mobiluncus curtisii
MFLAVPRRARFDTKGKAMRVHIGTDHAGFELKQHLVTWLRERGYEVVDHGPAAYDPDDDYPGFCIACAQGVIADEGSLGIVLGGSGNGEQIAANKVKGIRAALVWNEEIASLARQHNNANVISLGARQHSVEDCERFVEVFLTTDFSDEERHSRRIGQLSDYDNQR

SEQ ID NO: 1227 - protein, 145 aa, Mobiluncus mulieris
MKIAFGCDPNAADLKLALIAKAQQLGHEVKDFGAEDPIYANTAVAVAKAVAAGEFDRGVLVCGTGIGVSIAANKVKGAYCACVTDIYQAQRATLSNNANLIAMGSQVVGVKSAEMFLEEYLKYTFDPASRSGAKVARICEFERED

SEQ ID NO: 1228 - protein, 144 aa, Catenulispora acidiphila DSM 44928
MRIAVSADEVAGVAAQIGPELERRGHTVLLFGALVPGERADWAWSAEAAARAVAEGRADQAVVACWTGAGASIAANKVDGVRAALCTDAVMADGARKWADANALALSLRLTSQPLLMEMLDAWFAGAPSPDPVDAANVAHVAEI

SEQ ID NO: 1229 - protein, 159 aa, Catenulispora acidiphila DSM 44928
MRIYLGSDHAGYDLKNHLVTWLTAAGHEAVDCGPHTLDPQDDYPPYVMLAASKTAADPDTLGIVIGGSGNGEAIAANKVDGIRAALAWSEETARLGRLHNNANVISIGARMHTEAEATHFVELFITTPFTNEERHNRRIQLMTDYEKTGELPPLPNTTS

SEQ ID NO: 1230 - protein, 159 aa, Corynebacterium accolens
MRVYLGADHAGFETKNLISEHLTKQGHDVIDCGAHTYDAEDDYPAFCIEAALCTVNDPGSLGIVLGGSGNGEQIAANKVKGARCALAWSPETARLAREHNNAQLIGIGGRMHSQEEALEIVDAFLDQEWSRAERHQRRIDILAEYERTNIPPELPKDPR

SEQ ID NO: 1231 - protein, 157 aa, Corynebacterium amycolatum
MRIYLGADHAGFEMKNLIKAHLEKAGHDVVDCGAHTYDPADDYPAFCIEAASRTVADPGSLGIVLGGSGNGEQIAANKVKGARCALAWSVETAKLAREHNNAQLIGLGGRMHSEEEALAIVDAFVSQPWSEEERHQRRIDILAEYEKTGVAPELPEA

SEQ ID NO: 1232 - protein, 157 aa, Corynebacterium aurimucosum ATCC 700975
MRVYLGADHAGFETKNVIAEHLKKQGHDVIDCGAHEYDAEDDYPAFCIEAALRTVNDPGSLGIVLGGSGNGEQIAANKVKGARCALAWSPETARLAREHNNAQLIGIGGRMHSEEEALAIVDAFLDQEWSRAERHQRRIDILAEYERTNIPPELPEA

SEQ ID NO: 1233 - protein, 157 aa, Corynebacterium diphtheriae
MRVYLGADHAGFDMKNIIADHLKAKGHEVIDCGAHTYDALDDYPAYCIEAASRVVNDPGSLGIVLGGSGNGEQIAANKVKGARCALAWSVETARLAREHNNAQLIGLGGRMHSEEEALAIVDAFLDQEWSKEERHQRRIDILCEYERTGIAPVIPES

SEQ ID NO: 1234 - protein, 157 aa, Corynebacterium efficiens YS-314
MRVYLGADHAGFETKNAIAEHLKAHGHEVIDCGAHTYDPDDDYPAFCIEAANRTVNDPGSLGIVLGGSGNGEQIAANKVKGARCALAWSVETARLAREHNNANLIGIGGRMHSTEEALEIVDAFLDQEWSNAERHQRRIDILSDYERTGVAPVVPNE

SEQ ID NO: 1235 - protein, 162 aa, Corynebacterium genitalium
MRIYLGADHAGFERKNEIAEHLKAAGHEVVDCGAHEYDAADDYPAFCIAAAEKTVADPSSLGIVLGGSGNGEQIAANKVKGARCALAWSVETAQLAREHNNAQLIGIGGRMHSLEETLAIVDAFVGITPDHQVEERHQRRIDILARYEETGETEEIPAPKTL

SEQ ID NO: 1236 - protein, 155 aa, Corynebacterium glucuronolyticum
MHIYLGADHAGYEAKEAIKAHLIEAGYEVTDCGAHEYDAQDDYPAFCIAAAEAVAKDPGSLGFVLGGSGNGEQMAANKVKGIRCALGWNEDTARLARAHNNAQVLSIGGRQHSEEEVLKLVDAFLDEPWSEEERHQRRIDILAEYEKTGVAPEVK

SEQ ID NO: 1237 - protein, 157 aa, Corynebacterium glutamicum
MRVYLGADHAGFETKNAIAEHLKAHGHEVIDCGAHTYDAEDDYPAFCIEAASRTVNDPGSLGIVLGGSGNGEQIAANKVKGARCALAWSVETARLAREHNNANLIGIGGRMHSEEEALAIVDAFLEQEWSNAERHQRRIDILADYERTGIAPVVPNE

SEQ ID NO: 1238 - protein, 157 aa, Corynebacterium jeikeium
MRIYLGADHAGFEMKNVIKDHLTSKGFEVVDCGAHTYDANDDYPAFCIAAAKSVVEDEGSLGIVLGGSGNGEQIAANKVPGARCALAWSVETAKLAREHNNAQLIGLGGRMHSEEEALAIVDAFVTQPWSEAERHQRRIDILAEYERTGEAPALPEN

SEQ ID NO: 1239 - protein, 158 aa, Corynebacterium kroppenstedtii DSM 44385
MRVYLGADHAGFELKNTIAAHLEKNGHEIVDCGAHSFDPKDDYPAYCIEASARVVNDPGSLGIVIGGSGNGEQIAANKVKGARCALAWSVETAKLAREHNNAQLIGLGARQHSEEEALEIVDAFIETPWSNEERHQRRLDVLAEYERTGMAPALPEDQ

SEQ ID NO: 1240 - protein, 157 aa, Corynebacterium lipophiloflavum DSM 44291
MRIYLGADHAGFERKNQIKEHLEAAGHEVIDCGAHVYDAADDYPAFCIAAAECTVADPGSLGIVLGGSGNGEQIAANKVKGARCALAWSAETARLAREHNNAQLIGIGGRMHTEAEALAIVDAFIGQEWSNEQRHQRRIDILAEYEDTGVAPALPQE

SEQ ID NO: 1241 - protein, 159 aa, Corynebacterium matruchotii
MRIYLGADHAGFELKNTIKDHLLAGGYEVIDCGAHTYDANDDYPAFCIAAAQGVVDNPGSLGIVLGGSGNGEQIAANKVKGARCALAWSVETARLAREHNNAQLIGIGGRMHSDAEALAIVDAFLDQAWSGNPRHQRRIDILSEFETTGVAPEVPEATK

SEQ ID NO: 1242 - protein, 159 aa, Corynebacterium matruchotii
MRIYLGADHAGFELKNTIKDHLLAGGYEVIDCGAHIYDATDDYPAFCIAAAQGVVDNPGSLGIVLGGSGNGEQIAANKVKGARCALAWSVETARLAREHNNAQLIGIGGRMHSAAEALAIVDAFLDQAWSGNPRHQRRIDILSEFETTGVAPEVPEATK

SEQ ID NO: 1243 - protein, 160 aa, Corynebacterium pseudogenitalium
MWAMRVYLGADHAGFETKNLIVEHLTKQGHEVIDCGALTYDAEDDYPAFCIEAAQRTVNDPGSLGIVLGGSGNGEQIAANKVKGARCALAWSAETARLAREHNNAQLIGIGGRMHTEEQALEIVDAFLDQEWSRAERHQRRIDILAEYERTGIAPELPEA

SEQ ID NO: 1244 - protein, 157 aa, Corynebacterium striatum
MRVYLGADHAGFETKNVIAEHLKKQGHDVIDCGAHVYDAEDDYPAFCIEAALRTVNDPGSLGIVLGGSGNGEQIAANKVKGARCALAWSPETARLAREHNNAQLIGIGGRMHSEEEALAIVDAFLDQEWSAAERHQRRIDILAEYERTEIPPEIPEV

SEQ ID NO: 1245 - protein, 157 aa, Corynebacterium tuberculostearicum
MRVYLGADHAGFETKNLIAEHLTKQGHEVIDCGAHTYDAEDDYPAFCIEAAQRTVNDPGSLGIVLGGSGNGEQIAANKVKGARCALAWSAETARLAREHNNAQLIGIGGRMHTEEQALEIVDAFLDQEWSRAERHQRRIDILAEYERTGIAPELPEA

SEQ ID NO: 1246 - protein, 157 aa, Corynebacterium urealyticum
MRIYLGADHAGFDMKNLIADHLKAAGHEVIDCGAHTYDANDDYPAFCIEAARRVVADEGSLGIVLGGSGNGEQIAANKVPGARCALAWSVETAKLAREHNNAQLIGLGGRMHSEEEALAIVDAFIAQEWSEAERHQRRIDILAEYEKTGEAPALPEA

SEQ ID NO: 1247 - protein, 158 aa, Gordonia bronchialis DSM 43247
MTTTSGMTIAIGSDDAGIDYKAILAADLVDDARVASVIDVGVGPDEHTHYPHVAAAAARLVADGTADRALLICGTGLGVAISANKIPGIRAVTAHNSFSVERAVLSNDAQVLCFGQRVIGVELARRLTREWLGYRFDPQSASAEKVAAIADYEVASPV

SEQ ID NO: 1248 - protein, 157 aa, Gordonia bronchialis DSM 43247
MRVYLGADHAGFERKNQIAEHLEAAGHEVVDCGAHEYDADDDYPAFCIDAARRTVADPGSLGIVLGGSGNGEQIAANKVHGARCALAWSVETAQLARQHNNAQLIGIGGRMHSREEALAIVDAFIATPWSEEPRHQRRIDILAEYERTGQAPPVPGA

SEQ ID NO: 1249 - protein, 159 aa, Mycobacterium avium
MRVYLGSDHAGFELKQQIIAHLEQSGHQPIDCGAFSYDADDDYPAFCIAAATRTVADPDSLGIVLGGSGNGEQIAANKVPGARCALAWSVETAQLAREHNNAQLIGIGGRMHTVAEALAIVDAFVTTPWSKAPRHQRRIDILAEYERTHQAPPVPGAVG

SEQ ID NO: 1250 - protein, 159 aa, Mycobacterium intracellulare
MRVYLGSDHAGFELKQQIIEHLAKSGHEPIDCGAFTYDADDDYPAFCIATATRTVADPDSLGIVLGGSGNGEQIAANKVPGARCALAWSVETASLAREHNNAQLIGIGGRMHTVAEALAIVDAFVTTPWSKAERHQRRIDILAEYERTHQAPPVPGAAG

SEQ ID NO: 1251 - protein, 159 aa, Mycobacterium abscessus
MRVYVGADHAGYELKQKIIEHLRGRGHEPVDCGAFELDPQDDYPAFCIDAARRTVADPGSLGIVLGGSGNGEQIAANKVPGARCALAWSLETAVLAREHNNAQLIGIGGRMHTVPEALAIVDAFLAAKWSEEPRHQRRIDILAEYETTRVAPPVPGASS

SEQ ID NO: 1252 - protein, 157 aa, Mycobacterium gilvum
MRVYVGADHAGYELKQAIVEHLAATGHEPVDCGAFAYDAEDDYPAFCIAAAEKTVADPGSLGIVLGGSGNGEQIAANKVPGARCALAWSTETATLAREHNNAQLVGIGGRMHSTDEALAIVDAFLAAKWSEAPRHQRRIDILAEFEKTHVAPAVPGA

SEQ ID NO: 1253 - protein, 159 aa, Mycobacterium kansasii
MRVYLGSDHAGFELKQHVIEHLKASGHEPIDCGAFAYDADDDYPAFCIAAAQRTVADPGSLGIVLGGSGNGEQIAANKVPGARCALAWSVETASLAREHNNAQLIGIGGRMHSVAEALAIVDAFLSAQWSEAERHQRRIDILTQYERTHQAPPVPGPVA

SEQ ID NO: 1254 - protein, 162 aa, Mycobacterium leprae
MSGMRVYLGADHAGYELKRQIIEHLKQSGHQPIDCGAFSYDVDDEYPAFCITAATRTVADPGSLGIVLGGSGNGEQIAANKVVGARCALAWSVETARLAREHNNAQLIGIGGRMHTVAEALTIVDAFVTTPWSEAQRHQRRIDILAEFERTHQAPPVPGAQA

SEQ ID NO: 1255 - protein, 159 aa, Mycobacterium marinum
MRVYLGADHAGLELKQQIIEHLKATGHEPIDCGAFTYDAEDDYPAFCIAAAQRTVADPGSLGIVLGGSGNGEQIAANKVPGARCALAWSEQTASLAREHNNAQLIGIGGRMHTVAEALAIVDAFLSTPWSKAERHQRRIDILSEYERTHQAPPVPGAQD

SEQ ID NO: 1256 - protein, 153 aa, Mycobacterium smegmatis
MALRVVVGADDAGYEYKEALKGDLAADDRVTEVIDVGVGADEDTAYPHVAVAAARLIAEGKADRALLVCGTGLGVAISANKVPGIRAVTAHDSFSVERSVLSNNAQVLCFGQRVVGLELARRLAREWLGYEFDPTSKSAEKVQAICGYEPATS

SEQ ID NO: 1257 - protein, 152 aa, Mycobacterium smegmatis
MALKIVIGGDNAGFNYKEALRKDLEADDRVASVEDVGVGGVDDTTSYPNVAVAAAEKVARGEADRALLICGTGLGVAIAANKVKGIRAVTAHDVYSVQRSVLSNNAQVLCMGERVVGLELARALVKEWLGLEFDPQSASAAKVNDICAYEGA

SEQ ID NO: 1258 - protein, 159 aa, Mycobacterium smegmatis
MRVYVGADHAGFEFKKTIIAHLEKNGHEPIDCGAYEYDADDDYPAFCIAAAEKTVADPGSLGIVLGGSGNGEQIAANKVPGARAALAWSVETAQLAREHNNANLIGIGGRMHTTEEALAIVDAFLTTPWSEAERHQRRIDILAEYERTHVAPAVPGAPA

SEQ ID NO: 1259 - protein, 159 aa, Mycobacterium sp. MCS
MTAQQTSKLRIVVGSDDAGYEYKEALKGDLKADDRVAEVTDVGVGTDEDTAYPHIAVAAARMVADGKADRALLVCGTGLGVAISANKVPGIRAVTAHDSFSVERSVLSNDAQVLCFGQRVIGLELARRLAREWLNYEFDPASKSADKVEAICGYEPRTD

SEQ ID NO: 1260 - protein, 162 aa, Mycobacterium sp. MCS
MAAMRVYLGADHAGYELKQVIIEHLRSTGHEPVDCGAFDYDADDDYPAFCIAAAEKTVADPGSLGIVLGGSGNGEQIAANKVPGARCALAWSVETAKLAREHNNAQLIGLGGRMHSEADALAIVDAFLATPWSKAERHQRRIDILSEYERTHEAPPVPGAPA

SEQ ID NO: 1261 - protein, 162 aa, Mycobacterium bovis
MSGMRVYLGADHAGYELKQRIIEHLKQTGHEPIDCGALRYDADDDYPAFCIAAATRTVADPGSLGIVLGGSGNGEQIAANKVPGARCALAWSVQTAALAREHNNAQLIGIGGRMHTVAEALAIVDAFVTTPWSKAQRHQRRIDILAEYERTHEAPPVPGAPA

SEQ ID NO: 1262 - protein, 159 aa, Mycobacterium ulcerans
MRVYLGADHAGLELKQQIIEHLKATGHEPIDCGAFTYDAEDDYPAFCIAAAQRTVADPGSLGIVLGGSGNGEQIAANKVPGARCALVWSEQTASLAREHNNAQLIGIGGRMHTVAEALAIVDAFLSTPWSKAERHQRRIDILSEYERTHQAPPVPGAQD

SEQ ID NO: 1263 - protein, 157 aa, Mycobacterium vanbaalenii PYR-1
MRVYVGADHAGYELKQTIVEHLKATGHEPVDCGAFTYDAEDDYPAFCIAAAQKTVADPGSLGIVLGGSGNGEQIAANKVPGARCALAWSPETASLAREHNNAQLIGIGGRMHSTEEALAIVDAFLTTKWSEAPRHQRRIDILAEYEKTHVAPPVPGA

SEQ ID NO: 1264 - protein, 157 aa, Nocardia farcinica
MRVYLGADHAGFELKNHVKAHLEQAGHEVVDCGALEYDALDDYPAFCIEAARRTVADPGSLGLVFGGSGNGEQIAANKVPGARCALAWSVETAKLAREHNNAQLIGIGGRMHSTEEALAIVDAFLATPWSNEERHQRRIDILAEYEKTGVAPAVPAY

SEQ ID NO: 1265 - protein, 157 aa, Rhodococcus erythropolis
MRVYLGADHAGFERKNEIIEHLKANGHEAIDCGAHEYDAVDDYPAFCIEAAKRVVADEGSLGIVLGGSGNGEQIAANKVPGARCALAWSVETAKLAREHNNAQLIGIGGRMHSLEESLAIVDAFLATAWSGEERHQRRIDILSEYEKTGVAPALPQA

SEQ ID NO: 1266 - protein, 157 aa, Rhodococcus jostii RHA1
MRVYLGADHAGFERKNEIIEHLTAAGHETVDCGAHVYDALDDYPAFCIETARRVVADEGSLGIVLGGSGNGEQIAANKVKGARCALAWSVETAQLARQHNNAQLIGLGGRMHSLEESLAIVDAFLAAEWSNEERHQRRIDILSEFEKTGVAPALPEA

SEQ ID NO: 1267 - protein, 157 aa, Rhodococcus opacus
MRVYLGADHAGFERKNEIIEHLKAAGHETVDCGAHVYDALDDYPAFCIETARRVVADEGSLGIVLGGSGNGEQIAANKVKGARCALAWSVETAQLARQHNNAQLIGLGGRMHSLEESLAIVDAFLAAEWSNEERHQRRIDILSEFEKSGVAPALPEA

SEQ ID NO: 1268 - protein, 175 aa, Tsukamurella paurometabola DSM 20162
MPPSDAKATRAKLVIMRVYLGGDHAGFELKSQIARHLTAAGHEVVDCGAHTYDALDDYPAFCIDAAKRVVADPGSLGIVLGGSGNGEQIAANKVPGARCALAWSVETAQLARQHNNAQLIGLGGRMHTVDEALAIVDAFLATPWSDEERHQRRIDILAEYERTGVAPAVPGAPEA

SEQ ID NO: 1269 - protein, 160 aa, Acidothermus cellulolyticus
MRVYVASDHAGFELKTRLIEWLAEQGYEPVDCGPVVFQPDDDYPPYVIDAARRTAADRDSFGVVIGGSGNGEQIAANKVRGIRAALIWNDETAALARAHNDANVASIGARQHTIRDAIRLVDIFLRTPFSGEPRHARRIGMISEFEATGTPPEVPTVDWR

SEQ ID NO: 1270 - protein, 162 aa, Frankia sp. CcI3
MRVHLGSDHAGFHLKEALAERLVELGHAPVDHGPVEYDPDDDYPPFVLAAAAATAVEPGSMGIVIGGSGNGEAIAANKVAGVRAALAWSEQTATLARQHNDANVLSLGARMYTVTAALTFAEVFLTTPFSGEQRHVRRLRMLSAYERTGDVPSVPGSASSAS

SEQ ID NO: 1271 - protein, 161 aa, Frankia sp. EAN1pec
MRVHLGSDHAGFHLKKALVARLAELGHAPVDHGPVEYDPDDDYPPFVMAAAAAAAAEPDSLGIVIGGSGNGEVIAANKVDGVRAALVWSEQTATLARQHNDANVISVGARMHSLPEAVELVEIFLATPFSGEQRHLRRLRMISAYERSGEIPEPSPSSPAS

SEQ ID NO: 1272 - protein, 134 aa, Frankia sp. EuI1c
MIFGADDTNECVAAVREYLRANYETTVVDPTSWPELSEMVARGVAAGEYRFGVLMCWTGTGTAMAANKVPGVRAAQAWEPWIATNARLWNDANVLTMSLKRTAPEVALDCLRAFLAVADPDPEELSQIEKVRGR

SEQ ID NO: 1273 - protein, 164 aa, Frankia sp. EuI1c
MRVHLGSDHAGYHLKAALVERLAELGHTPVDHGPSDYDPDDDYPPFVMAAAAAVAAEPGSLGIVIGGSGNGEAIAANKVDGVRAALAWSEETARLGRQHNDANVLSLGARMHEVSEAIGFAQVFLDTPFSDESRHTRRLRMLTGYERTGELPPVPTGAPAPPAV

SEQ ID NO: 1274 - protein, 163 aa, Geodermatophilus obscurus
MRVFVGTDHAGLEFKDHLKQALTDAGHEPVDCGAFEYDAQDDYPPFCFEVGERTVTEPGSLGVVIGGSGNGEQIAANKVPGVRAALVWNRETAELARQHNDANVVSIGARQHGVEEATELVLHFLATPFSGDERHVRRIGLVSDYERDRHRPAGGLPTRDEPR

SEQ ID NO: 1275 - protein, 165 aa, Nakamurella multipartita DSM 44233
MSEPWSIVIGCDDAGLEYKQALKADLLADPRVGQVIDVGIDPANPAAYPHVAVAAARAVALGQADRALLFCGTGLGVAISANKVPGIRAVTAHDSFSVERSVLSNDAQVLCMGQRVIGLELARRLVREWLDYRFDTTSASAAKVEVIKAYDRAETTQDFDLAAAS

SEQ ID NO: 1276 - protein, 144 aa, Nakamurella multipartita DSM 44233
MRISVSADEDTGVARAVLDELTARGHRPIRHGALAAGERADWAWASAAAARDVAEGRAESAVVCCWTGTGASIAANKVPGVRAALCWDAPTAAGARRWNDANVLALSLRSTSRAVLTEILDAWFAADPSDDPGDRANIEHLDAL

SEQ ID NO: 1277 - protein, 156 aa, Stackebrandtia nassauensis DSM 44728
MSSRQWRIAVGADEAGFQYKEAIARDLAEDSRVGSVVDFGVAEGETTPYASVGLTVAEAVARGEVDRAILICGTGIGMAISANKVPGVRATTVSDSYSCERSVLSNDCQIISFGQRVVGLELARRLASEWLGYEFDPASPSNSKVSVISAYERRTP

SEQ ID NO: 1278 - protein, 147 aa, Stackebrandtia nassauensis DSM 44728
MRISVAADCTDGVAGSLIQALESRGHTVIPHGILAEDDRDDWAWCCAAAAADVAAGRADQGLVACWTGTGASIAANKVDGVRAALCTDAATADGARKWNDANVLALSLRLTSAPQLEEILDAWFGGQPSTDADDAANIRHLGELERR

SEQ ID NO: 1279 - protein, 155 aa, Stackebrandtia nassauensis DSM 44728
MRVYIGSDHAGFELKTALVKHLTGVGHEVVDVGPHAFDAEDDYPPFCLNTAARVVADPGSLGIVLGGSGNGEQIAANKVAGARAALAWKPEIAKLAREHNDANLVSIGARMHSTDEAIAIVDEFLSVRFSGAERHARRISQLDDYERTRQLPPLV

SEQ ID NO: 1280 - protein, 167 aa, Kineococcus radiotolerans SRS30216
MTDLQWRVVLAADEAGVSYKDAIKADLLKDPRVKEVLDVGVNGDDDKTAYPHVAVAAARKIAAGEADRGILVCGTGMGVAIAANKVPGIRASVAHDSFSVERLVLSNDGQVLTLGERVIGKELARRLAKEFLGYVFDPSSASAAKVEAITGYETVANTDADVAASSC

SEQ ID NO: 1281 - protein, 167 aa, Kineococcus radiotolerans SRS30216
MTDLQWRVVLAADEAGVSYKDAIKADLLKDPRVKEVLDVGVNGDDDKTAYPHVAVAAARKIAAGEADRGILVCGTGMGVAIAANKVPGIRASVAHDSFSVERLVLSNDGQVLTLGERVIGKELARRLAKEFLGYVFDPTSASAAKVEAITGYETVANTDADVAASSC

SEQ ID NO: 1282 - protein, 162 aa, Kineococcus radiotolerans SRS30216
MRVHVGTDHAGFELKEHLVAHLREQGHDVVDHGAPVYDAADDYPPFVLRAAAGVAGDPGSLGIVIGGSGNGEQIAANVVPGIRCALAWSVDTARLAREHNDAQVVGIGARMHTLEEATLLADTFLATPFSNDPRHVRRIEMLDAYARTGELPPLPAGAADQG

SEQ ID NO: 1283 - protein, 152 aa, Beutenbergia cavernae DSM 12333
MGLRIVVGADSAGFEYKEALKRDLEADERVSDVVDVGVDAGGQTDYPHVAVSAARLVARGEADRALLVCGTGLGVAIAANKVPGIRAVTAHDSYSVERSVLSNDAQVLTFGQRVIGLELARKLAAEWLAYTFDASSPSAVKVSAISEYEARD

SEQ ID NO: 1284 - protein, 156 aa, Beutenbergia cavernae DSM 12333
MAWRVVVGSDGAGFDYKEALKQDLFVSDLVSDVVDVGVPAADDGANYPSVAFEAARRVAAGEADRALLVCGTGLGVAISANKVKGVRAVTAHDVYSVRRSVLSNDAQVLCLGQRVIGLELARALTEEWLTLTFDPTSASAPKVAEIDTYEAGTGAC

SEQ ID NO: 1285 - protein, 149 aa, Beutenbergia cavernae DSM 12333
MRIHIAADHAGFELKSVLAEHLRAAGHDVVDHGADAYDELDDYPAFCFAAGEAVVAEPGTLGIVIGGSGNGEQIAANKVRGVRAALAWSTTTASLARAHNDANVVAIGARQHSVDEAIELVEAFLAEAFSGDARHQRRIDQLAAYETAR

SEQ ID NO: 1286 - protein, 157 aa, Brevibacterium linens
MKVHLGTDHAGFEFKEVLKAHLGDSGYEVIDHGALEYDALDDYPAFCIAAAQAVVDDQAAGVEALGVVIGGSGNGEQIAANKVKGARTALAWNTDTAKLAREHNNAQIVSVGARQHTEAESIAIVDAFLSEPFSGEERHERRIRIMDEYEATGKAGL

SEQ ID NO: 1287 - protein, 171 aa, Cellulomonas flavigena
MSVARIVVGADEAGLAYKDALADLLRADPRVEVVEDVGVHADDDTAYPHVAVAAARRVAEGGADRALLVCGTGLGMAIAANKVRGVRAVTAHDTFSVQRSVLSNDAQVLCLGQRVIGLELAKTLVREWLAHEFDPASASAAKVDAIRGYETAEPGEGSAGIDGTARGGGSC

SEQ ID NO: 1288 - protein, 150 aa, Cellulomonas flavigena
MRIHVAADHAGYELKVALVEHLRAADHEVVDHGAFEYDAEDDYPAFCFSAGEAVVAEPGSLGVVIGGSGNGEQIAANKVTGVRAALAWNVETARLGRQHNDANVVAVGARQHSVDEAIELVDAFVAEPFSGNARHQRRIDQLAAYEAARS

SEQ ID NO: 1289 - protein, 156 aa, Brachybacterium faecium
MALKIIVGGDNAGYGHKEELKALFEADDRVESVVDVGVGSADDGTYYPNVAVAAAEKIAAGEADRALLICGTGLGVAIAANKVSGVRAVTAHDLYSVQRSVLSNNAQVLCMGQRVIGLESAKELVKVWLDLEFDPESSSAAKVDAICAYDGSLDQA

SEQ ID NO: 1290 - protein, 156 aa, Brachybacterium faecium
MGWKIVTGSDNAGVGHKSALKDLLENDPRVDEVIDVGVTGREDGTYYPNVAVAAAEKVAAGEADRALLICGTGLGVAIAANKVSGVRAVTAHDLYSVQRSVLSNNAQVLCMGERVVGLELAKELVKVWLDLEFDPESSSAAKVDAICAYDGSLDEA

SEQ ID NO: 1291 - protein, 160 aa, Brachybacterium faecium
MRVHIGTDHAGFELKNRLVAVLQKKGHEVTDHGAHQYDALDDYPPFCTAVGEAVVADPSSLGVVIGGSGNGEQIAANKVAGVRAALVWNEDTARLARQHNDANVISVGARQHSEEELEALIDLFLAEPFTGEERHQRRIDLVGLYERTGGYTGSAAPATE

SEQ ID NO: 1292 - protein, 153 aa, Kytococcus sedentarius
MIIHIGGDHAAHELQRHLVAWLTERGHEVVDHGPLEYDAQDDYPVFVLPTAQAVAADPDSRGIVLGGSGNGEQMAANKVAGVRAALAWQPELAALARQHNDARVVSIGARFTDTATAEAIVEAFLTTEFEGEERHARRVAMVEAYERDGSLPG

SEQ ID NO: 1293 - protein, 155 aa, Janibacter sp. HTCC2649
MRVHIGGDHAAYELQQDLIAFLGTEGHEVTNHGPFDLDPLDDYPVFVLRAAEAVATDEGSLGVVLGGSGNGEQMAANKVAGVRAALCYNDELAQLAREHNNAQVISIGGRMNTVEEARSMVRTFLATPFSGEERHQRRIDMVSAYEDTKTLPDLP

SEQ ID NO: 1294 - protein, 150 aa, Jonesia denitrificans
MRVHIASDHAGFKLKAYLIAHLAEQGHDVVDHGAHHYDALDDYPSFCFDAAQAVVDEPDTLGIVIGGSGNGEQIAANKVNGVRAVLAWSTTTAQLGRQHNNANVIAIGARQHTVEEAASFVDAFLNEPFSQDPRHQRRIDQLAQYEATRS

SEQ ID NO: 1295 - protein, 153 aa, Clavibacter michiganensis
MTRTWRIVVGADDAGYDHKEAIKADLEASGLVVSVVDVGVDADGHTAYPTVATTAAEMVARGEADRAVLICGTGLGMAIAANKVAGIRAVTAHDGFSVERSVLSNDAQVLCMGQRVVGLELARRNVREWLTYEFDTSSASADKVDEIRAYEAK

SEQ ID NO: 1296 - protein, 162 aa, Clavibacter michiganensis
MRIHIATDHAGLDFSRYLTGHLTDAGHDVVDHGPTSYDALDDYPSFCIRAARAVVADQRDGATALGVVFGGSGNGEQIAANKVEGVRAALVWNLSTAVLARQHNDANVISIGARQHTVEEATAFIDAFIAEPFSAEERHARRIAQLAEYETTGAIAGHPVTD

SEQ ID NO: 1297 - protein, 153 aa, Clavibacter michiganensis
MTRTWRIVVGADDAGYDHKEAIKADLEASGLVASVVDVGVDADGHTAYPTVATTAAEMVARGEADRAVLICGTGLGMAIAANKVAGVRAVTAHDGFSVERSVLSNDAQVLCMGQRVVGLELARRNVREWLTYEFDTSSPSNDKVDEIRAYEAK

SEQ ID NO: 1298 - protein, 162 aa, Clavibacter michiganensis
MRIHIATDHAGLDFSRFLAEHLGAQGHDVVDHGPTSYDPLDDYPSFCIRAARAVVADQRGGTTALGVVFGGSGNGEQIAANKVEGVRAALVWNLSTAVLARQHNDANVISIGARQHTVEEATAFIDAFIAEPFSAEERHARRIAQLAEYETTGAIAGHPVTD

SEQ ID NO: 1299 - protein, 162 aa, Leifsonia xyli subsp. xyli str. CTCB07
MRIHIATDHAGLDFSKHLQAHLAQAGHEVIDHGPAEYDPIDDYPAFCVNAAKGVVRDQQAGIEALGVVFGGSGNGEQIAANKVIGARAALVWNESTALLARQHNDANVISIGARQHTVAEATRFIELFIAEPFSLEERHLRRIAQLAEFEATGDIAGKNVDR

SEQ ID NO: 1300 - protein, 181 aa, Microbacterium arborescens
MRIHIATDHAGLEFSTQLQHHLAEAGHDVVDHGPIEYDPLDDYPAFCIRAAQAVVRDQQAGVEALGVVFGGSGNGEQIAANKVHGVRAALVWNIPTAELAREHNDANVIAIGARQHTFDEAVTFIDRFIATPFSGEERHARRIGQLAAYEADGSLLPDPRAGAEGIASPLPATDSFDPEAG

SEQ ID NO: 1301 - protein, 160 aa, Arthrobacter aurescens
MSNNHGWRIVVGNDEAGVEYKQALLALLEADPRVASVTDVGVDFNDSTAYPHVAVDAARKVAEGEADRALLICGTGLGVAIAANKVPGVRAVTAHDSYSVERSVLSNNAQVLTLGQRVIGLELAKKLVGEWLDHRFDQNSSSAAKVDAICSYEPDYTKAV

SEQ ID NO: 1302 - protein, 152 aa, Arthrobacter aurescens
MRIIVGADEAGVDYKDRIMADLEADSRITEVIDIGVNRADEDFTRPYPYVGIAAGEMIRDGKADRAILFCGTGIGVAIAANKVPGIRATAAHDSFSVERSIRSNDCQVLTMGQRVVGVELARRLAKEWIGYAFDPSSGSAAKVKVLSDFEGC

SEQ ID NO: 1303 - protein, 160 aa, Arthrobacter aurescens
MTTPRVHIATDHAGMELSAHLVSHLTAKGYEVVDHGPKEYDALDDYPSFCINAGLAVVADQKAGVHALGIVLGGSGNGEQIAANKVNGVRAALAWNLSTAKLAREHNDANVVAVGGRQHTVEEATELIEAFLQEPFSNDERHVRRIGKIAVYETTGEIVE

SEQ ID NO: 1304 - protein, 163 aa, Arthrobacter chlorophenolicus A6
MSTEGQAMGLRLIVGADEAGVDYKDRVLEDLRNDPRVSEVIDIGVNRGDSPEDFTRPYPYVGIAAGEMIRDGAADRAILFCGTGIGVAIAANKVEGIRATAAHDSFSVERSVLSNDCQVLTMGQRVVGIELARRLAKEWIGYTFDPGSASAGKVKVLSDFESC

SEQ ID NO: 1305 - protein, 164 aa, Arthrobacter chlorophenolicus A6
MTSSPSFPRVHIATDHAGMELSAHLVSHLTAKGYDVVDHGPKAYDAQDDYPSFCINAALAVVADQQAGVHALGIVLGGSGNGEQIAANKVKGVRAALAWNLSTATLAREHNDANVVAVGGRQHSVEEATGLIEAFLAEPFSNDERHVRRIGKIAAYESTGEVIE

SEQ ID NO: 1306 - protein, 163 aa, Arthrobacter sp. FB24
MSADQSTAGWRIVIGNDEAGVEYKEALKALLEADSRVASVVDVGVGANDSTAYPHVAVDAARKVAEGEADRALLICGTGLGVAIAANKVPGIRAVTAHDGYSVERSVLSNNAQVLTMGQRVIGLELAKKLVGEWLDYRFDETSSSAAKVDAICSYEPDYTKAV

SEQ ID NO: 1307 - protein, 163 aa, Arthrobacter sp. FB24
MTREGQAVGIRLILGADEAGVDYKERIMEDLRKDPRVSEIIDIGVNRSDAPEKFTTPYPYVGIAAGEMIKDGLADRAILFCGTGIGVAIAANKVEGIRAATAHDSFSVERSVLSNDCQVLTMGQRVVGVELARRLAREWLGYTFDPASASAGKVKVLSDFEGC

SEQ ID NO: 1308 - protein, 164 aa, Arthrobacter sp. FB24
MTTSSDFPRVHIATDHAGMELSAHLVTHLTAKGYTVVDHGPKVYDALDDYPSFCINAALAVVADQAAGINALGIVLGGSGNGEQIAANKVKGVRAALAWNLSTATLAREHNDANVVAVGGRQHSVDEATEIIEAFLREPFSNDERHVRRIGKIAAYENTGEVIA

SEQ ID NO: 1309 - protein, 170 aa, Kocuria rhizophila DC2201
MRVHIATDHAGLDLSHHLMQKLTEHGYEMIDHGPQEYDPADDYPAFCISAALGVREDRANGLDSLGIVLGGSGNGEQMAANKVEGIRAALVWNQDTAKLAREHNDAQVMAIGGRQHETDEALQLALTFLAEPFSGDERHVRRIAQLGEYERTGDVAGRLSAITPRPFTAN

SEQ ID NO: 1310 - protein, 157 aa, Micrococcus luteus
MRVHIATDHAGMELSAHLVEHLTAAGYEMVDHGPTEYDPQDDYPGFCINAARAVVADREQGLDSLGIVLGGSGNGEQIAANKVAGVRAALAWNLDTARLARAHNDANVVAVGGRQHSLEEATELIEAFLAEPFSQDERHVRRIGKIAHYEATGEVLM

SEQ ID NO: 1311 - protein, 178 aa, Renibacterium salmoninarum
MPKASTLDTESITNPRRTMSTPRVHIATDHAGLELSAHLISHLGDRGYEVIDHGPSSYDPEDDYPAFCIHAAQAAMADTKAGVFALGIVLGGSGNGEQIAANKVEGIRAALVWNLETAKLAREHNDANVVAVGGRQHSVDEATGLIEAFLAEPFSDGERHVRRIGKIAHFEQTGQVQD

SEQ ID NO: 1312 - protein, 163 aa, Rothia mucilaginosa ATCC 25296
MRVHIATDHAGLELSHYLIESLTAAGYEMIDHGPADYDPLDDYPSFCINAALGVKRDREAGLDSLGIVLGGSGNGEQMAANKVDGIRAALAWNHDTAALAREHNNAQVVAVGGRQHSKEEALEIIKVFLATPWTNEERHARRIGQLAEYEQTGDIAGKQIDAA

SEQ ID NO: 1313 - protein, 152 aa, Xylanimonas cellulosilytica DSM 15894
MRLHIGTDHAGFELKNHLVEHLRSEGHDVVDHGAHVYDALDDYPAFCISAAEAVIAEPGSLGIVIGGSGNGEQLAANRVPGIRAILAWSVETAKLGRQHNDANVISVGGRMHTVEESTAIIDAFLAEPFSGDERHQRRIDQMLAYEAQRDAR

SEQ ID NO: 1314 - protein, 149 aa, Sanguibacter keddieii DSM 10542
MRVHIASDHAGYELKSHLVEHLTTEGHDVVDHGAHEYDALDDYPSFCFAAGEAVVADPGSLGVVIGGSGNGEQIAANKVPGVRAALAWNLDTARLGRQHNDANVVAVGGRQHTVEEATSFVDAFLAEPFSGDARHQRRIDQLADYEASR

SEQ ID NO: 1315 - protein, 155 aa, Tropheryma whipplei str. Twist
MSGRVHLATDHAGYEFSKGLLNFLADEHYQVVHHGAVNCDPEDDYPSFCIAAAEAVVRDITDGIPSLGVVIGGSGNGEQIAANKVKGARAALAWNECTARLARAHNNANVVAIGARMHAHDEGFRIVLAFLREPFSEDSRHIRRIDAISLYECQS

SEQ ID NO: 1316 - protein, 155 aa, Tropheryma whipplei TW08/27
MSGRVHLATDHAGYEFSKGLLNFLADEHYQVVHHGAVNCDPEDDYPSFCIAAAEAVVRDITDGIPSLGVVIGGSGNGEQIAANKVKGARAALAWNECTARLARAHNNANVVAIGARMHAHDEGFRIVLAFLREPFSEDSRHIRRIDAISSYECQS

SEQ ID NO: 1317 - protein, 156 aa, Micromonospora aurantiaca
MRVYLGSDHAGFELKVHLANHLAKQGYEVVDVGPHVFDPDDDYPAFCLHTGDRVVGDPGSLGVVIGGSGNGEQIASNKVAGVRAALAWNVDTAQLAREHNDANVVAIGARQHTLDEATALVEAFLTTPFSGNPRHSRRIEQVAAYEQSRRLPELPA

SEQ ID NO: 1318 - protein, 158 aa, Micromonospora sp. ATCC 39149
MRGMRVYLGSDHAGFELKVHLASHLAKQGYEVVDVGPHVFDPDDDYPVFCLHAGTRVVADPGSLGVVIGGSGNGEQIAANKVAGVRAALAWNIDTAQLGREHNDANVVAVGARQHTLDEATAIVEAFLTTSFSGNPRHARRIDQVAAYEQSHELPELP

SEQ ID NO: 1319 - protein, 155 aa, Salinispora arenicola CNS-205
MRVYLGSDHAGFELKAHLANHLAKEGYDVVDVGPQAYDPDDDYPAFCLHTGDRVVADGGSLGVVIGGSGNGEQIAANKIDGIRAALAWNIDTAHLAREHNNANVVAIGARQHTLDEATAIVEAFLTTPFSGKQRHSRRIDQVADYERTRELPDLP

SEQ ID NO: 1320 - protein, 155 aa, Salinispora tropica CNB-440
MRVYLGSDHAGFELKAHLANHLAKEGYDVIDVGPHAYDPDDDYPAFCLHTGDRVVADQGSLGVVIGGSGNGEQIAANKIDGVRAALAWSIDTAHLAREHNNANVVAVGGRQHTLDEATAIVEAFLTTPFSEKQRHVRRIDQVADYERTRELPDLP

SEQ ID NO: 1321 - protein, 152 aa, Aeromicrobium marinum DSM 15272
MRVHVAADHAGFELKTHLLAWLTGQGHEPVDHGAFTYDAEDDYPPFCVAAAQAVVDEPGSLGIVIGGSGNGEQMAANKVTGARAALAWSTETAALARQHNNAQIVSIGARMHSVPEVEAIVETFLTTPWSEADRHQRRIDLLLGYETSGTFA

SEQ ID NO: 1322 - protein, 158 aa, Kribbella flavida DSM 17836
MRVHIGSDHAGFELKNHLVQHLTAAGHDVVDHGPAVYDAVDDYPPYCLRTAVAVVQDDGSLGVVIGGSGNGEQIAANKVKGARAALAWSDETARLGREHNNANVISIGARMHSTEQATGFVETFLATGYSDEDRHTRRIEMLSSYERTGELPPLPESS

SEQ ID NO: 1323 - protein, 162 aa, Nocardioides sp. JS614
MRVHLGCDHAGLDLKDHLSRWLTDHGYEPVDHGPFAYDALDDYPVFCLRAAAAVAEERAAGRDSLGVVIGGSGNGEQMAANKVHGIRCALVWSEETAVLARQHNDANVVSVGGRMHSLEDMTRFVEIFLAEPFSGEERHVRRIGQLAAYESTGELPALPGDA

SEQ ID NO: 1324 - protein, 160 aa, Propionibacterium acnes
MGLRIVVAADPAAVEYKDVVKADLEADSRVDDVIDVGVQAGDDTLYPHIGIKGAHVIKDGKADRGIFFCGTGMGMAITANKVPGIRACTAHDSFSVERLIMSNDAHVLCLGQRVIGRELARRLAHEFIGYTFDPSSHSKANIDLIDAYESGAGESAPGNC

SEQ ID NO: 1325 - protein, 157 aa, Propionibacterium acnes
MTFKPSHVHIGTDHAAFELKEYLVGKLTEAGYQVVDHGAASYDSQDDYPDYCIPCAQAVMADPGSLGIVLGGSGNGEQIAANKVKGIRAALAYTVEIAELARLHNNANVVSLGGRMQTQEEAWQIVETFLTTDFSPEDRHQRRIDKLIRWEDKGSLG

SEQ ID NO: 1326 - protein, 157 aa, Propionibacterium acnes
MTFKPSHVHIGTDHAAFELKEYLVGKLTEAGYQVVDHGAASYDSQDDYPDYCIPCAQAVMADPGSLGIVLGGSGNGEQIAANKVKGIRAALAYTVEIAELARLHNNANVVSLGGRMQTQEEAWQIVETFLTTDFSHEDRHQRRIDKLIRWEDKGSLG

SEQ ID NO: 1327 - protein, 162 aa, Propionibacterium freudenreichii subsp. shermanii
MGFKVAVAADAAGVDYKEAIKADLEADPRVDEVIDVGIAPGETTPYPRKGIAGARVIAEGDADRGIFVCGTGMGMAISANKVPGIRACTAHDSFSVERLVMSNNAQVLCLGERVIGLELARRLAHEFLDYTFDPTSHSKANVDLIVEYEKETGADDNSVTSC

SEQ ID NO: 1328 - protein, 148 aa, Propionibacterium freudenreichii subsp. shermanii
MRIAMGSDHAGFELKEHLKGYLQGKGHDVIDVGTHSTESVDYPVYGAGAARKVAAGEADRAIVVCGTGLGIGMAAGKVPGIRCAIVSEVYSAQMSRLHNDANALALGARVIGTGVAEEIVDVWTTTDFLGGRHGRRVDMIEDPPALDA

SEQ ID NO: 1329 - protein, 160 aa, Propionibacterium freudenreichii subsp. shermanii
MRIAMGSDHAGFDLKEHLKEYLQGKGHEVIDVGTHSTESVDYPIYGAAAARKVADGEAATAIVVCGTGVGIGISANKVHGIRCAITSDVYAARMSRAHNDANALALGGRVVADGLAEEIVDVWLATDFEGGRHARRVGEITALEDGQDITADDLDEHDQL

SEQ ID NO: 1330 - protein, 160 aa, Actinosynnema mirum
MTAQLRIVVGSDDAGFEYKEALKRDLEASGAVVSVVDVGVDPDGHTPYPAVAVSAAEMIARGEADRALLVCGTGLGVAIAANKVTGVRAVTAHDSFSVERAVLSNNAQVLCFGQRVVGLELARRLAREWLEYRFDEGSASAQKVALITEYDEGRETAGTR

SEQ ID NO: 1331 - protein, 161 aa, Actinosynnema mirum
MADFTDVRVYLGSDHAGFELKTHLVQYLTETGHEVVDVGPAVYDAEDDYPPFCIEAARRVVADEGSLGIVIGGSGNGEQIAANKVPGARCALAYNVETAQLARQHNNAQLIGVGGRMHTTEEATAIVEAFLATPFSEQERHARRIDILAEYERTGQAPALP

SEQ ID NO: 1332 - protein, 152 aa, Saccharomonospora viridis
MGLRIIVGGDNAGYNYKEALKKDLEADERVDSVVDVGVTGTEDETYYPNVAIAAAEKIAAGEADRALLICGTGLGVAIAANKVKGVRAVTAHDVYSVQRSVLSNNAQVLCMGERVIGLELARALVKEWLGLTFDPNSSSGPKVDAICAYEGV

SEQ ID NO: 1333 - protein, 153 aa, Saccharomonospora viridis
MRVVVAADNAGVDLKNLVRDQLRADERVSEVIDLGAASVDDDTAYPHFGLAAAEKIANGEADRGILVCGTGIGMAISANKVTGIRATVAHDSYSAERSIKSNNCQIITFGARVIGPELAKKITHEWIGYTFDPTSASAAKVARITEYETQAAC

SEQ ID NO: 1334 - protein, 157 aa, Saccharomonospora viridis
MRVYLGSDHAGYELKNHLVAHLRERGYEVTDVGPHVYDAADDYPAFCIETARRVVADEGSLGIVIGGSGNGEQIAANKVPGARAGLAWSVETARLTREHNHAQLIGVGARMHTLEEATEIVEAFLTTPPSEDARHVRRVGQISDYERTGTPPALPQS

SEQ ID NO: 1335 - protein, 163 aa, Saccharopolyspora erythraea
MTDQTPWRIVVGSDDAGLAYKDALKKDLENDERVAEVVDVGVGSDEHTAYPHVAVNAARMVAEGKADRALLVCGTGLGVAISANKVPGIRAVTAHDSYSVQRSVLSNNAQVLCFGERVIGLELARTLASQWLDHRFDETSASAEKVAAIGSYESTSDSSGVAC

SEQ ID NO: 1336 - protein, 149 aa, Saccharopolyspora erythraea
MRVVVGSDDAGLQYKDVLKGDLAEDPRVGSVVDVGVNGDDVTAYPNIAIAAAEMVARGEADRALLVCGTGLGVAISANKVKGIRAVTAHDSFSVERSVLSNNAQVLTFGQRVIGLELARRLAREWLGYRFDPDSASAGKVAVLSDYEGC

SEQ ID NO: 1337 - protein, 156 aa, Saccharopolyspora erythraea
MRVYLGSDHAGFELKNHLVKWLTEQGHEVTDVGPAEYDAQDDYPPFCVETARRVVADEGSLGLVLGGSGNGEQIAANKVPGARAALTWNVDTAKLARQHNNALLAGIGARMHTVEEVQAIVEAFLGTDFEGGRHQRRIDLLTDYERTGEPPALPGN

SEQ ID NO: 1338 - protein, 163 aa, Streptomyces albus
MRVYLGSDHAGYELKNHLVDWLKANGHDPVDCGPHVYDAADDYPPFCLRAAERTAADPDSLGIVIGGSGNGEQIAANKVKGVRCALAWSKETAALGREHNNANVVSVGARMHTEEEATDFVATFLATPYSDEARHTRRIDMLSAYETTGELPPIPAHHPQHDA

SEQ ID NO: 1339 - protein, 151 aa, Streptomyces ambofaciens
MRISVSSDMDEPVARLLVEELRGRGHEVRAHGALSPGADARWAVCSERAAREVADGTADQAVVCCWTGTGASIAANKVPGVRAALCTDAYTADGARRWNDANVLALSLRLTSGPLLGEILDAWFAGTPSEDAEDRDGVTRVRRLDEGRAAP

SEQ ID NO: 1340 - protein, 156 aa, Streptomyces avermitilis
MRISVSSDMDEPVARSLLAELRGRGHEVVAHGALRPGDDTRWAACSAAAAREVATGTSDQAVVCCWTGTGASIAANKVPGVRAALCTDAYTADGARRWNDANVLALSLRLTSQPLLREILDAWFAAEAGEDADDRENVAHVGRLDADRTGGAADRG

SEQ ID NO: 1341 - protein, 159 aa, Streptomyces avermitilis
MYLGSDHAGFELKNHLVEWLKAAGHEPVDCGPHIYDAQDDYPPFCLRAAEGAAADPDALGIVIGGSGNGEQIAANKVKGVRAALAWSEETASLGRQHNDANVVAVGARMHTQEEATKFVETFLNTPFSGDARHIRRIDMLSAYETTGDLPAIPAHHPQQ

SEQ ID NO: 1342 - protein, 155 aa, Streptomyces clavuligerus
MRVVVGSDRAGAAYCTVLVDHLHDQPRVQQIITTGTGEGDVRPYPEIALAAAQLIGVGLADRALLVCHTGVGMAIAANKVTGIRAATAHDPLSVEHAVTHNNAQVLCLGAGVIGLALAQQLTKSWLNHSFDPASRAAARIALITDAEHRRRSALY

SEQ ID NO: 1343 - protein, 170 aa, Streptomyces coelicolor
MTDKLRIVVGSDDAGHQYKEALKQDLRGSALVAEVTDVGVDADGHTAYPKVAIAAAEMVARGEADRALLVCGTGLGVAIAANKVRGIRAVTAHDSFSVERAILSNNAQVLTFGQRVVGLELARRLAAEWLTYRFDENSASAAKVQLMSDYETADDAGAASGSAADGGAAA

SEQ ID NO: 1344 - protein, 152 aa, Streptomyces coelicolor
MRISVSSDMDEPVARLLVEELRARGHEVRAYGALSPGADPRWAACSERAAREVAEGRADQAVVCCWTGTGASIAANKVPGVRAALCADAYTADGARRWNDANVLAIGLRLTSAPLLREILDAWFAGGPSTDAEDRDNVAHVERLDEDRRAAR

SEQ ID NO: 1345 - protein, 159 aa, Streptomyces coelicolor
MYLGSDHAGFELKNHLVEWLAAAGHEPVDCGPHIYDAQDDYPPFCLRAAERTAADQGALGIVIGGSGNGEQIAANKVKGVRAALAWSEETASLGRQHNNANVVAVGARMHTQEEATKFVETFLGTPFSGDERHIRRIDMLTSYETTGDLPPVPSHHPQQ

SEQ ID NO: 1346 - protein, 162 aa, Streptomyces roseosporus
MRVYLGSDHAGYELKNHLVEWLGAHGHEAVDCGPHIYDAQDDYPPFCLRAAEKTAADPDSLGIVIGGSGNGEQIAANKVKGVRAALAWSEQTAALGREHNNANVVAIGGRMHTVEESTKFVEIFLSTPYSNEERHTRRIEMLSAYENTGELPPIPAHHPQQG

SEQ ID NO: 1347 - protein, 164 aa, Streptomyces flavogriseus ATCC 33331
MSEKLRIVVGSDDAGHAYKEALRKDLEASGLVATVTDVGVDADGHTAYPKVAIAAAEMVARGEADRALLVCGTGLGVAIAANKVKGVRAVTAHDSFSVERAVLSNNAQVLTFGQRVVGLELARRLASEWLTYRFDEASASAAKVALMDDYENKNDHENQQEAAA

SEQ ID NO: 1348 - protein, 162 aa, Streptomyces flavogriseus ATCC 33331
MRVYLGSDHAGYELKNHLVEWLTAHGHEAVDCGPHIYDAQDDYPPFCLRAAERTAADKDSLGIVIGGSGNGEQIAANKVKGVRAALAWSEQTAALGREHNDANVVAIGGRMHTLEESTKFVEIFLATPYSGEERHTRRIEMLSAYENTGELPPIPAHHPQQG

SEQ ID NO: 1349 - protein, 151 aa, Streptomyces ghanaensis
MRISVSSDMDEPVARALLAELRERGHDVRAHGALSHGDDPQWAVCSEAAAREVAAGTADQAVVCCWTGTGASIAANKVPGVRAALCTDATTADGARRWNDANVLALSLRLTSEPLLKEILDAWFAGTPSDDAEDRRNVDRVRRLDQERTGA

SEQ ID NO: 1350 - protein, 161 aa, Streptomyces ghanaensis
MRVYLGSDHAGYELKNHLVEWLKGAGHEPVDCGPHIYDAQDDYPPFCLRAAERTAADPGALGIVIGGSGNGEQIAANKVKGVRAALAWSEETAALGRQHNNANVVAVGARMHTQDEATAFVETFLNTPFSQDERHIRRIDMLADYETTGDLPPIPPHHPQQ

SEQ ID NO: 1351 - protein, 151 aa, Streptomyces griseoflavus
MRISVSSDMDEPVARALVAELHERGHEVRAHGALSLGDDTQWAVCSEAAAREVASGTADQAVVCCWTGTGASIAANKVPGVRAALCTDAGTADGARRWNDANVLALSLRLTSGPLLKEILDAWFAGVPSDDPEDRRNVERTARLDRERAGS

SEQ ID NO: 1352 - protein, 161 aa, Streptomyces griseoflavus
MRVYLGSDHAGYELKNHLVEWLEKAGHEPVDCGPHIYDAQDDYPPFCLRAAERTAADEGALGIVIGGSGNGEQIAANKVKGVRAALAWSEETAALGRQHNNANVVAVGARMHTQDEAVKFVETFLSTPFSGDERHIRRIDMLAGYETTGDLPPVPAHHPQQ

SEQ ID NO: 1353 - protein, 162 aa, Streptomyces griseus
MRVYLGSDHAGYELKNHLVEWLGAHGHEAVDCGPHIYDAQDDYPPFCLRAAEKTAADPDSLGIVIGGSGNGEQIAANKVKGVRAALAWSEQTAALGREHNNANVVAIGGRMHTVEESTKFVEIFLATPYSNEERHTRRIEMLTAYENTGELPPIPAHHPQQG

SEQ ID NO: 1354 - protein, 158 aa, Streptomyces hygroscopicus
MTGQQQPLRLIVGCDDAGLEYKEALKSDLLADGRIAEVVDVGVSVGDTTAYPHVAVTAARLVAEGKAERALLVCGTGLGMAISANKVPGVRAVTAHDSFSVERAVLSNDAQVLCFGQRVVGLELARRLAREWLDYRFDTSSASAAKVAAICGYEERGG

SEQ ID NO: 1355 - protein, 154 aa, Streptomyces hygroscopicus
MTTATPFRIVVGCDDAGYGYKEALKQDLLDDPRVAEVIDVGVGSDEHTAYPHVAVEAARRVADGTADRALLVCGTGLGVAISANKVPGIRAVTAHDSYSVRRSVLSNNAQVLCFGQRVIGLELARALTDDWLAQRFDETSSSAEKVAAIQSYES

SEQ ID NO: 1356 - protein, 162 aa, Streptomyces hygroscopicus
MRVYLGSDHAGYELKNHLVEWLRAGGHDPVDCGPHIYDAQDDYPPFCLRAAERTAADADSLGIVIGGSGNGEQIAANKVKGVRAALAWSEQTAALAREHNDANVISIGGRMHTQDEATKFVEIFLATPYSGEERHTRRIDMLAAYETTGDLPPIPAHHPAGD

SEQ ID NO: 1357 - protein, 170 aa, Streptomyces lividans
MTDKLRIVVGSDDAGHQYKEALKQDLRGSALVAEVTDVGVDADGHTAYPKVAIAAAEMVARGEADRALLVCGTGLGVAIAANKVRGIRAVTAHDSFSVERAILSNNAQVLTFGQRVVGLELARRLAAEWLTYRFDESSASAAKVQLMSDYETADDAGAASGSAADGGAAA

SEQ ID NO: 1358 - protein, 152 aa, Streptomyces lividans
MRISVSSDMDEPVARLLVEELRARGHEVRAYGALSPGADPRWAACSERAAREVAEGRADQAVVCCWTGTGASIAANKVPGVRAALCADAYTADGARRWNDANVLAIGLRLTSAPVLREILDAWFAGGPSTDAEDRDNVAHVERLDEDRRAAR

SEQ ID NO: 1359 - protein, 161 aa, Streptomyces lividans
MRVYLGSDHAGFELKNHLVEWLAAAGHEPVDCGPHIYDAQDDYPPFCLRAAERTAADQGALGIVIGGSGNGEQIAANKVKGVRAALAWSEETASLGRQHNNANVVAVGARMHTQEEATKFVETFLGTPFSGDERHIRRIDMLTSYETTGDLPPVPSHHPQQ

SEQ ID NO: 1360 - protein, 160 aa, Streptomyces pristinaespiralis
MYLGSDHAGFELKNHLVEWLKAHGHEPVDCGPHIYDAQDDYPPFCLRAAERTAADEGSLGIVIGGSGNGEQIAANKVKGVRAALAWSEQTAALGREHNNANVVAIGGRMHTLEESTKFVEIFLGTPYSGEERHTRRIEMLSAYETTGELPPIPAHHPQQG

SEQ ID NO: 1361 - protein, 154 aa, Streptomyces scabiei 87.22
MRISVSSDMDEPVARLLLTELRDRGHEVLAHGALREGDDPRWAVCSEAAARDVAAGRADQAVVCCWTGTGASIAANKVPGVRAALCADAYTADGARRWNHANVLAIGLRLTSGPLLKEILDAWFAAEDGRDADDRENVAHVDRLDVSRGHGRAG

SEQ ID NO: 1362 - protein, 185 aa, Streptomyces scabiei 87.22
MGSSRFAGSAPRRAMPKHACHTRTMRVYLGSDHAGYELKNHLVEWLKAAGHEPVDCGPHIYDAQDDYPPFCLRAAERTAADPGSLGVVIGGSGNGEQIAANKVAGVRAALAWSAETAALGREHNNANVVAVGARMHAQDDATKFVETFLNTPFSGDERHIRRIDMLAAYETTGDLPPVPAHHPQP

SEQ ID NO: 1363 - protein, 151 aa, Streptomyces sp. AA4
MRIVVAADNAGVELKNQLRDLLRADERVTEVTDLGVPDAADDRAYPLLGLAAAEAIARGEADRGVLVCGTGIGMAISANKVPGVRATVAHDSYSAERSIKSNDCQVITFGARAIGPEVAKKIVAEWVGYRFDPASASATKVAHITEYENAH

SEQ ID NO: 1364 - protein, 157 aa, Streptomyces sp. AA4
MRVYLGSDHAGFELKNHLVRHLGEQGHEVTDIGPFVYDAADDYPAFCVETARRVAADEGSLGIVIGGSGNGEQIAANKVPGIRAGLGWSVETAQLTRQHNHAQVLGVGARMHTQEQATEIVDAFLATPVDPAERHTRRVRQLLDYERTGTPPALPEA

SEQ ID NO: 1365 - protein, 151 aa, Streptomyces sp. Mg1
MRISVSSDMDEPVARALLGQLRDRGHDVVAYGALSPGDDPQWAACSEAAAREVAAGNAAQAVVCCWTGTGASIAANKVPGVRAALCTDAYTADGARRWNDANVLALSLRLTSEPLLKEILDAWFAAEASADAEDRANVARVERLDHTRTRS

SEQ ID NO: 1366 - protein, 161 aa, Streptomyces sp. Mg1
MRVYLGSDHAGFELKNHLVDWLKNNGHEPVDCGPHIYDAVDDYPPFCLRAAEKTAADADSLGIVIGGSGNGEQIAANKVKGVRAILAWSVETAKLGREHNNANVISVGGRMHTQDEAVSFIEAFLATPYSGEERHTRRIEMLSAYERTGELPPIPAHHPQG

SEQ ID NO: 1367 - protein, 161 aa, Streptomyces sp. SPB74
MYLGSDHAGYELKNHLVEWLSEHGHEPVDCGPHIYDAQDDYPPFCLRAAERAAADPEALGVVIGGSGNGEQIAANKVEGVRCALAWSVETAKLGREHNNANVVSVGARMHSTDEATSFVEVFLTTPYSEEPRHTRRIEMLTAYEKSGVLPPVPAHHPQPEA

SEQ ID NO: 1368 - protein, 168 aa, Streptomyces sp. SPB74
MAADRIAVAADHNGLALKAALSAWLRGRGYAVHDLGAYGSDADAVVDYPPLCWALCREVTAGRAARGIVLGGSGLGETVVCNKVPGIRAGLCHDVWNAGVSRGNNDANVLVLAARTLPPARALEVAETWLTTPFRGGAHARRLAQIAAVERGEAPTGEPPTGEPPALG

SEQ ID NO: 1369 - protein, 163 aa, Streptomyces sp. SPB78
MRVYLGSDHAGYELKNHLVEWLTEHGHEPVDCGPHLYDAQDDYPPFCLRAAERTAADPEALGVVIGGSGNGEQIAANKVEGVRCALAWSVETAKLGREHNNANVVSVGARMHSTDEATSFVEVFLSTPYSEEPRHTRRIEMLTAYEKSGVLPPVPAHHPQPEA

SEQ ID NO: 1370 - protein, 151 aa, Streptomyces sp. SPB78
MAADHNGLALKAELSAWLRGGGYDVHDLGAYGDDPDTVVDYPPLCWALCREVTAGRAARGIVLGGSGLGETVVCNKVPGIRAGLCHDVWSAGVSRGNNDANVLVLAARTLPPARALEVAGTWLTTHFRGGVHARRLAQIAAVERGEPPTGG

SEQ ID NO: 1371 - protein, 161 aa, Streptomyces sviceus ATCC 29083
MRVYLGSDHAGFELKNHLVDWLKAAGHDVVDCGPHIYDAQDDYPPFCLRAAERTAADADSLGIVIGGSGNGEQIAANKVKGVRAALAWSEETASLGRQHNNANVVAVGARMHSAEEATKFVETFLATPFSGDERHQRRIDMLSAYETTGGLPAIPAHHPQQ

SEQ ID NO: 1372 - protein, 161 aa, Streptomyces viridochromogenes
MRVYLGSDHAGYELKNHLVEWLKAAGHDPVDCGPHIYDAQDDYPPFCLRAAERTAADPGALGVVIGGSGNGEQIAANKVKGVRAALAWSEETAGLGRQHNNANVVAVGARMHSQDEATKFVEVFLSTPFSGDERHIRRIDMLKSYETTGDLPPIPPHHPQQ

SEQ ID NO: 1373 - protein, 155 aa, Nocardiopsis dassonvillei
MRVYLGSDHAGYELKEHLVSWLREQGHDVVDAGPAAYDAADDYPPFVLRAAEGAASDKGSLGVVIGGSGNGEQIAANKVRGVRAALAWSEDTARLAREHNDANVLSLGARMHSAQEATRFVEVFLTTPYSDEERHTRRIAMLTAYEETGELPPLP

SEQ ID NO: 1374 - protein, 166 aa, Thermobifida fusca YX
MRAPGTCKTGAVRIYIGSDHAGYELKQHLVSWLQKQGHDVIDAGPAVYDAADDYPPFVLRAAEGVAKDPEALGIVLGGSGNGEQIAANKVKGVRAALVWSNETAKLAREHNNANVISIGARMHTIDEATGFVDTFLTTPYSGEERHSRRIRMLSDYETTGQLPPLP

SEQ ID NO: 1375 - protein, 169 aa, Streptosporangium roseum
MGVEPATHTCETGRVRVYIGADHAGYELKNHVVSWLKEHGHEVTDCGPFVYDPEDDYPPFVLRAAEGVAEDPGSLGIVIGGSGNGEQIAANKVRGIRAALAWSEDTAKLAREHNNANVVSVGSRMHTQEEATRLVELFLGTAYSGAERHNRRIAQLTSYETIGQLPPLP

SEQ ID NO: 1376 - protein, 155 aa, Thermomonospora curvata
MRVYLGSDHAGFELKQHLIGWLADNGHEPVDCGPQVYDAADDYPPFVLRAAERTAADPGSFGIVLGGSGNGEAIAANKVKGIRAALVWNEEIAALAREHNDANVISIGARQHDLATATRFVEVFLNTPYSKEERHTRRIGMIGSYETTGELPPLP

SEQ ID NO: 1377 - protein, 154 aa, Atopobium parvulum
MRIAVGSDHAGFIQKDPIIEHIKSLGHEVLDFGPANDDRVDYPDFADKVARAVAAGKADRGVLICGTGIGIAMTADKVPGIRATPVQTVQFAELAREHNNANVIGLSGRFTDLAVNEAIVDTFLSTEFAGGRHTGRVEKIMREDDPNFKGVDAE

SEQ ID NO: 1378 - protein, 151 aa, Atopobium rimae
MRVAIASDHAGFIQKAPIAEYIESLGHEVIDFGPENDDRVDYPDYADKVARYVAAGGADRGVLICGTGLGIAMTADKVAGIRATPVQTPQFAQLAREHNNANVIGLSGRFVDVEVNKEIVKVFLTQEFGGGRHAGRVVKIMREDNPAFEGV

SEQ ID NO: 1379 - protein, 153 aa, Atopobium vaginae DSM 15829
MKVAIGSDHAGFEQKPALVEWLTSLGYEVIDLGPTTDARCDYPDFADKVARYVAEGKADRGILICGTGIGMAITADKVKGVRASCIQTPHFAHLFREHNNGNVVCISGRFTPYEINRDIVKEFLTTEFAGGRHAGRVDKIMREDDDAFCGVCA

SEQ ID NO: 1380 - protein, 155 aa, Collinsella aerofaciens ATCC 25986
MKIGIGNDHAAVELKNIISEHLKERGCEVVNFGTDTSESFDYPIAGYKVGKAVANGDVDLGILICGTGVGISLAANKVEGVRAVVCSEPFSAKLSRMHNNTNVLAFGARVVGSELAKMIVDEWLDAEFEGGRHERRVNLLNEIDHTRGLKVVDEA

SEQ ID NO: 1381 - protein, 153 aa, Collinsella intestinalis DSM 13280
MYKRKDVHMRIAIASDHGGFEQKQALAAYIADELGFDVTDMGPDTDASVDYPDYAAPVAKAVSAGEADRGVLVCGTGIGMAVAADKVAGVRASSITSVPFAELFRQHNNGNVVCLSGRFVDLEVNKEIVKTFLTTEFEGGRHEARVAKIMALD

SEQ ID NO: 1382 - protein, 145 aa, Collinsella stercoris DSM 13279
MRVAIASDHGGFEQKQALVDYLTNELGCEVSDMGPDSDASVDYPDFAVKVAQAVSTNEADRGVLVCGTGIGMALAADKVAGVRASSITSVPFAELFRQHNNGNVVCLSGRFVDLDLNKEIVKTFLTTEFEGGRHEARVAKVMALD

SEQ ID NO: 1383 - protein, 144 aa, Cryptobacterium curtum DSM 15641
MIISMGSDHAGFEQKEQLKQYLETAGHTVIDRGCPSEERVDYPDYAYPVACDVAQGTAERGVLVCGTGIGMALAADKVAGVRAANIITPQFAGLCREHNDCNVITLSGRFVDVGVNKEIVDVFLATPFGAGRHTGRVEKIMQLD

SEQ ID NO: 1384 - protein, 146 aa, Eggerthella lenta DSM 2243
MKISIASDHAGFEQKQALVGYLASKGHDVIDRGPDCDDRVDYPDYAARVAHDVVDGMAERGVLVCGTGIGMAVAANKIDGIRAANVTSPLFAALAREHNDANVVAVSGRFVDESVNREILDAFVSTSFGGGRHAGRVEKIAALENE

SEQ ID NO: 1385 - protein, 146 aa, Slackia heliotrinireducens DSM 20476
MKLSIASDHAGFEQKELLRAYLESAGHEVIDRGPNSDDRVDYPDYAVPVANDVADGTVERGVLVCGTGIGMALAADKVAGVRAANIITPQFAALCREHNDANVITLSGRFVDVDTNKEILDVFLTTEFGGGRHAGRVEKIMALDAR

SEQ ID NO: 1386 - protein, 162 aa, unknown
  marine actinobacterium PHSC20C1
MRIHIATDHAGLEFSATLQQHLTDAGHEVIDHGPVEYDALDDYPGFCIAAARGVAADQTAGIQALGVVFGGSGNGEQIAANKVTGIRAALVWNDSTAALARQHNDANVISIGARQHTVDEATRFIDLFIAEPFSGEERHARRIAQLAEYETTGTIAAHPFEN

SEQ ID NO: 1387 - protein, 154 aa, Aquifex aeolicus VF5
MKIAIGSDHAGFPLKEKIKEFLKGEGHKVIDVGTHAQESTHYPIYAKEVVRAIRSGKAERGILICGTGIGMSITANKFRGIRAALCTNEYMARMSRLHNDANVLCLGERVLGVELALSIVKVWLETPFEGGRHLKRLEIISEIEDEICGENIPR

SEQ ID NO: 1388 - protein, 148 aa, Hydrogenivirga sp. 128-5-R1-1
MKIAVGSDHAGFPLKERIKEFLLEEGHEVIDFGTTSEESTHYPLFARDVSLAVQSGEADRGILVCGTGIGMSITANKFRGIRAALCFNEYMARMSRLHNDANVLCLGDRVIGEDLALAIVEVWLKTPFEGGRHAKRVELIANIEREHL

SEQ ID NO: 1389 - protein, 148 aa, Hydrogenobaculum sp. Y04AAS1
MRIAIGSDHAGFDLKEALKEHIISKGHELIDCGTHSKESTDYPLYAKEVALHIKNQKADRGILICGSGLGMSISANKIKGIRAALCLNEYMARMSVKDNNANVLCLGGRVIGVELAKSIVDAWFDAHFEGGRHERRLRIISSFEEEGI

SEQ ID NO: 1390 - protein, 148 aa, Persephonella marina EX-H1
MKISIGSDHAGFELKEIIKDHLQKKGYEVVDKGTYSKESVDYPLFGEAVGRSVSEGETDRGIVICGTGIGISISANKIKGVRAALCTNEYMARMSRKHNDANVLALGSRVLGIDLALSIVDTFLSTDFEGGRHERRVHLIQNIEKINL

SEQ ID NO: 1391 - protein, 148 aa, Sulfurihydrogenibium azorense Az-Fu1
MKIALGSDHGGFFYKEKIKEYLKSKKYEIIDKGTYSPEPVDYPYFGENVGMAVASGEADRGIIICGTGIGISIAANKIKGVRAALCTNEFMARMARSHNDANVLALGQRVIGLDHALAIVDVFLETPFEGGRHERRVKLILDIEEGKI

SEQ ID NO: 1392 - protein, 148 aa, Sulfurihydrogenibium sp. YO3AOP1
MKIAIGSDHGGFFYKEKIKEYLKSKKYEVIDKGTYSPEPVDYPYFGEEVGKSVQSGEADRGIIICGTGIGISIAANKIKGVRAALCTNEFMARMARSHNDANVLALGQRVIGLDHALAIIDVFLETPFEGGRHERRVKLILDIEKGII

SEQ ID NO: 1393 - protein, 144 aa, Bacteroides caccae
MKTIGLACDHAGFELKEYVRGWLEAKGWAYKDFGTNSTASVDYPDYAHPLALAVESGECYPGIAICGSGNGINMTLNKHQGVRAALCWNAEIAHLARQHNDANILVMPGRFISTEEADMILTEFFSTQFEGGRHQNRINKIPIK

SEQ ID NO: 1394 - protein, 144 aa, Bacteroides capillosus ATCC 29799
MIALGSDHGGFALKQHIKTYLDSRGIAWKDFGCDSTESCDYPDFGAAAAKAVASGECEKGIVVCTTGIGISITANKVKGIRCALCRDVLSAELTRKHNNANMLALAGGFTGPFEAEHIVSAFLDTEFEGGRHERRVNKMMALED

SEQ ID NO: 1395 - protein, 144 aa, Bacteroides cellulosilyticus DSM 14838
MKTIGICSDHAGFELKQYIKGWLETKGWEYKDFGTYTTESCDYADFAHPLALAVEAGECYPGIAICGSGEGISMTLNKHQGIRAALCWTAEIAHLARQHNDANVLVMPGRFISTEEADMIMREFFSTQFEGGRHQKRIDKIPVR

SEQ ID NO: 1396 - protein, 144 aa, Bacteroides coprocola DSM 17136
MKVIGLASDHAGFELKQYVKQWLEAKGWEYKDFGTYSTDSCDYPDFAHPLALAVEAGECYPGIAICGSGEGIGMTLNKHQGIRAALCWIPEIAHLARQHNDANVLVMPGRFINTEMADKIMSEFFTTDFEGGRHQARIDKIPVK

SEQ ID NO: 1397 - protein, 144 aa, Bacteroides coprophilus DSM 18228
MKIIGLASDHAGFELKEFVKQWLEQKGWEYKDFGTYSTASCDYPDFAHPLAEAVEAGECYPGIAICGSGEGISMTLNKHQGIRAALCWIPEIARLARQHNDSNVLVMPGRFIDTATADQIMTEFFNTAFEGGRHQARIDKIPVK

SEQ ID NO: 1398 - protein, 144 aa, Bacteroides dorei DSM 17855
MKKVGLASDHAGFELKEFVKTWLTEKGYPCKDFGTYSTESCDYADYAHPLALAIEAGECGPGVAICGSGEGISMTLNKHQGIRAALCWIPEIAHLSRQHNDANVLVMPGRFIDHEMAEKILDEFFNSGFEGGRHQKRIEKIPVK

SEQ ID NO: 1399 - protein, 158 aa, Bacteroides eggerthii
MPSAYRRIQKIIIMKTIGICSDHAGYALKQYVKQWLETKGWEYKDFGTYSPESVDYPDFAHPLALAVEAGECYPGIAICGSGNGINMTLNKHQGIRAALCWTAEIAGLARQHNDANVLVMPGRFVTNQEADEIMTKFFSTPFEGGRHQRRVEKIPVTE

SEQ ID NO: 1400 - protein, 144 aa, Bacteroides finegoldii DSM 17565
MKTIGLACDHAGFELKEYVRGWLEVKGWAYKDFGTTSAASVDYPDYAHPLALAVESGECYPGIAICGSGNGINMTLNKHQGIRAALCWNAEIAHLARQHNDANILVMPGRFISTEEADMILTEFFSTEFEGGRHQKRIDKIPVK

SEQ ID NO: 1401 - protein, 144 aa, Bacteroides fragilis
MKKIGICCDHAGFELKEYVRGWLEAKGWEYKDFGTYSTDSCDYPDFAHPLALAVEAGECYPGIAICGSGNGISMTLNKHQGIRAALCWSAEIAHMARLHNDANVLVMPGRYISTEEADMIMTEFFSTEFEGGRHQKRIDKIPVK

SEQ ID NO: 1402 - protein, 144 aa, Bacteroides fragilis
MKKIGICCDHAGFELKEYVRGWLEAKGWEYKDFGTYSTDSCDYPDFAHPLALAVEASECYPGIAICGSGNGISMTLNKHQGIRAALCWTAEIAHMARLHNDANVLVMPGRYISTEEADMIMTEFFSTEFEGGRHQKRIDKIPVK

SEQ ID NO: 1403 - protein, 144 aa, Bacteroides fragilis
MKKIGICCDHAGFELKEYVRGWLEAKGWEYKDFGTYSTDSCDYPDFAHPLALAVEAGECYPGIAICGSGNGISMTLNKHQGIRAALCWTAEIAHMARLHNDANVLVMPGRYISTEEADMIMTEFFSTEFEGGRHQKRIDKIPVK

SEQ ID NO: 1404 - protein, 144 aa, Bacteroides intestinalis DSM 17393
MKTIGICSDHAGFELKQYVKGWLETKGWEYKDFGTYTTESCDYADFAHPLALAVEAGECYPGIAICGSGEGISMTLNKHQGIRAALCWTAEIAHLARQHNDANVLVMPGRFISTEEADMIMREFFSTQFEGGRHQKRIEKIPVR

SEQ ID NO: 1405 - protein, 144 aa, Bacteroides ovatus
MKTIGLACDHAGFELKEYVRGWLEAKGWAYKDFGTNSTASVDYPDYAHPLALAVESGECYPGIAICGSGNGINMTLNKHQGVRAALCWNAEIAHLARQHNDANVLVMPGRFISTEEADMILTEFFSTKFDGGRHQNRIDKIPVK

SEQ ID NO: 1406 - protein, 142 aa, Bacteroides pectinophilus ATCC 43243
MIAIGCDHGGFELKNEVIEHLKSRGIECVDVGCHSRESCDYPEFAKAVCAQITDGQCQLGILICGTGIGMSIAANKVRGIRAALCGDCFSAQATKEHNNANVLCLGARVTGPGLALKIVDTFLDTPFSNDERHVRRISKIED

SEQ ID NO: 1407 - protein, 144 aa, Bacteroides plebeius DSM 17135
MKTIGLASDHAGFELKQYVKKWLEAKGWEYKDFGTYTTDSCDYPDFAHPLALAVENGECYPGIAICGSGEGIGITLNKHQGIRAALCWIPEIAHLARQHNNANVLVMPGRFIDEAMADKIMTEFFTTDFEGGRHQARIDKIPVR

SEQ ID NO: 1408 - protein, 143 aa, Bacteroides sp. 2_1_33B
MDIVGLCSDHAGFELKEYIKTILDKRGLSYKDFGTYSSDSCDYPDFAHLMGKAVEAGEVYPGIAVCGTGNGISMTLNKHRGVRAALCWREDIAKLAREHNDANVLSMPGRFISKEEAKKIVEIFLDTPFEGGRHQRRIDKIPL

SEQ ID NO: 1409 - protein, 143 aa, Bacteroides sp. 2_1_7
MGIVGLCSDHAGFELKEYIKTILDKRGLSYKDFGTYSSDSCDYPDFAHLMGKAVEAGEVYPGIAVCGTGNGISMTLNKHRGVRAALCWREDIAKLAREHNDANVLSMPGRFISKEEAKKIVEIFLDTPFEGGRHQRRIDKIPL

SEQ ID NO: 1410 - protein, 145 aa, Bacteroides stercoris
MKTIGLCSDHAGFELKEYVRGWLEAKGWPYKDYGTYSTESCDYPDFAHQLAQAVEAGECYPGIAICGSGNGINMTLNKHQGIRAALCWTAEIAHLARQHNDANVLVMPGRFIGTEEADMIMTEFFNTSFEGGRHQRRIDKIPVQG

SEQ ID NO: 1411 - protein, 144 aa, Bacteroides thetaiotaomicron
MKTIGLACDHAGFELKEYVRGWLEVKGWAYKDFGTNSAASVDYPDYAHPLALAVESGECYPGIAICGSGNGINMTLNKHQGIRAALCWNAEIAHLARQHNDANILVMPGRFISTEEADMILTEFFSTQFEGGRHQNRIDKIPVK

SEQ ID NO: 1412 - protein, 145 aa, Bacteroides uniformis
MKTIGICSDHAGFELKEYVRGWLEAKGWAYKDFGTYSTESCDYPDFAHPLALAVEAGECYPGIAICGSGEGISITLNKHQGIRAALCWTAEIAHLARQHNDANVLVMPGRFISTEEADMIMREFFSTPFEGGRHQRRVDKIPVHL

SEQ ID NO: 1413 - protein, 144 aa, Bacteroides vulgatus
MKKVGLASDHAGFELKEFVKTWLTEKGYPCKDFGTYSTESCDYADYAHPLALAIEAGECGPGVAICGSGEGISMTLNKHQGIRAALCWMPEIAHLSRQHNDANVLVMPGRFIDHEMAEKILDEFFNSGFEGGRHQKRIEKIPVK

SEQ ID NO: 1414 - protein, 143 aa, Parabacteroides distasonis ATCC 8503
MGIVGLCSDHAGFELKEYIKTILDERGLSYKDFGTYSSDSCDYPDFAHLMGKAVEAGEVYPGIAVCGTGNGISMTLNKHRGVRAALCWREDIAKLAREHNDANVLSMPGRFISKEEAKKIVEIFLDTPFEGGRHQRRIDKIPL

SEQ ID NO: 1415 - protein, 143 aa, Parabacteroides johnsonii DSM 18315
MKTLGLCSDHAGYELKEFVKQILNSKGLTYKDFGTCSTESCDYPDYAHPLAEAVEAGEVYPGIAICGSGNGIAMTLNKHQGIRAALCWQEEIARLAREHNDANVLVMPGRFISQEEATHTVEAFLNTSFEGGRHQRRIDKIPL

SEQ ID NO: 1416 - protein, 143 aa, Parabacteroides merdae ATCC 43184
MKTLGLCSDHAGYELKEFVKQILDSKGLAYKDFGTDSTESCDYPDYAHPLAKAVEAGEVYPGIAICGSGNGIAMTLNKHQGIRAALCWQEEIARLAREHNNANILVMPGRFISQEEATHTVEAFLSTPFEGGRHQRRIDKIPL

SEQ ID NO: 1417 - protein, 144 aa, Porphyromonas endodontalis
MKRFGLCSDHAGFALKEEVKKILTDLGIEYQDFGTYSEERADYPDFAHKLGEAIDSGELEWGIAICGSGNGISMALNKHPHVRAALSWNEEIAALGRAHNNANVLSLPARFVSLDEAKKIIMAFLSTDFEGGRHEARVAKIPLC

SEQ ID NO: 1418 - protein, 145 aa, Porphyromonas gingivalis
METIGICSDHAGYELKERVKAWLAEQGITTKDFGCHSSESVDYPDFAHPLGSAIERGELNRGISICGSGNGISMVMNKYPHVRAALCWTEEIARLARQHNDANVLSLPARFISDEQAKAILKIYLETPFEGGRHKARIDKIPIRK

SEQ ID NO: 1419 - protein, 145 aa, Porphyromonas uenonis 60-3
MKLGVCSDHAGYQLKEQVKEWLAAMQIECVDYGTHSEERCDYPDYAHQLAFAIQMGTVDRGIAICGTGNGMAMTLNKYNVIRAGLAWNEDIAKLIRAHNDANVLVMPARFIETAEAERCLHAFLDTPFEGGRHKERIDKMVLPTC

SEQ ID NO: 1420 - protein, 152 aa, Prevotella bergensis DSM 17361
MEVKTIGLASDHAGFALKQFVKDYLDEKGIPYKDFGAYTDESCDYADFAHPLARAVEANEVYPGIAICGSGEGISITLNKHQGIRAALAWIPDIAHLARQHNNANVLVMPGRFIDNDTARKVMDEFLSTDFDGGRHQRRIDKIPMDSCQKKD

SEQ ID NO: 1421 - protein, 146 aa, Prevotella buccalis
MDIKTVGLACDHAGYEIKEFIKQYLEEKGISYKDYGTNSTSSCDYPDHAHALANAIERGDVYPGIGVCGSGEGMSMTLNKHQGIRAGLAWSPEIAHLTRLHNDANVLVLPGRFVDKETTRKILDEFFSTDFEGGRHSRRIAKIRIQ

SEQ ID NO: 1422 - protein, 147 aa, Prevotella copri DSM 18205
MEVKTVGIACDHAGFPLKQFVLEYLEKKGYPVKDYGTYSDASVDYPDFGHALAKGIESGEVYPGIGICGSGEGIAMTLNKHQGVRAGLAWCKEIAHLVRQHNDANVLVLPGRFVDNKTAEAILDEFFATTFEGGRHERRVKKIPVQQ

SEQ ID NO: 1423 - protein, 148 aa, Prevotella melaninogenica
MEIKTVGVACDHAGYPLKQFVIQYLEEHKYAYKDFGCNSDLSCDYPDYAHPLAEAIESGEVYPGIAICGSGEGMAIALNKHQGVRAGLVWNKDVAELTRQHNDANVAVLPGRFIDNKTAEKILDAFFKASFEGGRHERRVKKIPVQQG

SEQ ID NO: 1424 - protein, 147 aa, Prevotella oris
MEVKTVGLACDHAGFPLKQFVLEYLEKKGYQVKDFGTYSSESVDYPDFAHPLAEAVENGDVYPGIGICGSGEGMAITLNKHQGVRAGLAWDKDIAQLIRQHNDANVIVLPGRFIDNKTAEKILDAFFTATFEGGRHERRVKKIPLKE

SEQ ID NO: 1425 - protein, 147 aa, Prevotella sp. oral taxon 472 str. F0295
MEIKTIGIACDHAGFPLKQYVLQYLEEHGYPYKDYGTYSDQSSDYPDFAHALAKGIESGEVYPGIGICGSGEGIAMTLNKHQGVRAGLAWMPEIAQLIRQHNDANVLVMPGRFVDNNTAKKILDGFFSASFEGGRHLNRVKKIPVTE

SEQ ID NO: 1426 - protein, 153 aa, Prevotella tannerae ATCC 51259
MILNYITMNTTIGLACDHAGFELKQFVIQYLEKKGISYKDYGTYSTMSCDYPDFAHALAEGIEQGEVEKGIAICGSGEGISMTLNKHQSIRAALAWNEEVAGLCRQHNDANVLCMPGRFIDNKTAEKVMDKFFSTPFEGGRHERRINKIPLKP

SEQ ID NO: 1427 - protein, 146 aa, Prevotella timonensis CRIS 5C-B1
MNIKKVGLASDHAGFGLKEIIKEYLDEKGIAYQDFGTHSEASCDYPEYAHALASAVEKGDVYPGIGVCGSGEGMSMTLNKHQGIRAALVWQPEIAHMTRMHNDANVLVLPGRYMDKETAWQVLDEFFNTEFEGGRHVRRIEKIPVE

SEQ ID NO: 1428 - protein, 148 aa, Prevotella veroralis
MEIKTVGVACDHAGFPLKQFVIQYLEQHKYAYKDFGCNSDLSCDYPDYAHPLAEAIESGEVYPGIAICGSGEGMAMTLNKHQGVRAGLVWNKDVAELTRQHNDANAIVLPGRFIDNKTAEKILDEFFKASFEGGRHERRVKKIPVQEG

SEQ ID NO: 1429 - protein, 150 aa, Alistipes putredinis DSM 17216
MEKKIGIASDHAGYEMKEFLVGYLAAKGWDVLDFGPESEESVDYPDFAHPLANAIESGELERGIGLCGSGEGMAITLNKHQGIRAGLVWDKQIAHLIRQHNNANVIVLPARFITNDQAVEFVEEFLATDFEGGRHQRRIEKIPVKACNRQ

SEQ ID NO: 1430 - protein, 148 aa, Candidatus Azobacteroides pseudotrichonymphae genomovar. CFP2
MEIPIIGLASDHAGYELKEFIQILLNDRDMSYINYGTYTTDSVDYPIYGHKLAKAFEKGEVSVGIGICGSGNGINMTLNKHQKVRSALCWNEEIARLAREHNNANVLVLPARFLSQEEAKKIIDIFLNTPFKRGNKRHQQRIEAIPLK

SEQ ID NO: 1431 - protein, 142 aa, unknown
  unidentified eubacterium SCB49
MKIAIGNDHAGPDYKFAIVKYLEDQGHEVVNFGTDTLDSVDYPDFANPVSKAVNDGEVPYGILICGSANGVAMTANKYPKVRAGICWTKEITSLTRQHNDANVICIPARYTSIPQAVGMVETFLNTAFEGGRHQNRVAKICM

SEQ ID NO: 1432 - protein, 157 aa, Blattabacterium sp. (Blattella germanica) str. Bge
MSFAKIIMLIAIGSDHTGVYYKSLINNFLTKIGCKIKDFGLFEYGEKVDYPDFIHPTAEFVEKGKADFGIIICGSGNGAAMTANKYEKIRAALVWNKEVAFLARKHNNANIISLPARFLDKNEILEIVDIFLKTNFEGGRHKIRIKKIPINSKYNPQ

SEQ ID NO: 1433 - protein, 145 aa, Blattabacterium sp. (Periplaneta americana) str. BPLAN
MKIAIGSDHTGIDCKHLIIKFLVKNGYHIRDFGFSSYGKKVDYPDFIHPTVESVDKGEMDFGIIICGSGNGAAMTANKYQKIRAALVWNKEVAFLARKHNNANVLSLPARFVKNEKEVLEIVEMFLKTDFEGGRHKRRIEKIPIK

SEQ ID NO: 1434 - protein, 143 aa, Capnocytophaga gingivalis
MKIVIGNDHAGTEYKNLILQYLLSKDYQVTNVGADTSQSVDYPDFAHPVGEMIDKGEADWGIVICGSGNGVAMTVNKHPKVRCALCWNKEIAALARAHNNANVLAIPARFTAAEQALEMVKTFLETPFEEGRHQRRVEKIQLC

SEQ ID NO: 1435 - protein, 140 aa, Capnocytophaga ochracea
MKIAIGNDHAGVDYKKAIVAFLESKGIEVLNCGTDTSESVDYPDFGHAVAKALEENKADLGIVICGSGNGIAMSANKHPHIRCAVCWTKELSALARAHNNANVLSIPARFTAIEQAVDIANTFLNTPFEGGRHERRVKKI

SEQ ID NO: 1436 - protein, 140 aa, Capnocytophaga sputigena
MTIAIGNDHAGVDYKNAITAFLKSKNIEVLNFGTDTPESVDYPDFGHAVAQALEEGKADLGIVICGSGNGIAMTANKHPHVRCAVCWTKEISALARAHNDANVLSIPARFTAIEQAVEIANTFLITPFEGGRHERRVNKI

SEQ ID NO: 1437 - protein, 144 aa, Chryseobacterium gleum
MKRKIAVAADHAGYEYKEIVKNYLSEHFEVQDFGTFSTNSVDYPDFVHPAATSVENGENELGILFCGSGNGVQITANKHQKIRCALCWMPEIATLARQHNDANMISIPARFISKELAIEIVDKFLSTDFEGGRHQNRVDKIAFC

SEQ ID NO: 1438 - protein, 143 aa, Croceibacter atlanticus HTCC2559
MKIAIGNDHAGTFYKNTIVEYLKSENIEVINYGTNSEDSVDYPDFVHPVAADVESNSVNLGIIICGSGNGASMTANKHQGVRSALCWTKEITKLAREHNDANILSIPARFTSVQQALEMVKVFLNTEFEGGRHQTRVDKIACS

SEQ ID NO: 1439 - protein, 143 aa, Dokdonia donghaensis MED134
MKISIGNDHAGPSYKNVIVKFLKEAGHTVSNYGTDTPDSVDYPDFGHPVATDVEEGKADFGIVICGSGNGIAMTVNKHQGVRAALCWIKEIAILAREHNNANVIAIPARYTSEMQALEMVKAFITTEFEGGRHQRRVDKIACN

SEQ ID NO: 1440 - protein, 143 aa, Flavobacterium johnsoniae
MKISIGNDHAGPEYKKSIVAMLEARGYEVTNYGTDTDASVDYPDFGHPVANDVSEGKADFGIVICGSGNGIAMTVNKHPKVRAGLCWTKEIAYLTRLHNDANIVSIPARFTSIHQAVEIVETFLDTAFEGGRHQNRVNKIACS

SEQ ID NO: 1441 - protein, 142 aa, Flavobacterium psychrophilum JIP02/86
MKISIGNDHAGPDYKKAIVQFLEQKGHIITNHGTDSFDSVDYPDFGHKVAIDVTNRKADFGIIICGSGNGIAMSANKHQGIRAALCWTKEIASLARQHNDANIISIPARYTSIQQAIEMVDTFLNTTFEGGRHATRVGKISC

SEQ ID NO: 1442 - protein, 146 aa, Gramella forsetii KT0803
MKISIGNDHAGTDYKQMIQEKLESMGHTVTNYGTNAEDSVDYPDFVHPVAQDVENKKADLGIIICGSGNGANMTANKHQGVRSALCWNTEIAKLSREHNDANILSIPARFVSKDLATQMMETFVNTEFEGGRHQRRVDKIPAKKAC

SEQ ID NO: 1443 - protein, 144 aa, Kordia algicida OT-1
MKNIAIGNDHAGTDYKNAITAHLEAKGYTIQNYGTNSDDSVDYPDFIHPVATDVESGKVPFGIIICGSGNGAAMTANKHQKVRAALCWTKEIVALARQHNDANILSIPARFTSLPQAIAMVDTFLETEFEGGRHQRRVAKIACS

SEQ ID NO: 1444 - protein, 145 aa, Polaribacter irgensii 23-P
MRIAIGNDHAGTIYKFEIIKHLESKGYEVLNFGTDTDASMDYPDAIHPTATAVENGTAAFGIILCGSGNGAQMTANKHQGIRAALCWNNELVALTRQHNNANILTIPARFVSLQQAIGFVDIFLTTDFEGGRHGDRVEKIACAGL

SEQ ID NO: 1445 - protein, 144 aa, Polaribacter sp. MED152
MTIAIGNDHAGTEYKFEIIKHLEEKGYTVLNFGTDTNNSMDYPDAIHPTADALESGKAELGIILCGSGNGAQMTANKHQGIRAALCWNNELVALTRQHNDANILTIPARFVSLQQALGFVDVFLNTEFEGGRHANRVNKISCAG

SEQ ID NO: 1446 - protein, 143 aa, Psychroflexus torquis ATCC 700755
MIISIGNDHAGTFYKNKIVDYLKSQNIEVHNHGTNSEDSVDYPDFVHPVAIDVEDGTSSLGIIICGSGNGANMTANKHQGIRSALCWTSELVALAKQHNNANVLSIPSRFVSLEEALDFVTVFLKTPFDGGRHHHRVDKIACH

SEQ ID NO: 1447 - protein, 139 aa, Psychroflexus torquis ATCC 700755
MQNKNIFIASDHAGFNLKTKLLKNFPKINDLGTKTDESVDYPDFAHKLTREVLKNKKNVGILICGTGVGMSIAANRKKGIRAGLANNSKIARLIRKHNDANVLVLPGRFINTSEAKKSVQAFLSTKFESGRHKRRIKKL

SEQ ID NO: 1448 - protein, 169 aa, Robiginitalea biformata HTCC2501
MKQTIDFFKRQMIYIASDHAGFELKNALCRHLAASGRDVEDLGPYAYDPEDDYPDFILPAAEAVAANPGSLGVVLGGSGQGEALAANKVEGVRAALYYGGPRDIVSLSRTHNQANILSLGARFLDEEEAIAVLELWLETPYGREERHVRRINKVRAYEQKRAGGPAENS

SEQ ID NO: 1449 - protein, 143 aa, Robiginitalea biformata HTCC2501
MKIAIGNDHAGTEYKLAIVGLLKSMDIEVINHGTDGTDGVDYADFIHPVATDVASGEADLGIVVCGSGNGACMTANKHQEIRAALCWNKEIVSLAREHNNANILGLPARFLAIPQALEMVRTFLDTPFEGGRHQRRIEKIPCY

SEQ ID NO: 1450 - protein, 142 aa, Flavobacteriaceae bacterium 3519-10
MKKISIASDHAGYAYKEAIKKHFAGQYQIEDFGTFSEDSVDYPDFVHPSAESVETGRNELGILICGSGNGVQMTANKHKAIRCALCWMPELAELARKHNNANMIALPARFIAVELAIDVVEKFLTTDFEAGRHQLRVDKIPC

SEQ ID NO: 1451 - protein, 143 aa, Flavobacteria bacterium BAL38
MKISIGNDHAGPDYKKAIVQFLEEKGHTIYNHGTDTFDSVDYPDFGHPVAYDVESKKADFGIVICGSGNGIAMTVNKHQDIRAALCWTKEIAALARQHNDANILSIPARYTSIQQAIEMVDTFLNTSFEGGRHANRVKKIACK

SEQ ID NO: 1452 - protein, 144 aa, Flavobacteriales bacterium ALC-1
MKISIGNDHAGPDYKQAVVKHLETKGYTITNYGTDTLDSVDYPDFVHPVAKDVNDGNADLGILICGSANGVAMTANKYQNVRAGVCWTSEITELTRLHNNANIICIPARFTSIPQAIKMVDTFLNTAFEGGRHQNRVDKIPLSC

SEQ ID NO: 1453 - protein, 136 aa, Flavobacteriales bacterium ALC-1
MKISIGNDHAGPDYKQAVVKHLETKGYTITNYGTDTLDSVDYPDFVHPVAKDVNDGNADLGILICGSANGVAMTANKYQNVRAGVCWTSEITELTRLHNNANIICIPARFTSIPQAIKMVDTFLNTAFEGGRHQTV

SEQ ID NO: 1454 - protein, 156 aa, Flavobacteriales bacterium HTCC2170
MYLYICGKLTLTKMKISIGNDHAGTEYKLAIIGLLKSMNIEVSNYGTDGTDSVDYPDFVHPVAKDVEEGKVNYGIIICGSGNGASMTANKHQKIRCALCWNKEIVQLAREHNDANILSLPARFLSLAQALEMVKVFLNTKFEGGRHERRIEKIACS

SEQ ID NO: 1455 - protein, 143 aa, Flavobacteria bacterium BBFL7
MNISIGNDHAGPDYKQAIVDMLKKRGHQVTNHGTDTLDSVDYPDFAHKVGQDVDSHTVDLGIVICGSAQGVSMTVNKYQNVRGAVCWSKEIAGLAREHNNANIICIPARFTSIPQAIAMVETFLDTEFAGGRHANRVNKIACS

SEQ ID NO: 1456 - protein, 143 aa, Flavobacteria bacterium MS024-2A
MQISIGNDHAGPEYKEKIIAFLKSENYETINYGTNTTDSVDYPDFIHPVAKDVSEGKSDFGIIICGSGNGANMTANKYQKIRSALCWNKEIVALAREHNDANILSLPARFISIPQAIEMVKVFISTKFEGGRHQKRIDKIPCK

SEQ ID NO: 1457 - protein, 143 aa, Flavobacteria bacterium MS024-3C
MTIAIGNDHAGTDYKFAIIAFLKALGHDVLNFGTDKSDSVDYPDHIHPVAEAVSSKKVALGIIICGSGNGAAMTANKHQDIRAALCWTKEIVLLAKQHNDANILSLPARYLSLPQALEMVEVYLDTPFEGGRHANRVAKIGCS

SEQ ID NO: 1458 - protein, 153 aa, Chitinophaga pinensis DSM 2588
MASQPLFNLTLPVAIGADHAGFEYKEEIISYLEGKGLKVKDAGAHSKDPADYPDFAHPVATLVEREQAAFGILVCGSGNGVAITANKHQGIRAAICWGEELSRLARSHNNANVLCIPARFVDDAVAKQIVDVFIDTPFEGGRHENRVRKIACL

SEQ ID NO: 1459 - protein, 145 aa, Algoriphagus sp. PR1
MAKKIAIGGDHAGFEYKAKMISKLESQGYEVKDFGPFSDASVDYPDYVHPLSTAIEAGEYELGIVICGSGNGVAITANKHQGIRAALCWNEDLAALSRQHNNANVLALPARFISYELAEKLAETFLTTDFEGGRHQNRVNKIACS

SEQ ID NO: 1460 - protein, 145 aa, Cytophaga hutchinsonii
MAYTIALGGDHAGYTYKKEIIAYLETQGHKTIDCGPFSEASVDYPDFSHPVAEAVETGKATFGILICGSGNGVCMTANKHQHIRAGLCWTPEIAMLTRQHNNANVLCLPARFIPIEEAIACVKMFVETAFEGGRHEGRVNKIACA

SEQ ID NO: 1461 - protein, 143 aa, Dyadobacter fermentans DSM 18053
MRKIAIGSDHAGFPYKQPVIDWLTTNGFEVKDFGTYSADSADYADFAHPVASGVESKEFEKGVLLCGSGQGVCITANKHQGVRAALVWDLPLAPLARQHNDANVICFPVRFIELETALASLEAFLSTEFEGGRHQTRVDKISC

SEQ ID NO: 1462 - protein, 142 aa, Microscilla marina
MKIAIGGDHAGFAYKEAVVALLKDKGVAVEDFGPFSEESVDYPDFVHPVAKKVDAKEADLGILICGSGNGVAMTANKYQSVRAALCWQTELAALARQHNNANVLCIPARFVDLALAKNMVETFLNESFEGGRHERRVNKISC

SEQ ID NO: 1463 - protein, 143 aa, Spirosoma linguale
MKIAIGSDHAGFRYKEAIRQYLTNLGHEVIDKGTYAETPSVDYPVYIRPVAEAVAAGDVDRGIVLGGSGNGEAIMANRIKGVRCGLCWNEESARLCRQHNDANVMSIGERMMSEETALNLVQIWLDTPFEGGRHLARIQQLDQ

SEQ ID NO: 1464 - protein, 149 aa, Pedobacter heparinus DSM 2366
MKIIIGSDHAGFTYKNILLTTLTAAGYEVLDLGTYTSAATDYPDHAAAVARAILEKKGERGILVCGSAVGVSIAANKFKGIRAGVCHDTYSAHQSVEHDDVNILCMGERVIGIELAKDISFAFLKASFTHEERHIKRLAKITAIENEEL

SEQ ID NO: 1465 - protein, 146 aa, Pedobacter heparinus DSM 2366
MSTDKKIKIAIGADHAGFEYKELLKSYLSDHEVKDFGTHSADSVDYPDFAHPVAEAVESEAYTFGVLVCGSANGVAITANKHQQIRAAICWQKEIAELARMHNNANIICIPARFVSEELAKEMVSTFLNTAFEGGRHAGRVNKMSC

SEQ ID NO: 1466 - protein, 179 aa, Pedobacter sp. BAL39
MFVFKLMLCPGIARILAKLGNNLSININKKLMKVILGSDHAGYRYKQMFSELLTTEGYEVLDLGAFNEEASDYPDHAEDVAVALQEGKGDRGILVCGSAVGVSIAANKFKGIRAGVCHDTYSAHQAVEHDDVNVLCLGERVVGPALAKEIVLSFLKASFTNETRHVKRLAKITAIEDQW

SEQ ID NO: 1467 - protein, 146 aa, Pedobacter sp. BAL39
MSTETKVKIAIGADHAGFEYKELIKEWFAEHEIKDFGTFSADSVDYPDFAHPVAEAVESKAFTFGILVCGSANGVAITANKHQHIRAAICWLKEIAELARLHNDANIICIPARFVSPELAKEMINTFLTTAFEGGRHAGRVGKISC

SEQ ID NO: 1468 - protein, 146 aa, Sphingobacterium spiritivorum
MSSVKTIAIGGDHAGFDYKKELIPFLQELGYEVKDFGTYSTDSVDYPDFAHPVASAVESKEFDKGILICGSANGVAITANKHQDIRAAICWLEEIAALARQHNDANIVCIPARFISPDLAKAIVKTFMTTDFEGGRHANRVNKISC

SEQ ID NO: 1469 - protein, 146 aa, Sphingobacterium spiritivorum
MSSVKTIAIGGDHAGFDYKKELIPFLQELGYEVKDFGAHSTDSVDYPDFAHPVASAVESKEFDKGILICGSANGVAITANKHQDIRAAICWLEEIAALARQHNDANIVCIPARFISLDLAKAIVKTFMSTDFEGGRHANRVNKISC

SEQ ID NO: 1470 - protein, 144 aa, Chlorobaculum parvum NCIB 8327
MNIAVGSDHAGVEMKKSVIAWLEKNGHTAEDMGPYTEESVDYPDFAHKVCSAVLEGKADQGILMCGTGIGMSIAANKVKGIRAGLACGPEFAALARQHNNANVLCFAARFNDVPTAEKILESWFASEFEGGRHQRRVDKLEAGS

SEQ ID NO: 1471 - protein, 144 aa, Chlorobium tepidum
MKIAVGSDHAGVELKKFVLSWLEKHCYDFEDMGPYSAESVDYPDYGHKVAEAVARGDFDQGILMCGTGIGISIAANKVKGVRAANVCNPEYAALARQHNDANVLAFGARFNDDSSAAKILESWFASEFEGGRHQRRVDKIEFCC

SEQ ID NO: 1472 - protein, 150 aa, Chlorobium chlorochromatii CaD3
MTMKIAVGSDHAGFEFKKTVVAWLEAHGYEVEDMGPHNEESVDYPDYAHHVGRAVAGGHCDSGVLLCGTGIGVSVAANKIKGVRAALACNPEFATLARQHNNANILCMPARFTNRETIEQCLHNWFEASFEGGRHERRVNKIEPCCKVNS

SEQ ID NO: 1473 - protein, 144 aa, Chlorobium ferrooxidans DSM 13031
MKIAVASDHAGFESKKTVVAWLEKHGYACSDMGPYNEESVDYPDFARKVAQGVAAGEFDQGVLLCGTGIGVSIAANKVKGIRAALACNPEFATLARQHNNANIICFSARFSDKATIEQSLQNWFSAEFEGGRHERRVEKIEPCC

SEQ ID NO: 1474 - protein, 144 aa, Chlorobium limicola
MKIAVGSDHAGFELKNYVVQWLQENGHEPVDMGPFNEESVDYPDYARKVGESIVDGTCQEGVLLCGTGIGVSISANKVKGIRAALACRPEFATLARQHNNANIICFSARFTDRETIAKSLENWFAADFEGGRHERRVNKIEPCC

SEQ ID NO: 1475 - protein, 142 aa, Chlorobium phaeobacteroides
MKIAIGSDHAGYALKKIVYSWLDKHGYEVDDMGPWSEESVDYPDFARKVAEAVSRGDADQGVLLCGSGIGVSIVANKVKGIRAALAFNPEIASLARQHNNANVLCFPARYSDSGTIEQSLENWFNAEFEGGRHERRVLKIEP

SEQ ID NO: 1476 - protein, 148 aa, Chlorobium phaeobacteroides
MKIAVGSDHAGYEMKNHVIQWLQENRYEVVDMGPFNEESVDYPDFARKVGESVAEGSCQQGVLLCGTGIGVSISANKVKGIRAALACNPEFATLARQHNNANIICFSARFTDRETIAKSLQNWFAAEFEGGRHERRVNKIEPCCSKSV

SEQ ID NO: 1477 - protein, 144 aa, Prosthecochloris vibrioformis DSM 265
MKIAIGSDHAGVEFKKEIAAWLAAHGHECTDMGPYTEESVDYPDYAHKVARAVAAGEYEQGILLCGTGLGVSISANKVPGIRAALACRPEFATLARQHNNANVLCMSARFTDSAAIVTTLEHWFAAEFEGGRHQRRVEKIEQWS

SEQ ID NO: 1478 - protein, 144 aa, Chlorobium luteolum DSM 273
MNIAVASDHAGVEFKKDIVAWLESHGHACTDMGPYTEDSVDYPDYAHKVGHSVASGESDQGILLCGTGIGVSISANKIPGIRAALCCRPEFATLARQHNDANILCFSARFTDLASIHESLDNWFSADFEGGRHQRRVDKIDPCS

SEQ ID NO: 1479 - protein, 144 aa, Pelodictyon phaeoclathratiforme
MKIAVGSDHAGFTFKKTVTDWLERHDYEFDDMGPYNEESVDYPDYARKVAEAVAAQQCDSGILLCGTGIGVSISANKIKGIRAALACNPEFATLARQHNNANIICFSARFTDKATIEQSLHNWFTTDFEGGRHQRRVNKIEPCC

SEQ ID NO: 1480 - protein, 142 aa, Chloroherpeton thalassium ATCC 35110
MKLALGSDHAGVQKKAFVKDWLIRNGHEAVDLGPYSEESCDYPDYARKVAQAVASGEVAQGVLLCGSGVGVSIVANKTKGVRAALAYQPEIASLARQHNNANVICFPARYMNESEIEQCLKNWFEADFEGGRHERRVSKIED

SEQ ID NO: 1481 - protein, 142 aa, Prosthecochloris aestuarii
MRIAIGSDHAGYELKKTVKSWLEDHGHEVNDMGPYSDESVDYPDYARKVAQAVADGEYQQGVLLCGSGIGVSVSANKIRGIRAALAFNPEIASLARQHNNANIICFPARFTDADTIKTSLGNWFSAEFEGGRHERRVQKIEP

SEQ ID NO: 1482 - protein, 145 aa, Opitutus terrae PB90-1
MKTFTIAIGSDHAGFAYKEALRAALTADGHKVRDFGTYSDAACDYPDFIRPVAEAVARGEFERGIVLGGSGNGEAIVANRVRGVRCGLCWNEQVAKWNRSHNDGNVLSIGQRTISEAEAIQIARVWLATEFEGGRHAARIAKIDR

SEQ ID NO: 1483 - protein, 146 aa, Opitutaceae bacterium TAV2
MKTFSIAIGSDHAGFAYKEKIKEALLSEGHTVRDFGTYSPASCDYPDFIRPTAEAVARGEFERGIVLGGSGNGEAIVANRIKGIRCGLCWNEQVAVWNRSHNDGNVLSLGERTVTLEEALKIVRVWLATEFEGGRHLPRIQKIDAA

SEQ ID NO: 1484 - protein, 148 aa, Methylacidiphilum infernorum V4
MKIALGSDHAGFNYKEKVKNFLKESCLEVIDCGTFAPDPPVDYPDYVRPAALLVAQGQADRAIVFGGSGNGEAMVANKVKGIRCAYCFNEESARLGRLHNDANAISIGQRLIPEEMALKIVKIFLETPFEGGRHIPRIKKMMEYENAP

SEQ ID NO: 1485 - protein, 148 aa, Verrucomicrobiae bacterium DG1235
MSKLTVAIGSDHAGYVYKQAIIAHLQGQGYTVKDYGTDSAESCDYPDFIRPVAQAVAAGEFDRGIVLGGSGNGEAIVANRIPGIRCGLCWNEQIAVWNRSHNDGNVLSIGERTVTQEDALQIVDTWLNTEFEGGRHQPRIDKIDNPSL

SEQ ID NO: 1486 - protein, 151 aa, unknown
  bacterium Ellin514
MKIAIGSDHAGFQYKEQIKDFLKQLGHEVRDFGTNSDASVDYPLFIRPTALAVADGECERGIVLGGSGNGEAIVANRVKGVRCALCWNVESARLGRQHNNANMISIGQRMMTIETAFQIVQTWLDTPFEGGRHQRRIEEIDQATPEGCARS

SEQ ID NO: 1487 - protein, 144 aa, Verrucomicrobium spinosum
MKISIGSDHAGFAYKEKIKAFLQSLGHEVQDFGTYSADPVDYPTYVRPAAEAVAKGEADRGIVLGGSGNGEAIVANKVRGVRCSLCWSHDTARWAREHNDANVLAIGERTISPELALEIVKIWLETEFTAGRHLARVQAIEGKG

SEQ ID NO: 1488 - protein, 147 aa, Chloroflexus aggregans DSM 9485
MRIAVGSDEKNYLTDALIADLERRGHELILFGPLTGTNDPWPDVGRAVGEAVASGQADQGIVCCYTGTGVSIAANKVPGIRAALCHDSQTAAGARKWNDANVLALSLRLTTPELAREILDAWFATECPPEEQATIDRLRAFDRVVGA

SEQ ID NO: 1489 - protein, 144 aa, Chloroflexus aurantiacus
MRIAVGSDERTYMTDALITELKQRGHDVILFGPLAGTSDPWPDVGRAVGEAVATGQADQGIVCCYTGTGVSIAANKVPGIRAALCHDAQTAAGARKWNDANVLALSLRTTTPELVREILDAWFATECPPEEQVTIDRLRAFDKL

SEQ ID NO: 1490 - protein, 149 aa, Herpetosiphon aurantiacus
MIMKIAVGTDHGGLILKQAVIEEVQRLGHEVLDFGTDSPASVDYPDFAAAVGNAVVSGQAERGIAICGSGVGVTVAANKIKGVRACLCHDTYSAHQGVEHDDLNVLCLGGRVIGPALAGEIVQAFLSATFHNEARFTRRLDKVIALENQ

SEQ ID NO: 1491 - protein, 152 aa, Dehalococcoides ethenogenes 195
MSNISVAIGADHGGYGLKTDLLPFLNQLGIKVLDLGACTYDSADDYPDFALAVARKVACGQTDRGIIICGSGVGACITANKIKGVRAGLCHDVYSAHQGVEHDDMNVLCLGARVIGIEVAKEIITAFLNARFTGEERHKRRLEKLLQAEKEG

SEQ ID NO: 1492 - protein, 152 aa, Dehalococcoides sp. BAV1
MSNISIAIGADHGGYDLKTDILPFLNHLGLKVLDLGACTYNSSDDYPDFAQTVARNVACGKTDRGIIICGSGVGACITANKIKGIRAGLCHDVYSAHQGVEHDDMNVLCLGARVIGIEVAKEIISAFLNARFTGEERHKRRLEKLLKVEKEG

SEQ ID NO: 1493 - protein, 152 aa, Dehalococcoides sp. CBDB1
MSNISIAIGADHGGYDLKTGILPFLNHLGLKVLDLGACTYNSADDYPDFAQTVARNVACGKTDRGIIICGSGVGACITANKIKGIRAGLCHDVYSAHQGVEHDDMNVLCLGARVIGIEVAKEIISAFLNARFTGEERHKRRLEKLLKVEKEG

SEQ ID NO: 1494 - protein, 154 aa, Dehalococcoides sp. VS
MKMSNISVAIGADHGGYGLKIDLLPFLNQLGADVLDLGACAYNSTDDYPDFALAVARKVACGQTDRGIIICGSGVGACITANKIKGVRAGLCHDVYSAHQGVEHDDMNVLCLGARVIGIEVAKEIITAFLNARFTGEERHKRRMEKLLQAEKES

SEQ ID NO: 1495 - protein, 154 aa, Gloeobacter violaceus
MKLVIGSDHGAYELKEELKTWLGEHEYAFEDVGTYNGERCDYPLVAQSVAEKIQRGEADRGILLCGTGIGISIAANKFDGIRAALAHDHYTARMSREHNDANVLAMGGRVLGPEVAKDVLETWLSTEFGGERHQRRLDQIQSFEAPKTPQTVGS

SEQ ID NO: 1496 - protein, 154 aa, Nostoc punctiforme PCC 73102
MKIAIGSDERTNLTDRILEELKQRGHEVIVFGSLAENDLEVDWPLSCSKVALAVATQKADEGIVFCWTGTGASIAANKVLGIRAALCHDAETARGARIWNHANVLVLSLRATTEAIAKEILDAWFSTPFSEDEWNILQMERIRQLEKSALFQQS

SEQ ID NO: 1497 - protein, 161 aa, Acaryochloris marina MBIC11017
MNIAIGADCYGFDLKEAIKVYLLSQKHELQDVGISAGDSKTPYYETASLVANLVGTQQVERGVLICGTGMGMAIVANKFPGVYAAVCENTHAAKKSRSINNSNVLTLGGMFTTPILAQDILETWLMTGFTQDWEPDIQTWLEHSMKDIAELEIAQFKAQLK

SEQ ID NO: 1498 - protein, 150 aa, Denitrovibrio acetiphilus DSM 12809
MKKVALAADHGGVQLKDEIIEYLKSKQFDILDLGTNSGESVDYPEYGAKAAVAVTNGEADCAIIMCGSGIGISIAANKFKGVRCALCFDAYTAKMCRQHNDANIMALGGRITTIDRAKDMVDLFLETEFEGGRHQRRIDKLDALAAESWK

SEQ ID NO: 1499 - protein, 148 aa, Dictyoglomus thermophilum
MKIAIGADHAGYMLKEELKHWLDEWNIPYHDFGTYSPERVDYPDYGILVARAVAKGGFEKGILICGTGIGMSIVANKVKGIRAALCRDPYEAKLSREHNDANILALGGRILGFDLAKEIVRVWLNTEFSGGRHKVRIDKISRIEEDEL

SEQ ID NO: 1500 - protein, 148 aa, Dictyoglomus turgidum DSM 6724
MKIAIGADHAGYMLKEELKRWLEEWNISYHDFGTYSPERVDYPDYGIIVARAVAKGGFEKGILICGTGIGMSIVANKVKGIRAALCRDPYEAKLSREHNDANILTLGGRILGFDLAKEIVRVWLNTEFTGGRHKVRIDKISMIEEDEL

SEQ ID NO: 1501 - protein, 150 aa, Elusimicrobium minutum Pei191
MKIALASDHAGFSLRETVINKIKDLGHEVIDFGTFECSSVDFSDFAVKGAQAVVSKQAEKGVFICGSGVGMCISANKVKGTRASVAHDTYSAAQGVEHEDMNILCLGARVIGPSIAEEIVEKFLNAKFQGLERQVRRLNKIIDIENNNFK

SEQ ID NO: 1502 - protein, 149 aa, unknown
  uncultured termite group 1 bacterium phylotype Rs-D17
MKLAFGTDHAAAEVRNKVKEYFQSAGYEIEDFGFCGDGSCDYPDYAVKVAEAVISKKADRGILICGTGIGMSIAANKMKGIIAAVCWNEDTAKLAVRHNGANVLCLGSRTATLSELCQRIKIFLGTPFEERHLQRIRKIEEIEKQQCQK

SEQ ID NO: 1503 - protein, 181 aa, unknown
  uncultured bacterium CBNPD1 BAC clone 2089
MCGGRVSCPKVMRCDGPGSYARGVSAASPRRSFRIAIGADHAGFELKQHLVAFLGAAGHKVDDFGTHSTESVDYPPICAAVGRAVRDGKADLGIVLGGSGQGEQLAANKVRGVRAALCNCLYTAKMARSHNNANVLSMGARVVGVGLAEEIVTTFLATEFEGGRHERRVTQLAEIEEEESK

SEQ ID NO: 1504 - protein, 156 aa, Acidobacterium capsulatum
MKLAIGADHAGFPLKEEVREFVKRLGHEVDDLGAYSAEPSDYPDFAEKVGLALIEGRAERGILICGSGVGVNVAANKLPGVRACMCHDTYSAHQGVEHDNMNVLVLGARIIGPALAFDLVTSFLNAAFQSQVERYTRRLNKVYAIEARYMPGSKKA

SEQ ID NO: 1505 - protein, 150 aa, Solibacter usitatus Ellin6076
MKLALASDHAGVALKARVIEELRKDGHETADLGTCTTDPVDYPDYAMAVGLAVLTGQAERAILICGSGAGACVAANKLKGIRAATCHDSFSARQCVEDDNVNVFCLGARVIGTELAVELVRIYLKAQFSGLERHKRRLAKIAALEAEFGK

SEQ ID NO: 1506 - protein, 145 aa, Solibacter usitatus Ellin6076
MKIAIGADHAGFSLKEKLRQKLAQDGHEVVDFGTASDASCDYPDFAQPVARDVAQGRSDRGILVCSTGIGMAMAANKIDGVRAAPAQSDDEVKFTREHNDANVLTLGAKYLDEDRAIELIHIFLNTEFAGGRHARRVAKIAQLEK

SEQ ID NO: 1507 - protein, 149 aa, Candidatus Koribacter versatilis Ellin345
MKVAVSADHAGVPMNEVVIAELRKLGHEVLDLGTHDPNSGDDYPDRAADITAAVLNQGCERGILICGSGVGASVAANKIKGIRAGLCHDHYSAHQGVEHDNMNVLCLGGRVIGTETALDLVRAFVSAKFTNEERHLRRLHKIAVMEGSR

SEQ ID NO: 1508 - protein, 152 aa, Candidatus Koribacter versatilis Ellin345
MKIALGADHAGFELKNQVKQHLTQQGIDVQDFGTNTPDSVDYPDFAQRVADTVAVGGVERGVLVCGTGIGMAMSANKVPGIRAANCHTILEAELSRQHNDANILTLGARVLEPEAAFAIVDAWMKAQFEGGRHQRRVDKIHQIEQQEVKRST

SEQ ID NO: 1509 - protein, 173 aa, Anoxybacillus flavithermus WK1
MMKRPSRPVKMKRDGFFFIMIRRGSNVKVAIASDHGGIRIREEIKKLMDEMGIEYTDFGCECETSVDYPDYALPVAQKVANGEFDRGILICGTGIGMSIAANKVKGIRCALVHDVFSAKATREHNDSNILAMGERVIGPGLAREIAKVWLTTPFEGGRHEKRIQKISAYENEQ

SEQ ID NO: 1510 - protein, 147 aa, Bacillus anthracis
MKVVIASDHGGMNIRKELVSLLEELNIEYIDLGCECEAGSVDYPDFAFPAAEMVANGEVDRGILVCGTGIGMSIAANKVNGIRCALVHDTFSARATREHNDTNMLAMGERVIGAGLARDIAKIWLTTEFEGGRHENRVGKIKTYEAK

SEQ ID NO: 1511 - protein, 147 aa, Bacillus cereus
MKVVIASDHGGMNIRKELVSLLEELNIEYIDLGCECEAGSVDYPDFAFPAAEMVANGEVDRGILVCGTGIGMSIAANKVNGIRCALVHDTFSAKATREHNDTNMLAMGERVIGAGLARDIAKIWLTTDYEGGRHENRVGKIKTYETK

SEQ ID NO: 1512 - protein, 147 aa, Bacillus cereus
MKVVIASDHGGMNIRKELVSLLEELNIEYIDLGCECEAGSADYPDFAFPAAEMVANGEVDRGILVCGTGIGMSIAANKVNGIRCALVHDTFSAKATREHNDTNMLAMGERVIGAGLARDIAKIWLTTDYEGGRHENRVGKIKTYETK

SEQ ID NO: 1513 - protein, 147 aa, Bacillus cereus
MKVVVASDHGGMNIRKELVSLLEELNIEYIDLGCECEAGSVDYPDFAFPAAEMVANGEVDRGILVCGTGIGMSIAANKVNGIRCALVHDTFSARATREHNDTNMLAMGERVIGAGLARDIAKIWLTTEFEGGRHENRVGKIKTYEAK

SEQ ID NO: 1514 - protein, 147 aa, Bacillus cereus
MKVVIASDHGGMNIRKELVNLLEELNIEYIDLGCECEAGSVDYPDFAFPAAEMVANGEVDRGILVCGTGIGMSIAANKVNGIRCALVHDTFSAKATREHNDTNMLAMGERVIGAGLARDIAKIWLTTDYEGGRHENRVGKIKTYETK

SEQ ID NO: 1515 - protein, 147 aa, Bacillus cereus
MKVVIASDHGGMNIRKELVSLLEELNIQYIDLGCECEAGSVDYPDFAFPAAEMVANGEVDRGILVCGTGIGMSIAANKVNGIRCALVHDTFSAKATREHNDTNMLAMGERVIGAGLARDIAKIWLTTDYEGGRHENRVGKIKTYETK

SEQ ID NO: 1516 - protein, 147 aa, Bacillus cereus
MKVVVASDHGGMNIRKELVSLLEELNIEYIDLGCECKAGSVDYPDFAFPAAEMVANGEVDRGILVCGTGIGMSIAANKVNGIRCALVHDTFSAKATREHNDTNMLAMGERVIGAGLARDIAKIWLTTDYEGGRHENRVGKIKTYETK

SEQ ID NO: 1517 - protein, 147 aa, Bacillus cereus
MKVVVASDHGGMNIRKELVSLLEELNIEYIDLGCECEAGSVDYPDFAFPAAEMVANGEVDRGILVCGTGIGMSIAANKVNGIRCALVHDTFSAKATREHNDTNMLAMGERVIGAGLARDIAKIWLTTEFEGGRHENRVGKIKTYETK

SEQ ID NO: 1518 - protein, 147 aa, Bacillus cereus
MKVVVASDHGGMNIRKEIVSLLEELNIEYIDLGCECEAGSVDYPDFAFPAAEMVANGEVDRGILICGTGIGMSIAANKVHGIRCALVHDTFSAKATREHNDTNMLAMGERVIGAGLARDIAKIWLTTDYEGGRHENRVGKIKTYEAK

SEQ ID NO: 1519 - protein, 147 aa, Bacillus cereus
MKVVIASDHGGMNIRKELVSLLEELNIEYIDLGCECEAGSVDYPDFAFPAAEMVANGEVDRGILVCGTGIGMSIAANKVNGIRCALVHDTFSAKATREHNDTNMLAMGERVIGAGLARDIAKIWLKTDYEGGRHENRVGKIKTYETK

SEQ ID NO: 1520 - protein, 147 aa, Bacillus cereus
MKVVVASDHGGINIRKEIVNLLEELNIEYIDLGCECEAGSVDYPDFAFPAAEMVAKGEVDRGILICGTGIGMSIAANKVHGIRCALVHDTFSARATREHNDSNMLAMGERVIGAGLARDIAKIWLTTDYEGGRHENRVGKIKTYEEK

SEQ ID NO: 1521 - protein, 147 aa, Bacillus mycoides
MKVVVASDHGGMNIRKELVSLLEELNIEYIDLGCECEAGSVDYPDFAFPAAEMVANGEVDRGILVCGTGIGMSIAANKVNGIRCALVHDTFSAKATREHNDTNMLAMGERVIGAGLARDIAKIWLTTDYEGGRHENRVGKIKTYETK

SEQ ID NO: 1522 - protein, 147 aa, Bacillus thuringiensis
MKVVIASDHGGMNIRKELVSLLEELNIEYIDLGCECEAGSVDYPDFAFPAAEMVANGQVDRGILVCGTGIGMSIAANKVNGIRCALVHDTFSAKATREHNDTNMLAMGERVIGAGLARDIAKIWLTTDYEGGRHENRVGKIKTYETK

SEQ ID NO: 1523 - protein, 147 aa, Bacillus thuringiensis
MKVVIASDHGGMNIRKELVSLLEELNVEYIDLGCECEAGSVDYPDFAFPAAEMVANGEVDRGILVCGTGIGMSIAANKVNGIRCALVHDTFSARATREHNDTNMLAMGERVIGAGLARDIAKIWLTTEFEGGRHENRVGKIKTYEAK

SEQ ID NO: 1524 - protein, 147 aa, Bacillus thuringiensis
MKVVIASDHGGMNIRKELVSLLEELNIEYVDLGCECEAGSVDYPDFAFPAAEMVANGEVDRGILVCGTGIGMSIAANKVNGIRCALVHDTFSAKATREHNDTNMLAMGERVIGAGLARDIAKIWLTTDYEGGRHENRVGKIKTYETK

SEQ ID NO: 1525 - protein, 147 aa, Bacillus weihenstephanensis KBAB4
MKVVVASDHGGMNIRKELVSLLEELNIEYIDLGCECEAGSVDYPDFAFPAAEMVANGEVDRGILVCGTGIGMSIAANKVNGIRCALVHDTFSAKATREHNDTNMLAMGERVIGAGLARDIAKIWLITDYEGGRHENRVGKIKTYETK

SEQ ID NO: 1526 - protein, 153 aa, Bacillus clausii KSM-K16
MKIAIGSDHNAFELKEELKTYMIDEGYDVVDYGCHSCEAVDYPDVSFRVGNDIMKGEIDRGILICGTGIGVAIAAGKVPGIRAALCHDTYSAERAQLSNNAQILTMGAKVIGPEAAKKVLNAYLGASFAGGPSARKIQQIAEQEQAYLEQESR

SEQ ID NO: 1527 - protein, 149 aa, Bacillus clausii KSM-K16
MKIAIASDHGGTRLRAEITAMLEEMGLSYKDFGCDCEGSVDYPDYALPVAEKVAQGEFDRGILICGTGIGMSIAANKVKGIRCALVHDTFSAKATRQHNDTNMIALGERVIGPGLAVEIVQTWLGEAFEGGRHQTRIGKIAAYEEKAGL

SEQ ID NO: 1528 - protein, 146 aa, Bacillus coagulans
MKVALASDHGGKHLKQEIAGLLQDLGVAYEDFGCDCEGSVDYPDYALPVAEKVAKGEFDRAILICGTGIGMCISANKVKGIRCALVHDVFSAKATRAHNDSNVLAMGERVIGPGLACEIVKEWLGTPFEGGRHARRIEKIAQYEQK

SEQ ID NO: 1529 - protein, 146 aa, Bacillus coahuilensis m4-4
MKVALASDHGGVNLLKEMKNLLEELNIEYEDFGCNCEGSVDYPDYAVPVAEKVANGEFDKGILICGTGIGMSIAANKVKGIRCALVHDVFTAKVTRQHNDTNVLAMGERVIGPGLAREIAMAWLQGEFEGGRHARRVEKISEYENK

SEQ ID NO: 1530 - protein, 145 aa, Bacillus halodurans C-125
MKVAIGSDHGGVNIKNEIIQLMEELGMQYEDFGCDCTTSVDYSDYAIPVAEKVAAGEFDRGILICGTGIGMSIAANKVKGIRCALCHDVFSAKATREHNDSNVLAMGERVIGPGLAREIAQTWLTTEFEGGRHARRIGKIAEYEG

SEQ ID NO: 1531 - protein, 147 aa, Bacillus pseudomycoides DSM 12442
MKVVVASDHGGMNIRKEIVSLLEELNIEYVDLGCECEAGSVDYPDFAFPAAEMVANGEVDRGILICGTGIGMSIAANKVHGIRCALVHDTFSARATREHNDTNMLAMGERVIGAGLARDIAKIWLTTDYEGGRHENRVGKIKTYEAK

SEQ ID NO: 1532 - protein, 149 aa, Bacillus pumilus
MKVAIASDHGGTNIREEIKQLMDELKIEYIDMGCECGSGSVDYPDYAFPVANMVANGEVDRGILICGTGIGMSISANKVKGIRCALAHDTFSAKATREHNDTNVLAMGERVIGPGLAREIAHIWLTTEFTAGRHAVRIGKIADYEEKHL

SEQ ID NO: 1533 - protein, 149 aa, Bacillus pumilus
MKVAIASDHGGTNIREEIKQLMDELKIEYIDMGCECGSGSVDYPDYAFPVANMVVNGEVDRGILICGTGIGMSISANKVKGIRCALAHDTFSAKATREHNDTNVLAMGERVIGPGLAREIAHIWLTTEFTAGRHAVRIGKIAEYEEKHL

SEQ ID NO: 1534 - protein, 150 aa, Bacillus selenitireducens MLS10
MKIVIGSDHAGYHLKGAIIDVVKELGHEIVDVGTDSPDSVDYADFGLQAAEMVANKEADRGIVICGTGIGMSISANKVKGIRCALVHDLFTAKATREHNDTNVLAMGERVIGPGLAQEIAKTWLTTEFEGGRHERRIMKVMNYEDGTYHV

SEQ ID NO: 1535 - protein, 145 aa, Bacillus sp. B14905
MRIAISSDHGGNNLRREIMQLLDELHISYEDFGPQSADSVDYPDYAKPVSDGVANGKFDKGILICGTGIGMSIAANKVNGIRCALVHDVFSAKATRCHNDSNVLAMGERVIGPGLAREIVQTWLETEFEGGRHTRRIEKITELEQ

SEQ ID NO: 1536 - protein, 155 aa, Bacillus sp. NRRL B-14911
MHIAIGSDHCGFEMKNALLPFFKTIGCDVVDYGCYSGETVDFPDISREVCDAVRSGKSERGILFCGTGVGAAIASNKINGIRAAVCHDIHSAHQSVEHDNVNVMCIGAQIIGPWLAEDLIKSFVNAIFSPEEHLLRRVEKLEQLELRSSREFNAD

SEQ ID NO: 1537 - protein, 146 aa, Bacillus sp. NRRL B-14911
MKVAIASDHGGVNIREEMKHLMEEMGIEYEDFGCECGVSFDYPDYALPVAEKVASGEFDKGILICGTGIGMSISANKVKGIRCALVHDVFSAKATRQHNDSNILAMGERVIGPGLAREIAKTWLETEFEGGRHANRIGKIKTYEDL

SEQ ID NO: 1538 - protein, 149 aa, Bacillus amyloliquefaciens
MKVAIASDHGGVHIREEIKSLLDELQIEYIDMGCECGAGSVDYSDYAFPVAEKVVNGEADRGILICGTGIGMSISANKVKGIRCALAHDTFSAKATREHNDTNVLAMGERVIGPGLAREIAKVWLTTEFTGGRHERRIGKIADYEEKNL

SEQ ID NO: 1539 - protein, 149 aa, Bacillus licheniformis
MKVIIASDHGGINIRKEIMALMDELNIEYEDYGCECGSGSVDYPDYAFPVAQKVANGEADRGILICGTGIGMSISANKVKGIRCALVHDVFSAKMTREHNDTNVLAMGERVIGPGLAREIAKVWLTTEFSAGRHAVRIGKIADYEDKHE

SEQ ID NO: 1540 - protein, 149 aa, Bacillus subtilis
MKVAIASDHGGVHIRNEIKELMDELQIEYIDMGCDCGSGSVDYPDYAFPVAEKVVSGEVDRGILICGTGIGMSISANKVKGIRCALAHDTFSAKATREHNDTNILAMGERVIGPGLAREIAKIWLTTEFTGGRHQTRIGKISDYEEKNL

SEQ ID NO: 1541 - protein, 148 aa, Geobacillus kaustophilus HTA426
MKVAIASDHGGIRIREEIKALLDEMGIEYTDFGCDCETSVDYPDYALPVAEKVARGEFDRGILICGTGIGMTIAANKVKGVRCALCHDVYSAKLTRMHNDSNILAMGERVIGPGLAREIAKAWLETEFEGGRHARRIGKIAEYENKHL

SEQ ID NO: 1542 - protein, 148 aa, Geobacillus sp. G11MC16
MKVAIASDHGGIRIREEIKALLDEMGIEYTDFGCDCETSVDYPDYALPVAEKVARGEFDRGILICGTGIGMTIAANKVKGVRCALCHDVYSAKLTRMHNDSNILAMGERVIGPGLAREIAKAWLETEFEGGRHARRIGKIADYENEHL

SEQ ID NO: 1543 - protein, 148 aa, Geobacillus sp. WCH70
MKVAIASDHGGIHIREEIKKLMDEMGIEYIDLGCECETSVDYPDYAIPVAEKVANGEVDRGILICGTGIGMTIAANKVKGIRCALCHDVYSAKLTRQHNDSNILAMGERVIGPGLAREIAKVWLTTEFEGGRHARRVEKITQYENKHL

SEQ ID NO: 1544 - protein, 158 aa, Geobacillus sp. Y4.1MC1
MAIKVALGCDHNAFNMKEIIKEFLKERGYDVVDYGCYSCEAVDYPDVAFQVAKDIAANKMDRGILICGTGIGVAIAAGKVPGIRAALCHDTYSAERARKSNNAQILTMGAQIIGPELAKKIVEVWMNSEFDGGNSARKVQKIIDQEKELLKSWGNTIM

SEQ ID NO: 1545 - protein, 147 aa, Geobacillus sp. Y4.1MC1
MKVAIASDHAGIHIREEIKKLMDELGIEYIDLGCDCETSVDYPDYAIPVAEKVANGEVDRGILICGTGIGMAIAANKVKGVRCALCHDVYSARLTRQHNDSNVLAMGERVIGPGLAREIAEVWLTTAFEGGRHAKRVEKITQYETEH

SEQ ID NO: 1546 - protein, 154 aa, Geobacillus sp. Y412MC10
MKIALGTDHAGIRLKEEIVEVIRGLGHEVEDLGCGCSDSVDYPDYALPVCEKVVSGEADRGILICGTGIGMSIAANKVPGIRCALTHDVFSAKATREHNDSNVIALGERVVGPGLAAEIVSAWLTTDFSQGERHVGRVNKIKAIEERYLKSESR

SEQ ID NO: 1547 - protein, 149 aa, Geobacillus sp. Y412MC52
MMKVAIASDHGGIRIREEIKALLDEMGIEYTDFGCDCETSVDYPDYALPVAEKVARGEFDRGILICGTGIGMTIAANKVKGVRCALCHDVYSAKLTRMHNDSNILAMGERVIGPGLAREIAKAWLETEFEGGRHARRIGKIADYENKHL

SEQ ID NO: 1548 - protein, 146 aa, Exiguobacterium sibiricum 255-15
MKVAIGADHGGFKLKAELNELLQELGIDYTDFGTYSSESIDYPDVAIPVAEAVANGEFDRGILICGTGIGIGIAANKVKGIRAALVHDTFSAKATRQHNNSNILTMGERVIGPGLARDIAKIWLETEFEGGRHENRVCKISDYEVK

SEQ ID NO: 1549 - protein, 146 aa, Exiguobacterium sp. AT1b
MKIAIGADHGGFNLKKEIVALLEELGHEYKDFGTHSADSIDYPDVAIPVAEAVAAGEFDRGILICGTGIGIGIAANKVKGIRAALVHDSFSAKATRQHNDSNIMTMGERVIGPGLALDLVTTWLDTDFEGGRHSNRVDKMSAYESK

SEQ ID NO: 1550 - protein, 148 aa, Listeria innocua
MKIAIGCDEMGYELKQTLITRLKEKNIEFTDFGSFENEKVLYPSIAEKVALEVKNNDYDRGILICGTGIGMAITANKIHGIRAAQIHDSYSAERARKSNDAHIMTMGALVIGPSLAVSLLDTWLDSDFSGGRSQAKVDLMEEIDQKNR

SEQ ID NO: 1551 - protein, 146 aa, Listeria innocua
MKLTIGCDHGGRRLKDAIVKHLREKDIEVVDIGTYTDESVDFPSYAEEVANQVVSGQADLGILCCGTGIGMSIAANKVDGIRAAVVSDTFSARATREHNNSNVLCLGERVIGEGLALLLVDTWLEGSFAGDRHKRRLDKITELERK

SEQ ID NO: 1552 - protein, 149 aa, Listeria innocua
MEIAIAADHGGFQLKEKVRAHLIESGYKVKDFGCYSLESVDFPEYAAKVGHFVATENSLGVLCCGTGIGMSIAANKIKGVRAAVVSDTFSAMMTRRHNNSNVLCLGERVLGDSLALLLLDTWLAAEFEGGRHMTRLAKLAELEEQEEVE

SEQ ID NO: 1553 - protein, 151 aa, Listeria innocua
MTVSKVAIASDHGGIELRKSIISYLESVGISYEEFGPEAPESVDYPGLAITVSEKVVNNEVDRGILVCGTGIGMSIAANKVKGIRCALVGDTFSAHATREHNDTNVLALGARVIGPGLAEDIVKIWLETAYEGGRHANRVGQITAYEDSHA

SEQ ID NO: 1554 - protein, 151 aa, Listeria monocytogenes
MTVSKVAIASDHGGIELRKSIISYLESVGISYEEFGPETPESVDYPGLAITVSEKVVNQEVDRGILVCGTGIGMSIAANKVKGIRCALVGDTFSAHATREHNDTNVLALGARVIGPGLAEDIVKIWLNTDYEGGRHANRVGQITAYEDSHA

SEQ ID NO: 1555 - protein, 148 aa, Listeria monocytogenes
MKIAIGCDEMGYELKQTLITRLKEKNIEFTDFGSFEDEKVLYPSIAEKVALEVKNNDYDRGILICGTGIGMAITANKIHGIRAAQIHDSYSAERARKSNDAHIMTMGALVIGPSLAVSLLDTWLDSDFSGGRSQAKVDLMEEIDQKNR

SEQ ID NO: 1556 - protein, 148 aa, Listeria monocytogenes
MKIAIGNDHVGIELKPVIVAYLQDLGHEVDDFGAFSNERTDYPEYGKKVAESVAAGKSDLGILICGSGVGISIAANKVNGIRAVVCSEPYSAKLSREHNNTNILAFGSRVVGAELAKMIVQNWLDAEFEGGRHAKRVEMIARIEDEND

SEQ ID NO: 1557 - protein, 146 aa, Listeria monocytogenes
MKLTIGCDHGGRRLKDAIVKHLREKDIEVVDIGTYTDESVDFPSYAEEVANQVVSGQSELGILCCGTGIGMSIAANKVDGIRAAVVSDTFSARATREHNNSNILCLGERVIGEGLALLLVDTWLEASFAGDRHKRRLDKITELERK

SEQ ID NO: 1558 - protein, 149 aa, Listeria monocytogenes
MEIAIAADHGGFQLKEKIRAHLIESGYTVKDFGCYSLESVDFPEYAAKVGHFVATENSLGVLCCGTGIGMSMAANKIKGVRAAVVSDAFSAMMTRRHNNSNVLCLGERVLGDSLALLLLDTWLVAEFEGGRHNTRLQKLAELEEREEDK

SEQ ID NO: 1559 - protein, 151 aa, Listeria monocytogenes
MTVSKVAIASDHGGIELRKSIISYLESVGISYEEFGPETPESVDYPRLAITVSEKVVNQEVDRGILVCGTGIGMSIAANKVKGIRCALVGDTFSAHATREHNDTNVLALGARVIGPGLAEDIVKIWLETEYEGGRHANRVGQITAYEDSHA

SEQ ID NO: 1560 - protein, 146 aa, Listeria monocytogenes
MKLTIGCDHGGRRLKDAIVKHLREKDIEVVDIGTYTDESVDFPSYAEEVASQVVSGQSELGILCCGTGIGMSIAANKVDGIRAAVVSDTFSARATREHNNSNILCLGERVIGEGLALLLVDTWLEASFAGDRHKRRLDKITELERK

SEQ ID NO: 1561 - protein, 149 aa, Listeria monocytogenes
MEIAIAADHGGFQLKEKIRAHLIESGYTVKDFGCYSLEGVDFPEYAAKVGHFVATENSLGVLCCGTGIGMSMAANKIKGVRAAVVSDAFSAMMTRRHNNSNVLCLGERVLGDSLALLLLDTWLVAEFEGGRHNTRLQKLAELEEREEDK

SEQ ID NO: 1562 - protein, 151 aa, Listeria monocytogenes
MTVSKVAIASDHGGIELRKSIISYLESVGISYEEFGPEAPESVDYPGLAITVSEKVVNQEVDRGILVCGTGIGMSIAANKVKGIRCALVGDTFSAHATREHNDTNVLALGARVIGPGLAEDIVKIWLETEYEGGRHANRVGQITAYEDSHA

SEQ ID NO: 1563 - protein, 151 aa, Listeria monocytogenes
MTVSKVAIASDHGGIELRKSIISYLESVGISYEEFGPETPESVDYPGLAITVSEKVVNREVDRGILVCGTGIGMSIAANKVKGIRCALVGDTFSAHATREHNDTNVLALGARVIGPGLAEDIVKIWLETAYEGGRHANRVGQIAAYEDSHA

SEQ ID NO: 1564 - protein, 148 aa, Listeria monocytogenes
MKIAIGCDEMGYELKQTLITRLKEKNIEFTDFGSFEDEKVLYPSIAEKVALEVKNNDFDRGILICGTGIGMAITANKIHGIRAAQIHDSYSAERARKSNDAHIMTMGALVIGPSLAVSLLDTWLDSDFSGGRSQAKVDLMEEIDQKNR

SEQ ID NO: 1565 - protein, 149 aa, Listeria monocytogenes
MEIAIAADHGGFQLKEKIRTHLIESGYKVKDFGCYSLESVDFPEYAAKVGHFVATENRLGVLCCGTGIGMSMAANKIKGVRAAVVSDAFSAMMTRRHNNSNVLCLGERVLGDSLALLLLDTWLAAEFEGGRHMTRLGKLAALEEQEGVE

SEQ ID NO: 1566 - protein, 147 aa, Listeria monocytogenes
MKIAIGCDEMGYELKQTLITRLKEKNIEFTDFGSFEDEKVLYPSIAEKVALEVKNNDYDRGILICGTGIGMAITANKIHGIRAAQIHDSYSAERARKSNDAHIMTMGALVIGPSLAVSLLDTWLDSDFSGGRSQAKVDLMEEIDQKK

SEQ ID NO: 1567 - protein, 149 aa, Listeria monocytogenes
MEIAIAADHGGFQLKEKIRAHLIESGYTVKDFGCYSLESVDFPEYAAKVGHFVATENSLGVLCCGTGIGMSMAANKIKGVRAAVVSDAFSAMMTRRHNNSNVLCLGERVLGDSLALLLLDTWLVAEFEGGRHNTRLQKLAKLEEREEDK

SEQ ID NO: 1568 - protein, 149 aa, Listeria monocytogenes
MEIAIAADHGGFQLKEKIRAHLIESGYTVKDFGCYSLESVDFPEYAAKVGHFVATENSLGVLCCGTGIGMSMAANKIKGVRAAVVSDAFSAMMTRRQNNSNVLCLGERVLGDSLALLLLDTWLAAEFEGGRHNTRLAKLAELEEPEEDK

SEQ ID NO: 1569 - protein, 149 aa, Listeria monocytogenes
MEIAIAADHGGFQLKEKIRAHLIESGYKVKDFGCYSVESVDFPEYAAKVGHFVATENSLGVLCCGTGIGMSMAANKIKGVRAAVVSDAFSAMMTRRHNNSNVLCLGERVLGDSLALLLLDTWLAAEFEGGRHMTRLGKLAELEEREGVE

SEQ ID NO: 1570 - protein, 151 aa, Listeria monocytogenes
MTVSKVAIASDHGGIELRKSIISYLESVGISYEEFGPEAPESVDYPGLAITVSEKVVNQEVDRGILVCGTGIGMSIAANKVKGIRCALVGDTFSAHATREHNDTNVLALGARVIGPGLAEDIVKIWLETAYEGGRHANRVGQITAYEDSHA

SEQ ID NO: 1571 - protein, 148 aa, Listeria monocytogenes
MKIAIGCDEMGYELKQTLIARLKEKNIEFTDFGSFEDEKVLYPSIAEKVALEVKNNDFDRGILICGTGIGMAITANKIHGIRAAQIHDSYSAERARKSNDAHIMTMGALVIGPSLAVSLLDTWLDSDFSGGRSQAKVDLMEEIDQKNR

SEQ ID NO: 1572 - protein, 151 aa, Listeria monocytogenes
MTVSKVAIASDHGGIELRKSIISYLESVGISYEEFGPETPESVDYPGLAITVSEKVVNQEVDRGILVCGTGIGMSIAANKVKGIRCALVGDTFSAHATREHNDTNVLALGARVIGPGLAEDIVKIWLETEYEGGRHANRVGQITAYEDSHA

SEQ ID NO: 1573 - protein, 146 aa, Listeria monocytogenes
MKLTIGCDHGGRRLKDAIVKHLREKDIEVVDIGTYTDESVDFPSYAEEVANQVVSGQSELGILCCGTGIGMSIAANKVDGIRAAVVSDTFSARATREHNNSNVLCLGERVIGEGLALLLVDTWLEASFAGDRHKRRLDKITELERK

SEQ ID NO: 1574 - protein, 149 aa, Listeria monocytogenes
MEIAIAADHGGFQLKEKIRAHLIESGYTVKDFGCYSLESVDFPEYAAKVGHFVATENSLGVLCCGTGIGMSMAANKIKGVRAAVVSDAFSAMMTRRHNNSNVLCLGERVLGDSLALLLLDTWLAAEFEGGRHNTRLAKLAELEEPEEDK

SEQ ID NO: 1575 - protein, 151 aa, Listeria monocytogenes
MTVSKVAIASDHGGIELRKSIISYLESVGISYEEFGPEAPESVDYPGLAITVSEKVVNQEVDRGILVCGTGIGMSIAANKVKGIRCALVGDTFSAHATREHNDTNVLALGARVIGPGLAEDIVKIWLETAYEGGRHANRVGQITAYEDSQA

SEQ ID NO: 1576 - protein, 146 aa, Listeria monocytogenes
MKLTIGCDHGGRRLKDAIVKHLREKDIEVVDIGTYTDESVDFPSYAEEVANQVVSGQSELGILCCGTGIGMSIAANKVDGIRAAVVSDTFSARATREHNNSNVLCLGERVIGEGLALLIVDTWLEASFAGDRHKRRLDKITELERK

SEQ ID NO: 1577 - protein, 148 aa, Listeria welshimeri
MKIAIGCDEMGYELKQTLITRLKEKNIAFTDFGSFEDEKVLYPSIAEKVALEVKNNDYDRGILICGTGIGMAITANKIHGIRAAQIHDSYSAERARKSNDAHIMTMGALVIGPSLAVSLLDTWLDSDFSGGRSQAKVDLMEEIDQKNR

SEQ ID NO: 1578 - protein, 146 aa, Listeria welshimeri
MKIAIGNDHVGIELKPIIIRFLKELGHEVEDFGAFTNERTDYPEYGKKVAENVAAGKADLGILICGTGVGISIAANKVKGIRAVVCSEPYSAKLSREHNNTNILAFGSRVIGSEMAKMIVQNWLEAEFEGGRHQNRVTMIAGIENE

SEQ ID NO: 1579 - protein, 146 aa, Listeria welshimeri
MKLTIGCDHGGRRLKDAIVKHLREKNIDVVDIGTYTDESVDFPSYAEEVANQVVSGQSELGILCCGTGIGMSIAANKVDGIRAAVVSDTFSARATREHNNSNILCLGERVIGEGLALLLVDTWLEASFAGDRHKRRLDKITELERK

SEQ ID NO: 1580 - protein, 151 aa, Brevibacillus brevis
MKVALAADHGGYKLKEEIKTLLASMNIQTEDFGCTCEESVDYPDYALPVAEKVAAGEFDRGILVCGTGIGMSIAANKVPGIRCALVHDTFSARATREHNNTNVLAMGERVIGPGLALDIVKIWLETEFQGGRHERRVEKISQIEAKHAGVK

SEQ ID NO: 1581 - protein, 153 aa, Paenibacillus larvae
MLKLALGADHAGYRLKDVLIPFIESLGHEVVDLGCSCDSSVDYPDYALEVCDHVISGIADKGILICGTGIGMSIAANKVPGIRCALVHDLFSAQATREHNDSNVLAMGERVVGPGVAQEIVRIWLETEFSGGERHANRVGKVKAIEEKYAIHP

SEQ ID NO: 1582 - protein, 152 aa, Paenibacillus sp. JDR-2
MKIAIGADHAGYRLKDEIVPFLLSLGHEIEDLGCDCSQSVDYPDYALPVADRVASGQADRGILICGTGIGMSIAANKVPGIRCALVHDMFSAQATREHNDTNVLAMGERIIGPGLAQEIVRIWMETPFSSGERHVGRVRKVKEIEQQYTVHP

SEQ ID NO: 1583 - protein, 150 aa, Paenibacillus sp. oral taxon 786 str. D14
MKVVIANDHGGLMLKRELASLLREMNAEVVDLGCDTQDAVDYPDYAIRAAAMVANGEAERGILICGTGIGMSIAANKVPGIRCALAHDVFSAKATRLHNDSNMLALGERVIGPGLAREIVKTWIETEFEGGRHQRRIDKVSNYERSARSE

SEQ ID NO: 1584 - protein, 148 aa, Macrococcus caseolyticus JCSC5402
MKIAIASDHGGFQYKEKIIELLQSQNIEYIDFGPLDETSVDYPDYAKPVAESVVNGACDRGILICGTGIGMSIAANKVPGVRCALVHDVFTAQVTREHNNSNILAMGQRVIGEGLMLLIVKTWLEAEFEGGRHQKRIDKVSALESCNG

SEQ ID NO: 1585 - protein, 147 aa, Staphylococcus carnosus
MEIAIGADHNGYELKEEIKSYVEELGHTVTDYGCHQCAETDYPDVAQEVGKNIQKGEHDRGILICGTGIGVAITACKLKGIRAALAHDVYSAERAQLSNNAQIMTMGAQIIGVEAAKKNVKAYLDAEWQGGSQRKVDKIDQVEKDEE

SEQ ID NO: 1586 - protein, 148 aa, Staphylococcus saprophyticus
MKIAIGADHNGYDLKEAVKAHVEHLGHVVEDFGCHQCAETDYPDVAAEVGKSIQQGENERGILICGTGIGVAITANKIKGIRAALAHDYYSAERAQLSNNAQILTMGAQIIGVEVAKKNVEAYLNVSWEGGSQRKVDKIDKVEESENK

SEQ ID NO: 1587 - protein, 151 aa, Abiotrophia defectiva
MKLVIGSDHVGYDYKEIIKLYLKEKGIDVTDVGTDSTERFDYPISGYKAAKIIVAGEADGGVLICGTGVGISLAANKVKGIRACVCSEPYSAGLSKCHNNTNIIAFGSRVVGIELAKMIVDAWLEAKYEGGRHGKRVEMIAEIENTGELMV

SEQ ID NO: 1588 - protein, 146 aa, Abiotrophia defectiva
MENKIIAIGSDHGGFELKQEIIKYLTEKNIEYKDFGCYDETSCDYTEYGKAVAEAVAAGKYEKGILICGTGIGISITANKVKGIRCALCSDCFSAEATREHNDANILALGGRVVGTGVALKIVDTFLNTPFSNEERHIRRISRIES

SEQ ID NO: 1589 - protein, 157 aa, Abiotrophia defectiva
MVETMKLAMGCDPAAYLFYRKLLERMRGEGYDIVDVGCESENEADGGKYAEIAEIVSNKVIKKECDYGILLCGTGQGMAMAANKIPGIRAVLCYDVLPAVLSKNDNNGNVLCTGAWFMEKKGIDFTLAMIHAWLFSDYTGTHEDGMRALSHLDCKRY

SEQ ID NO: 1590 - protein, 146 aa, Enterococcus casseliflavus
MKLAIDCDHVGFELKTDIITYLELLGHTVQDFGTQSAKRVDYPNYAAAVAEAVVTQKCDLGILICGTGVGISIAANKIKGIRAVVCSEPYSAKLSREHNNTNVLAFGSRVVGIELAKMITKEWLAAEFEGGRHQKRVAMIGQLEVE

SEQ ID NO: 1591 - protein, 172 aa, Enterococcus faecalis
MKTKIAIACDDLGFETKEAIKKYLIEEKNADVVYDPVQVPEDGVNTFAKLADEMSVLIQKDVCRLGIYICGTGIGFTCQANKHWGIRATAVTNPYSAKRARLSNNVQIIGLGLRVNGLEYMKQIIDAWYDEPFEFSTARENSKNNLLEAEKNDNLLLKKPDHVAWNMGFRPD

SEQ ID NO: 1592 - protein, 172 aa, Mitsuokella multacida DSM 20544
MKVKIGIACDDIGFERKEEVRHYLEEVKGMEVVYDPVKVPADGQNTFAVLADDMATRIQKDEFRLGIYICGTGIGFTCQANKHWGIRAVAVSNPYTAQRARLSNNAQIIGLGCRVLGMEYTKMVLDAWLDNPFDFATARENSKKNLLEAKKNDDLLLKKPDYIAWNMGFEAE

SEQ ID NO: 1593 - protein, 149 aa, Lactococcus lactis
MKLAIGSDHVGFELKPLIIDYREELGHEVTDFGPFSTERTDYPIYGKKVAEEVAAGHFDGGVLICGTGVGISISANKVRGIRAVVCSEPYSAKLSKEHNNTNIMAFGSRVVGSELAKMIVKEWLEAIYEGGRHAKRIEMITELETEQKR

SEQ ID NO: 1594 - protein, 149 aa, Lactococcus lactis
MKLAIGSDHVGFELKPLIIDYLEELGHEVTDFGPFSTERTDYPIYGKKVAEEVAAGHFDGGVLICGTGVGISISANKVRGIRAVVCSEPYSAKLSKEHNNTNIVAFGSRVVGSELAKMIVKEWLEAIYEGGRHAKRIEMITELETEQKR

SEQ ID NO: 1595 - protein, 149 aa, Alkaliphilus metalliredigens QYMF
MKIAIGSDHGGYELKNLIKEHLLNKKLEVVDFGTESTDSCDYADYAQGVAEAVAKGDYARGILICGTGIGISIAANKVPGIRCALVGDCFSAKATTEHNDSNVLALGGRVVGPGLALEIVDIWLSATFQGGRHQKRIDKITDIESKYYK

SEQ ID NO: 1596 - protein, 149 aa, Alkaliphilus oremlandii OhILAs
MKIAIGSDHGGYGLKELIRKHLQEKGFDIKDFGTDSTASVDYPDFAKAVGEAVVAGEFQRGILICGTGIGISIAANKIPGVRCALVGDCFSAKATRQHNDANILALGERVVGPGLALEIVDIWLSAEFEGGRHQGRVDKIADIEKKYTL

SEQ ID NO: 1597 - protein, 152 aa, Clostridium acetobutylicum
MKIAIGSDHAGFSLKKEVIKHLESKNIEVKDFGTLTDESCDYPDYALKVAEEVAQKNFEFGILICGTGIGISISANKVPGIRAAVCTDTFCAHASREHNNANILAMGERVVGPGLAIDIVDTFLNSKFQGDRHQRRIDKITQIEKKYNGGMK

SEQ ID NO: 1598 - protein, 169 aa, Clostridium asparagiforme DSM 15981
MGLTTPYRKEDLQMNKTIVIGCDNAAVSMKNQLKAYMEAAGYTVEDMGCDSPDDPIYYPYVAAKACQAIIDSNYTKEGVLICGTGLGMAMTANKFPGIRAGVCHDSFSGERLKLSNNGNVICFGERVIGVELAKKILGEWLTLEFKDGSSTPKVAAINELEHHNMKAGS

SEQ ID NO: 1599 - protein, 157 aa, Clostridium asparagiforme DSM 15981
MKVAVGADFSAIARKNEVKAYLIENGYEVLDLGQNEGEDQLIYPEAAKRIALAVQSGEAERGIIFCGTGGGVSIMANKFRGVYCVASESMYTAFKMRQLNGANVLAMGKNVAGEQNTYEIVNLFLTTDFCQDFAPEREAFVNGLRRRMLEIEAENLK

SEQ ID NO: 1600 - protein, 146 aa, Clostridium asparagiforme DSM 15981
MKIAMGNDHTGIELKNIIKEFVEGKGYEVIDLGTNAPESCDYPVYGEKVGRAVADGEADLGIAICGTGVGISLACNKVKGIRACVCSEPYTAKLSRQHNNSNVLAFGSRVVGSELAKMITEAWLDAAFEGGRHQRRVDMVMEIEKR

SEQ ID NO: 1601 - protein, 150 aa, Clostridium bartlettii DSM 16795
MKIGLGCDHGGYNLKLEIKKYLGTKGIECVDFGTNNDTESVDYPIYGQKVAEAVVAKEVDYGIVCCGTGIGISLAANKVPGIRCAVVSDTFSAKMSKAHNNANMLSLGERVLGKGLALEIVEAWLNTEFEGDRHLRRVNLLSEIEKKYNK

SEQ ID NO: 1602 - protein, 164 aa, Clostridium beijerinckii
MHVEKSQNKLGDDLIMKIAIGCDHGGLELKNEIIKFLESEKHEIKDFGTYSTGSCDYPDIALPVAEAVAAKEYEFGILICGTGIGIGIAANKVPGIRAALCSDTFSAHATREHNNANILTMGQRVVGAGLALDIVKTFISAKFEGDRHQKRIDKISDIEKKYTH

SEQ ID NO: 1603 - protein, 147 aa, Clostridium beijerinckii
MIAIGADHGGYKLKEFIKGYLDKNSVEYIDVGTFSEDSIDYPQIAMDVANRVSIGDCEKGILCCGTGIGMSIVANKIKGVRAALVGDCFTAKATREHNDSNVLCLGGRVIGEELALMIVDIWLSTEFIGKHHVNRLNQIKEIEEKFK

SEQ ID NO: 1604 - protein, 149 aa, Clostridium beijerinckii
MKRMKIALGCDHGGINLKGAIKKHLISKNIEVEDFGTNSSESVNYPEYAIKVSKAVISKECDLGILCCGTGIGMSIAANKHKGIRAAVVGDCFSAKMTREHNNTNVLCLGERVTGEGLALTIVDTWINSKFQGGRHSERLALVEEIENK

SEQ ID NO: 1605 - protein, 152 aa, Clostridium bolteae ATCC BAA-613
MRTIVIGCDNAAVHLKNELMGFMEKKGYTVENMGCDSTEDSTYYPYVAEKVCQEIINSGYQKHGVLICGTGLGMAMTANKFKGIRAGVCHDVFSAERLKLSNDGNVICMGERVIGAELAKRILEKWLELEFVDCASTSKVEAIKEIEGENLK

SEQ ID NO: 1606 - protein, 149 aa, Clostridium bolteae ATCC BAA-613
MVISVGSDHAGYGLKVKMIPYLESLGHTIIDNGNNGAEDVVFFPEVARAVCRPVLEGTAERGIMFCGTGVGASVACNKIPGIRASIVHDYQCAHQCVEHDHVNVMCIGEKVVGEWLAKDLLKAFLEAAGDTDERTAHVIQLLAQMDQRQ

SEQ ID NO: 1607 - protein, 146 aa, Clostridium bolteae ATCC BAA-613
MKIAIGNDHTAIELKNIIKEFVEEKGYEVIDLGTNSTESCDYPIYGEKVGRAVADGQADLGIAICGTGVGISLAANKVKGIRACVCSEPYTAKLSRVHNNSNVLAFGARVVGSELAKMITEAWLDAEFEGGRHERRVNMIMEIENR

SEQ ID NO: 1608 - protein, 145 aa, Clostridium botulinum
MKIALGSDHAGLPLKNEIIKHLEGKGIEIKDFGTYTEESCDYPDYAQKVAEKVVAKEFDFGILVCGTGIGISIAANKVKGVRAALCSDTFSAHACREHNNANILALGQRVVGVGLALDIVDNFLNAEFQGGRHENRINKMMRIEK

SEQ ID NO: 1609 - protein, 149 aa, Clostridium botulinum
MKLAIGCDHGGFELKQEIIKFLESEGHKVKDFGTHSTESCDYPDISLPVAEAVVAKEFELGILVCGTGIGIGIAANKVPGIRAALCSDTFSAHATRQHNNANILTMGQRVVGTGLALDIVKTFISSEFEGDRHQKRIDKISAIETKYSK

SEQ ID NO: 1610 - protein, 145 aa, Clostridium botulinum
MKIALGSDHAGLPLKNEIIKHLEGKGIEIKDFGTYTEESCDYPDYAQKVAEKVVAKEFDFGILVCGTGIGISIAANKVKGVRAALCSDTFSAHACREHNNANILALGQRVVGVGLALDIVDNFLNAKFQGGRHENRINKMMEIEK

SEQ ID NO: 1611 - protein, 149 aa, Clostridium botulinum
MKIAIGCDHGGVDLKRTVIEHLQEKGIEVKDFGTYTEESCDYPEYGQKVAEEVVAKNYDFGIVICGTGIGISISANKVPGARAALCHDTFSAHATREHNNANILALGARVTGPGLALDIVDSFLGSTFEGGRHERRIEKISDIEKKYSK

SEQ ID NO: 1612 - protein, 149 aa, Clostridium botulinum
MKIAIGSDHGGVNLKKDIIKHLQEKGIEVKDFGTYTEESCDYPQYGQKVAEEVVAKKYDFGIVICGTGIGISISANKVPGARAALCHDTFSAHATREHNNANILALGARVTGPGLALDIVDTFLESKFEGGRHERRIDKITEIEKKYQK

SEQ ID NO: 1613 - protein, 149 aa, Clostridium botulinum
MKLAIGCDHGGFELKQEIIKFLESEGHEVKDFGTHTTESCDYPDISLPVAEAIVAKEFELGILICGTGIGIGIAANKVPGIRAALCSDTFSAHATRQHNNANILTMGQRVVGTGLALDIVKTFISSEFEGDRHQKRIDKISAIETKYSK

SEQ ID NO: 1614 - protein, 149 aa, Clostridium botulinum
MKLAIGCDHGGFELKQEIIKFLESEGHEVKDFGTHSTESCDYPDISLPVAEAIVAKEFELGILVCGTGIGIGIAANKVPGIRAALCSDTFSAHATRQHNNANILTMGQRVVGTGLALDIVKTFISSEFEGDRHQKRIDKISAIETKYSK

SEQ ID NO: 1615 - protein, 145 aa, Clostridium botulinum
MKIALGSDHAGLPLKNEIIKHLEGKGIEIKDFGTYTEESCDYPDYAQKVAEKVVAKEFDFGILVCGTGIGISIAANKVKGVRAALCSDTFSAHACREHNNANILALGQRVVGVGLALDIVDNFLNAEFQGGRHENRINKMMGIEK

SEQ ID NO: 1616 - protein, 145 aa, Clostridium botulinum
MKIALGSDHAGLPLKNEIIKHLEGKGIEIKDFGTYTEESCDYPDYAQKVAEKVVAKEFDFGILICGTGIGISIAANKVKGVRAALCSDTFSAHACREHNNANILALGQRVVGVGLALDIVDNFLNAEFQGGRHENRINKMMGIEK

SEQ ID NO: 1617 - protein, 149 aa, Clostridium butyricum
MKIAVGCDHGGFELKNEIIKYLESEKYEIKDFGTYSTDSCDYPDIAQPVAEAVAAKEFDFGILICGTGIGIGIAANKVPGIRAALCSDTFSAHATRQHNNANILTMGQRVVGTGLALDIVKTFLSSEFEGDRHSKRINKITAIEEKYGK

SEQ ID NO: 1618 - protein, 149 aa, Clostridium carboxidivorans P7
MKIALGSDHAGLPLKKEIITHLEGKGIQIEDFGTYTESSCDYPEFALKVAEEVAAKNFDFGILVCGTGIGISIAANKVPGIRAAVCGDTFSAHACREHNDANILTLGQRVVGLGLALDIVDIFLDTKFEGGRHQKRIDKISDIEKKYSK

SEQ ID NO: 1619 - protein, 152 aa, Clostridium cellulolyticum
MSIAIGCDEAGFQFKEVIKNLLLEKGLDVEDFGVYNTDPVLYPDIAVAVAKSISEGKHERGILICGTGIGMAIAANKVPGIRAAVCHDSFSTERSRKSNNAQIMALGARVIGIELAKLLVDLWLECEFGGGGSEAKVNKIMEYENEFLKSCR

SEQ ID NO: 1620 - protein, 149 aa, Clostridium cellulolyticum
MIAIGSDHAGYLLKADIIKFLESKGLEVKDFGTNCPDSVDYPDYGRAVAEAVASKECEKGILICGTGIGISIAANKVPGVRAALCTDSYMAKMCRQHNDANIIAIGERVVGPGLAFDIIETWLETEFLGGRHQNRLDKISDIEKKYLTK

SEQ ID NO: 1621 - protein, 149 aa, Clostridium cellulovorans
MKIALGSDHAGFQLKNAIQKHLIEKGIEVKDFGTESEASCDYSDFALKVAEEVKDKNFDFGILVCGTGIGISIAANKVPGIRAALCHDTFSAHSTRQHNNANILAMGARVVGEGLALDIVDIFLNTEFEGERHQRRIDKISLIEQKYNK

SEQ ID NO: 1622 - protein, 150 aa, Clostridium difficile
MKIGLGCDHGGYNLKKEIISYLESKGIECVDYGTNNATDSVDYPVYGEIVANSVINKEVDYGILCCGTGIGISLAANKVPGIRCAVVSDVFSAKMSKAHNDANMLSLGERVLGKGLALEIVEAWINTDFEGDRHARRVNMIKSIEEKHNK

SEQ ID NO: 1623 - protein, 148 aa, Clostridium difficile
MKISIGCDHGGYELKEYIKENLINKGIEVEDVGTNSKESVDFPIYAKKVSQNVQSKKSDLGILCCGTGIGMSIAANKFKGIRAAVVSDCFSAKATREHNNTNVLCLGERVIGKGLAMRIVEEWLNSSYNGERHARRLQMIDDIEKENL

SEQ ID NO: 1624 - protein, 150 aa, Clostridium difficile
MKIGLGCDHGGYNLKKEIISYLEGKGIECVDYGTNNATDSVDYPVYGEVVANSVINKDVDYGILCCGTGIGISLAANKVPGIRCAVVSDVFSAKMSKAHNNANMLSLGERVLGKGLALEIVEAWINTDFEGDRHARRVNMIKSIEEKHNK

SEQ ID NO: 1625 - protein, 148 aa, Clostridium difficile
MKISIGCDHGGYELKEYIKENLINKGIEIEDVGTNSKESVDFPIYAKKVSQNVQSKKSDLGILCCGTGIGMSIAANKFKGIRAAVVSDCFSAKATREHNNTNVLCLGERVIGKGLAMRIVEEWLNSSYNGERHARRLQMIDDIEKENL

SEQ ID NO: 1626 - protein, 151 aa, Clostridium hathewayi DSM 13479
MKEEFIYIGSDHGGFSLKQVIKDCLDRKGILYKDVGSDSAEIVRYPTYAEEVALAVSEHRATRGILICSTGIGMSIVANRFKGVRASLCTDSYMGKITRAHNDSNILCLGGKITGELEAVDILENWLTTEFEGGRHTISLGLIEELDCNGK

SEQ ID NO: 1627 - protein, 145 aa, Clostridium hathewayi DSM 13479
MRIGIGCDHGGYEMKEELKKRLTGGGHAVTDKGIYSVSEVDYPDVAAEVAEGVVAGEYDCAILVCGTGIGMSIAANKVDGIRAALVTDTFSARMAKEHNNANIITLGARTVGIELAWELVNAYLGAEFLGGKHLVRVEKIMGMEK

SEQ ID NO: 1628 - protein, 151 aa, Clostridium hathewayi DSM 13479
MKIAIGNDHTALEMKNEMKKFLEEKGYEVIDYGTNSTESCDYPVYGEKVGNAVAGGEADLGLAICGTGVGISLACNKVKGIRCCVCSEPYTAKLSRMHNDSNVLAFGARVIGVEMAKMITEEWLNAKYEGGRHQRRVDQVMDIERRNQNAR

SEQ ID NO: 1629 - protein, 155 aa, Clostridium hiranonis DSM 13275
MEDFKMKIALACDHGGYDLKMAIIAHLEKRGIEVMDLGTNNATDSVNYPEYGEAAALKVANGEADCGILVCGTGIGISLAANKVPGIRCAVVSDTFSARMTKAHNNANMLAMGGRVVGPGLALDIVDAYLDTEFEGGRHQTRVDMLMDIEKKYTK

SEQ ID NO: 1630 - protein, 146 aa, Clostridium hylemonae DSM 15053
MKIAIGCDPNAQEAKEELIKFMEEKGYGEITDFGSEDPIYANTAVKVAEAVASKEYDRGILICGTGIGVSIAANKVKGAYAALLSDVYSAKRARLSNDANIACMGAFTIGNKLREELTDAFLTNDFVPGCSSQPKVDAFVEYDNAR

SEQ ID NO: 1631 - protein, 157 aa, Clostridium hylemonae DSM 15053
MEERRTNRMMKIGIGNDHAAVDMKNEVVEFLKEKGYEVVNFGTDKKESSNYPEYGRKVAEAVAAGEVDLGILICGTGVGISLAANKVKGIRAVVCSEPYSAKLSRQHNNTNVLAFGARVIGIELAKMIIEEWLNAEFMGGRHQDRIDMITEIENENE

SEQ ID NO: 1632 - protein, 149 aa, Clostridium kluyveri
MKIALGSDHAGFPLKKEIIEHLKNKGLELEDFGTFSEESCDYPDYALKVGEQVVSKNYDFGILVCGTGIGISIAANKIPGVRAALCGDTFSAHACREHNNANILAIGQRVVGVGLALDIVDNFLFTEFQGGRHQKRIDKIGEIEKKYSR

SEQ ID NO: 1633 - protein, 154 aa, Clostridium kluyveri
MEVFFMKIALGSDHAGFPLKKEIIEHLKNKGLELEDFGTFSEESCDYPDYALKVGEQVVSKNYDFGILVCGTGIGISIAANKIPGVRAALCGDTFSAHACREHNNANILAIGQRVVGVGLALDIVDNFLFTEFQGGRHQKRIDKIGEIEKKYSR

SEQ ID NO: 1634 - protein, 149 aa, Clostridium leptum
MKIAIGCDEAGCGLKHIIIDLLQKEGIEVTDEGCRDDEVVLYPNIAERVANIVADGEADRGILICGTGIGMAMAANKVKGIRAAVCHDPFSTERSRKSNDAQIMCMGARVIGPELAKMLVKLWLTCDFAGGGSAPKVEAINQMEEKYFK

SEQ ID NO: 1635 - protein, 163 aa, Clostridium leptum
MDKRIIIGADDSGFTLKEAVKEHLLKNGYDVTDVGTLSLDEPVVYYEVGRRVAKEVADKKFERGLLFCGTGMGVNLVANKFPGVYCGLCESVFAAKKCRIINNCNVLAMGGFIVGPKMGIEMAEAFLNTDFSYGFDLATPEFLQNAVKEIDQISADVLKEYSK

SEQ ID NO: 1636 - protein, 148 aa, Clostridium leptum
MIALGADHGGYRLKEAVKAYLEEKGIPYKDFGTDSEESVNYGPYAYRVAQSIVSGECEKGVLCCGTGIGISIAANKVKGIRAAVCTNEFCAEMTRRHNDANILAMGGRVIDEKTAVKLADIFLNTPFEGGRHLERIQQIAAIENGEKL

SEQ ID NO: 1637 - protein, 145 aa, Clostridium methylpentosum DSM 5476
MIALGSDHGGFELKREIANYLTERGIPFEDFGTHSPDSCDYPDMAVEPCEAVANGRCDQAILICGTGIGISMAANKIHGIRAAVCSDYFSAKYTRLHNDANVLCLGGRVVGPGLACELVEVFLNTPFEGGRHSGRIEKLMKLEEK

SEQ ID NO: 1638 - protein, 141 aa, Clostridium nexile
MIAIGCDHGGYDLKLEIIKYLEREGLAYKDFGCNGESVDYPIYARKVGQAVLDGECEKGILICGTGIGISIAANKMKGIRCALCSDCFSAEATRLHNDANIIALGGRVLGPELAVKIVDTFLKTPFSGDERHVRRISMIEE

SEQ ID NO: 1639 - protein, 149 aa, Clostridium novyi
MKIAIGCDHGGVELKKTVIEHLQEKGIEVKDFGTYTEESCDYPEYGQKVAEEVVAKNYDFGIVICGTGIGISISANKVPGARAALCHDTFSAHATREHNNANILALGARVTGPGLALDIVDAFLGATFEGGRHERRIDKISEIEKKYSK

SEQ ID NO: 1640 - protein, 152 aa, Clostridium papyrosolvens
MSIAIGCDEAGFQFKEVIKKLLIEKGLEVEDFGVYSTDPVLYPDIAVAVAKSIAEGKHERGILICGTGIGMAIAANKVPGIRAAVCHDSFSTERSRRSNNAQIMTLGARVIGIELAKQLVNLWLGCEFDGGGSEAKVNKISEYENEFYKSCR

SEQ ID NO: 1641 - protein, 158 aa, Clostridium papyrosolvens
MKKIIIGSDKSGFPLKEAIKAHLTQLGYEVTDGGTLNEEEPKPYFEVASAVAKRVSDGEFERAVLICGTGMGVSIVANKHKGVYAAVCENTYAAEKARAINDANILCLGGWLTAEIVGCAMVDTFLNTEFTQNLEEWRAKNLRNARIQVKNIEDEIYK

SEQ ID NO: 1642 - protein, 149 aa, Clostridium papyrosolvens
MIAIGSDHAGYLLKADIIKFLESKGLEVKDFGTNSPDSVDYPDYGRAVAEAVAGKECEKGILICGTGIGISIAANKVPGARAALCTDSYMAKMCKQHNDANIIAIGERVVGPGLALDIIETWLETEFLGGRHQNRLEKISDIEKKYLTK

SEQ ID NO: 1643 - protein, 154 aa, Clostridium perfringens
MEVNEMKIAIGCDHGGFNLKNTVIKHLEEKGIEVKDFGTYSTDSCDYPDISIQVAEAVAKKEFEYGILICGTGIGISIAANKVPGIRAALCSDTFSAHATRQHNNANILAIGERVVGPGLALDIVDTFLNSEFEGGRHQNRIDKITAIEEKYSK

SEQ ID NO: 1644 - protein, 149 aa, Clostridium perfringens
MKIAIGCDHGGFNLKNTVIKHLEEKGIEVKDFGTYSTDSCDYPDISIQVAEAVAKKEFEYGILICGTGIGISIAANKVPGIRAALSSDTFSAHATRQHNNANILAMGERVVGPGLALDIVDTFLNSEFEGGRHQNRIDKITAIEEKYSK

SEQ ID NO: 1645 - protein, 149 aa, Clostridium perfringens
MKIAIGCDHGGFNLKNTVIKHLEEKGIEVKDFGTYSTDSCDYPDISIQVAEAVAKKEFEYGILICGTGIGISIAANKVPGIRAALCSDTFSAHATRQHNNANILAMGERVVGSGLALDIVDTFLNSEFEGGRHQNRIDKITSIEEKYSK

SEQ ID NO: 1646 - protein, 149 aa, Clostridium perfringens
MKIAIGCDHGGFNLKNTVIKHLEEKGIEVKDFGTYSTDSCDYPDISIQVAEAVAKKEFEYGILICGTGIGISIAANKVPGIRAALCSDTFSAHATRQHNNANILAMGERVVGPGLALDIVDTFLNSEFEGGRHQNRIDKITAIEEKYSK

SEQ ID NO: 1647 - protein, 142 aa, Clostridium phytofermentans ISDg
MIALGCDHGGYDLMQEVIAYLEEKKVPYKNFGTDSKASCDYPVFGKNVAMAVANKECEFGILICGTGIGISMAANKVAGVRAALCHDCFSAEATRQHNNANVLCMGGRVVGPGLALKIVEIFLNTEFSNDDRHIRRISMLEN

SEQ ID NO: 1648 - protein, 153 aa, Clostridium scindens
MKIAIGCDPNAQTVKEELIKYIEKKGYGEVTDFGSEDPIYAHTAIKVAESVAAKEYDRGILICGTGIGVSLAANKVKGAYAALISDIYSATRARLSNNANIACMGAFTTGSKVREGMVDAFLTNEFVSGCASQPKVDAFVAYDNSRENGNGQK

SEQ ID NO: 1649 - protein, 146 aa, Clostridium scindens
MKIAIGCDPNAQAAKEVLIKYIEAKGYGEVKDFGSEDPIYGHTAFAVAEAVAAKEYDRGILLCGTGIGVSIAANKVKGAYAALVSDVYSAQRARLSNDANIACMGAFTTGDKVRELLVDAFLGNEFETGCASQPKVDAYVKYDQER

SEQ ID NO: 1650 - protein, 146 aa, Clostridium scindens
MKIGIGNDHAAVDMKFEIADYLKELGYEVVNYGTDKKESCNYPEYGEAVARAVASKEVDLGILICGTGVGISLAANKVKGIRAAVCSEPATARLSRQHNNTNILAFGARIVGMELAKDIVKAWLDAEFEGGRHQTRVDMIMEIEDK

SEQ ID NO: 1651 - protein, 149 aa, Clostridium sp. 7_2_43FAA
MKIAIGSDHGGVELKKEIKKYLVTEGHEVKDFGTNSTESCDYPDYALPVAEAVVAKEFDFGILICGTGIGIGIAANKVPGVRAALCSDTFSAHATREHNDANILTLGQRVVGPGLALDIVKTFLNTEFQGERHQNRIDKITEIEKKYYK

SEQ ID NO: 1652 - protein, 170 aa, Clostridium sp. L2-50
MKKVNIEKTGWVTTTRKDFENKKGRTKNMIALGCDHGGYGLMQDVIKHLEERGLEYKNYGCYSEESVDYPVYAKKVAHAVADGECERGILICGTGIGISITANKVPGIRAALCGDCFSAQATREHNDANILAMGARVTGPGLALKIVDTFLDTPFSNDERHIRRIKMIEE

SEQ ID NO: 1653 - protein, 150 aa, Clostridium sp. SS2/1
MKIAIGCDEAAYSLKKIIIDHLSNRDDVELKDFGAEAGEVVLYPDVAKVVAEAVASGEFERGILVCGTGIGMCITANKIPGIRAAVCHDPFSTERSRKSNNAQIMCMGERVIGPELAKYLVDIWLKCDFAGGGSTPKVNRINEIDAEYKK

SEQ ID NO: 1654 - protein, 150 aa, Clostridium sp. SS2/1
MKISLGCDEAAYQLKETIKQHLQEAGHEVIDNGVGEGEVELYPDVAVRTCKKVTDGTCDRGILVCGTGIGMAMTANKVPGIRAAVCHDPFSTERSILSNDANVMCMGARVIAPQLALYLLDIWMGLTFKNGPSTPKVERIMEYQKEFCGK

SEQ ID NO: 1655 - protein, 145 aa, Clostridium sporogenes
MKIALGSDHAGLPLKNEIIKHLEGKGIEIKDFGTYTEESCDYPDYAQNVAEKVVAKEFDFGILVCGTGIGISIAANKVKGVRAALCSDTFSAHACREHNNANILALGQRVVGVGLALDIVDNFLNAKFQGGRHENRVNKMMGIEK

SEQ ID NO: 1656 - protein, 149 aa, Clostridium tetani
MKIALGSDHAGLKLKKEIIKHLEGKDIELKDFGTDAEESCDYPDYAKEVANQVADKNYDLGILICGTGIGISIAANKVPGIRAALCSDTFSAHSCREHNNANILALGERVVGLGLALDIVDTFLSSEFQGGRHQKRLDKISGIENSFHK

SEQ ID NO: 1657 - protein, 156 aa, Anaerococcus hydrogenalis DSM 7454
MINKKENKMREYIIGCDCAAVELKNTIKELLENEGIKVEDVGVKTVEDGTYYPNVAKTLCEKIQESDYEKRGILVCGTGIGMAISANKCKGIRAAVCHDQYSGERAVLSNNANVFCFGQRVIGPELAKKIVKEIISLEFKDGSSTPKVEAINALEK

SEQ ID NO: 1658 - protein, 147 aa, Anaerococcus hydrogenalis DSM 7454
MKYIIGNDHGGIDLVDSVEEKLLELGHEVEKIGTYTKDSCDYPDFAKEACEKVLSNQADFAILICGTGIGMSLAANKFKGIRAACVSDVFSAKMSRAHNNCNVLCFGSRVIGSEVAKMIVEVFANTKFEGGRHSNRVEKITEIEEKN

SEQ ID NO: 1659 - protein, 147 aa, Anaerococcus lactolyticus ATCC 51172
MKFVIANDHGGIDLQPAVCEKLQELGHEVVHVGTYDKESCDYSDFAVKACEKVINNEADFAILICGTGLGMSISANKIKGIRAACVSEPFSAKMSRAHNNANVLCIGARVIGSELCKMIVEEFAKTPFEGGRHQRRVDKICKIEEEN

SEQ ID NO: 1660 - protein, 149 aa, Anaerococcus prevotii DSM 20548
MKYVIGNDHGGLDLEEVVKDELEKLGHEVYHVGAYDSESVDYSDYAKKACTEVIEGRADFAILICGTGLGMSISANKIQGIRAACVSEAYSARMSRAHNNANTLCMGARVIGSETCRMIVDEFVNTKFEGGRHQRRVDKIMDIEKSNKA

SEQ ID NO: 1661 - protein, 146 aa, Anaerococcus tetradius ATCC 35098
MRYVIGNDHGGLDLVEVVKDELEKLGHEVDHVGAFDNKSVDYSDFAKKACDKIIEEKADFAILICGTGLGMSLSSNKIKGIRAACVSESYSARMSRAHNDANVLCIGARVIGSETCRMIIDEFVKTKFEGGRHQRRVDKIMELERI

SEQ ID NO: 1662 - protein, 147 aa, Anaerococcus vaginalis ATCC 51170
MKYIIGNDHGGIDLVDSVEEKLLELGHEVEKVGTFTKESCDYSDFAKIACEKVLNKEADFAVLICGTGIGMSLAANKFKGIRAACVSETYSAKMSRAHNNSNVLCIGSRVIGSEVAKMIVEIFATTEFEGGRHLKRVNKIKEIEENN

SEQ ID NO: 1663 - protein, 150 aa, Finegoldia magna ATCC 29328
MKIAIAADHGGFELKDSMVEYIKSLGNEVVDLGTNSADSVDYPDYAKKVCEEIQKGNSDLGILICGTGIGMSLAANKFEGIRAACVSDVYSAKMSRNHNNANVLCIGARVIGDEVAKLIIKTFLENEFEAGRHQRRVDKIMAFEKENKGL

SEQ ID NO: 1664 - protein, 150 aa, Finegoldia magna ATCC 53516
MKIAIAADHGGFELKDSMVEYIKSLENEVMDLGTNSADSVDYPDYAKKVCEEIQQGNSDLGILICGTGIGMSLAANKFEGIRAACVSDVYSAKMSRNHNNANVLCIGARVIGDEVAKLIIKTFLENEFEAGRHQRRVDKIMAFEKENKGL

SEQ ID NO: 1665 - protein, 143 aa, Parvimonas micra ATCC 33270
MKIIIGNDHSAVEMKNELVKFLEEMGHEVINVGTDGTESVDYPLFGQAVCKKVLENKNSLGIAICGTGIGISIACNKVKGIRAGLCSESFSARMTRKHNNANVLCLGARVTGIELAKDIVKTFIEEDFEGGRHQKRIDMLEEN

SEQ ID NO: 1666 - protein, 144 aa, Peptoniphilus lacrimalis 315-B
MKIALGSDHAGFHLKEDIKKYLQEKQIETVDCGSFSDQRCDYPDFGHKVAKTVQNGSVDYGIVICGSGIGISISANKVKGIRCALCSEPLSAKLSRNHNNCNMLAMGARLIGLDMAKEIVDTFVQSKFEGGRHIRRVEKIEEDL

SEQ ID NO: 1667 - protein, 146 aa, Symbiobacterium thermophilum
MKVAVASDHGGIDLKATVISVLKSLGCEVADLGTHDRSSCDYPDYAQKVAEGVAAGEYQRGVLICGTGIGMSIAANKVAGVRAALCNEIYSARMARAHNDANVLCLGARVVGSGVAEEIVRAFFTTEHEGGRHARRVEKIRLLEQG

SEQ ID NO: 1668 - protein, 154 aa, Symbiobacterium thermophilum
MRIAIGNDHVGTEMKRAIAAHLESLGHEVVNFGTDSTERTDYPIYGERVARAVAAGEVDCGILICGTGVGISLAANKVRGIRAVVCSEPYTARLSKQHNNTNILAFGARVVGVDLAKMIVDEWLNASFEGGRHQRRVDMIADIERREECGPEGC

SEQ ID NO: 1669 - protein, 152 aa, Anaerofustis stercorihominis DSM 17244
MKKIAVGADAVGLLLKDEIVSYLKDEGYGVTDLGVKEESDKTFYANVAEKVALAVRDEDYDRGLLFCGTGIGMSIAANKVPGVFATVCHDPYSAERASLSNNAKIITMGYRVIGKETAKVVLKHWLDNDFVEGCKSQSNVDEVTKLDEKYKG

SEQ ID NO: 1670 - protein, 150 aa, Anaerofustis stercorihominis DSM 17244
MKIVIASDHGGYELKQFLIETFKKEGYDFVDYGTNSEESVDYPDYAIKTCEDVAAGKFDRGILICGTGIGISIAANKVKGIRAAHCTDCFSAKMCKQHNNANVIVLGGRITGPELAAEILRTYLNEKEFLGGRHENRVNKIKAYEEKVYK

SEQ ID NO: 1671 - protein, 142 aa, Eubacterium eligens
MIAIGCDHGALELKEQLIEHLKKRGIECKDYGTYTKDSCDYPVYAKKVAEAVLSGECEEGILLCGTGIGMSMAANKIKGIRAALCSDCFSAQATKEHNNANVLCMGARVIGPELAFRIADTFLDSKFSNDERHIRRISMLED

SEQ ID NO: 1672 - protein, 145 aa, Eubacterium hallii
MKIVFGCDPNATEFKLQLMEYVKGLGHEVADLGSDDPIYANTAIEVAKAVAAKEYDRGIIVCGTGIGVSIAANKVKGAYAACIHDVYQAQRAQLSNHANIITMGSQVIGIELAKQLVKEYLSVEWDPNCRSVAKVQRIIDFENEE

SEQ ID NO: 1673 - protein, 154 aa, Eubacterium hallii
MSEVKVIGIGNDHAAVDLKNEIKAYLEEKGYKVVNYGTDSSESCDYPVYGAKVGNAVASGEVDAGVLICGTGIGISIAANKVNGVRAAVVSEPVSARLTKEHNNANIIAFGARIVGSEMAKAIVDAWLDAEYIGSGRHERRVNMIEEEAAKYNK

SEQ ID NO: 1674 - protein, 147 aa, Eubacterium rectale
MKIAIGNDHAAVELKKTIMEYVESMGHEVTNFGTDSSESCNYPEYGEKVANAVASGEFDCGILICGTGVGISIAANKVNGIRAAVCSDTATARLVKQHNNANIIAFGERIVGVELAKDIVKAYLTAEFEGGRHAKRIAMISDIEARN

SEQ ID NO: 1675 - protein, 144 aa, Eubacterium saphenum
MIVVLAADHGGANLKNELAAVLRDKGYKILDLGTNDAEVSVDYPVYAKEAALLVAEGKADRGIVCCGSGIGVSIASNRVRGVRCALCMDENMAELSRRHNDANMLALGGRLLDVEKAKRIMESWLETKFEGGRHKRRIDMIDGI

SEQ ID NO: 1676 - protein, 144 aa, Eubacterium siraeum
MLAIGSDHAGYELKCEVKKFLDGLGVEYIDCGCNGERADYPDIAEKTCEKIKSGECDKGILICGTGIGISISANKIKGIRAALCQDYYTAKYTRLHNDANVLCMGGRVIGAGTAEEIVRVFLSTEFEGGRHAARVDKMMALENK

SEQ ID NO: 1677 - protein, 154 aa, Eubacterium ventriosum
MKIGFGCDHAAIDLKNELIEYMTEKGYECVDYGTGYDENGEIIKCDYPNKGREVGEAVVRKDVDYGVLMCGTGIGISVAANKVPGVIAAVCSEPYSAKLTKQHNNANVIAFGARVVGVELAKMILDEFFGAEFEGGRHQARVDMIHGIEADYSK

SEQ ID NO: 1678 - protein, 150 aa, Eubacterium ventriosum
MKIGIGNDHVAVEMKNEIKAYLEEKGHEVVDFGTNSSERCNYPVYGEAVANAIVNGEVDCGVLICGTGVGISLSANKVNGIRACVCSEPYSARLSKQHNNTNIIAFGARVIGIELAKMIVDEWLNAEYEGGRHQVRIDMIKDIEEKQKQK

SEQ ID NO: 1679 - protein, 156 aa, Heliobacterium modesticaldum Ice1
MKIAIGSDHGGFRMKEDIGAFLAEEIELAGVKPEVIDKGTFSEESVDYPEFGVKVAKAVVEGEADFGIVICGTGIGISIAANKVPGIRAALCGDTFSARMAREHNDANVLALGARVIGPGLARDIVAAFLSSAFAGGRHARRVDMLRAIEGQGTVK

SEQ ID NO: 1680 - protein, 149 aa, Anaerostipes caccae DSM 14662
MKISLGCDEAAFDLKEAIKKHLEDAGHEVVDNGVGPGEVELYPDVAVRTCEKVTSNECDRGILVCGTGIGMAMTANKVPGIRAAVCHDPFSTERSILSNDGNVMCMGARVIAPQLALYLLDIWMGLTFKDGPSTEKVERITYYEKQFSK

SEQ ID NO: 1681 - protein, 149 aa, Anaerostipes caccae DSM 14662
MKISIGCDEAAYELKEAIKKRLEETGHTYVDNGVEAGETALYPDVAVKTCERVASGECDRGILVCGTGIGMAMTANKVPGIRAAVCHDPFSTERSILSNDGNVMCMGARVIAPQLALYLLDIWMGLEFKDGPSTEKVERITYYEKQFSK

SEQ ID NO: 1682 - protein, 143 aa, Bryantella formatexigens DSM 14469
MIAIACDHGGYVLKQEILKHLDKRGLAYKDFGCDSEAAVDYPVYARKVTDAITKGECERGILICGTGIGISIAANKVKGIRAALCTDCFAAEATRLHNDANVLALGGRVVGPGLALKIVDTFLDTPFSQEERHKRRISLIEED

SEQ ID NO: 1683 - protein, 142 aa, Butyrivibrio crossotus
MIALGSDHGGFALKSAIIKHLENRGLEYKDYGCYNTDSCDYPVFGRAAAEAVADGTCDKGIVVCTTGIGISIAANKVKGIRCALCTSTNLAKMTRLHNNANMLALGASVVSEELAMDIVDTFLDTEFSNEERHIRRVEMIEK

SEQ ID NO: 1684 - protein, 141 aa, Coprococcus eutactus
MIALGCDHGGYELMQEVIKHLEERGLEYKNFGCYSTESVDYPIYGQAAAKAVASGECDKGIIICGTGIGISISANKIKGIRAALCHDCFSAQATREHNDANMLAMGARVIGPGLALKIVDIFLDTPFSNDERHVRRIGMIE

SEQ ID NO: 1685 - protein, 154 aa, Dorea formicigenerans ATCC 27755
MKRGGYNVMKIGIGNDHAAVDMKNQVVEYLEGKGYEVVNFGTDTYESCNYPEYGEKVGRAVAAGDVDLGILICGTGVGISLAANKVKGVRAVVCSEPYSAKLSRQHNNTNILAFGARVIGIELAKMIIDEWLNAEFEGGRHQTRVDMITAIENK

SEQ ID NO: 1686 - protein, 148 aa, Dorea longicatena DSM 13814
MKIAIGCDPNAQQAKEELIKFMEDKGYGEIKDFGSEDPIYANTAVAVAEAVASGEYDRGILICGTGLGVSIAANKVKGAYAALLSDIYSAKRARLSNDANIACMGAFTIGNKLREELTDAFLTNEFVPGCSSQPKVDAFREYEAAHQK

SEQ ID NO: 1687 - protein, 148 aa, Dorea longicatena DSM 13814
MNMKIAIGCDPNAEEAKQEIIAYIEKKGYGEVTDFGSEDPIYANVAIDVAEHVASGEYDRGVLICGTGLGVSIAANKVKGAYAALVSDVYSATRARLSNDANIVCMGAFTTGAKVREMLVDAFFTNEFVPGCSSQPKVDAFREYDQNR

SEQ ID NO: 1688 - protein, 159 aa, Dorea longicatena DSM 13814
MKDKGRNRNMKIGIANDHSAVDMKNEIVEYLESLGHEVVNYGTDSYESCNYPEFGEKIGNAVASGEVEQGIAICGTGAGISLAANKVNGIRAVVCSDPYTARMAKEHNDANVIAFGARVIGIETAKCIVDEWLNAKFEGGRHATRVDMIMDVEKRNHNL

SEQ ID NO: 1689 - protein, 156 aa, Oribacterium sinus F0268
MKMKIAMGNDHAAVEMKMELKAYLEEQGIEIINVGTDTPERYDYPLAGYQVAKLVQEGKADFGIAICGTGVGISLAANKVPGIRAFPCSEPYSAAMGRRHNNANVLCLGARVVGVELAKMIVDSFLLAEFEGGRHAERVALISEIEEDAEGFKKRM

SEQ ID NO: 1690 - protein, 152 aa, Roseburia intestinalis L1-82
MRNTMKIAIGNDHAATELKFVIMDYLKELGHEVINFGTDTSDSCNYPEYGEKVGRAVVAGEADCGVLICGTGVGISIAANKVKGVRAAVCSDCATARLVKEHNNANIIAFGARIVGTELAKDIVKAYLDAEFLGGRHQTRIDLIHEIEERNS

SEQ ID NO: 1691 - protein, 147 aa, Roseburia inulinivorans DSM 16841
MKIAIGNDHAATELKFIIMDYVKSLGHEVVNFGTDGNESCNYPEFGEKVGRAVVNGEADCGILICGTGVGISIAANKVNGVRAAVCSDCATARLVKEHNNANIIAFGARIVGSELAKDIVKAYLDAEFQGGRHQTRIDMIHEIETRN

SEQ ID NO: 1692 - protein, 153 aa, Shuttleworthia satelles DSM 14600
MKIAIGNDHAATALKFEMMDYLGNLGHELVNFGTDEDASVNYPDYGEAVARAVARKEVDCGVLICGTGIGISLAANKVEGIRAASVSDPVSARLAREHNDANIICFGARIVGPEMARAILDAYLGAEFLGGRHADRVRLIHEIEKRTIEGREL

SEQ ID NO: 1693 - protein, 152 aa, Candidatus Desulforudis audaxviator MP104C
MRIAIACDHGGFKLKQEVLDCLKDSGFQVQDCGTFSEASVDYPDVVLPVAEAVARGEWDRAILLCGTGIGVAMVANKVPGVRAAVAHDPYSARHSRAHNDANVLALGERVVGPGLARDIVTVWLQTEFEGGRHARRVGKIAAVEEKYAPRRS

SEQ ID NO: 1694 - protein, 149 aa, Desulfitobacterium hafniense
MKIALGADHGGYELKNEIRAHLEEQGIEILDFGTNTKDSVEYPRYGFYVGDAVTKGKADLGIVVCGTGLGISIAANKVPGVRAAVCTETYSARMAREHNNANILALGGRVTGLGLALDIVDMFVKTPFAGGRHACRVDLIEAIEKGDTL

SEQ ID NO: 1695 - protein, 154 aa, Desulfitobacterium hafniense
MEVSLLKIALGADHGGYELKNEIRAHLEEQGIEILDFGTNTKDSVDYPRYGFYVGDAVTKGKADLGIVVCGTGLGISIAANKVPGVRAAVCTETYSARMAREHNNANILALGGRVTGLGLALDIVDMFVKTPFAGGRHACRVDLIDAIEKGETL

SEQ ID NO: 1696 - protein, 149 aa, Desulfotomaculum acetoxidans
MRVAIAADHGGFQLKKEIIECLRADGFEYKDFGTYSEESVDYPDLALAVAEAVKAGDYDRGIICCGTGIGVSLAANKVPGIRAALCHDTFSARCAREHNDANILTLGQRVIGAGLAAEIVRIWLNTVFAGGRHARRVEKIAQIEAKYNK

SEQ ID NO: 1697 - protein, 152 aa, Desulfotomaculum reducens
MKNISIVLGSDHAGFEMKEQIKEYLQGQGHTVQDMGCNGTESCDYPDFALAVGEKIRSGQCQQGILICGTGVGMAIAVNKVPGVRAANVFAPEIAQLAREHNNANVLTMGSRFIDLAQAKAIVEKFINTEFAGDRHAKRVDKISAIEKKYSL

SEQ ID NO: 1698 - protein, 153 aa, Pelotomaculum thermopropionicum SI
MKVAVASDHGGFRLKEEVIGLLRELGIAYRDFGTYSEDPVDYPDMALAVAEAVRKGEYDRGVLCCGTGIGVAICANKVPGIRAALCHDTFSARAAREHNDANILTMGQRVIGPGLARDIVATWLQAEFQGGRHARRVDKIRCIEQEYYSFGRS

SEQ ID NO: 1699 - protein, 145 aa, Anaerotruncus colihominis DSM 17241
MKIAIGCDQNASELKEQLKAFIMELGHVCVDFGGDEPIYANTAIRLAQAVAAEECDRGVLICGTGIGMCIAANKVKGAYAALVNNVYQAQRAQLSNRANIMTLGAQVTGVELAKCLVQSYLKEQFDPQSRSAPKVQRICDYENGR

SEQ ID NO: 1700 - protein, 146 aa, Anaerotruncus colihominis DSM 17241
MMLALAADHGGFALKEEVKAWLDEQQIPYKDFGTHDGASCDYADMAAPACDAVISGDCDKALLFCGTGIGISMAANKIKGIRAACCSDYFSAKYTRLHNDANVLCMGGRVIGPGAAIELIDVFLHTEFEGGRHQRRIDKIAALENR

SEQ ID NO: 1701 - protein, 148 aa, Faecalibacterium prausnitzii A2-165
MAKPIALAADHGGFELKEAVKAHLDELGLEYIDFGTHSTASVDYPDMALPACDAVVSGQCDKALLFCGTGVGISMAANKVKGIRACCCSDSFSCEYTRRHNDANALCMGGRVVGPGLACQLVDLFLNTPFEGGRHEKRIAKLMAIETR

SEQ ID NO: 1702 - protein, 148 aa, Faecalibacterium prausnitzii M21/2
MAKPIALAADHGGFELKEAVKAHLEELGLEYIDFGTHSTDSVDYPDMAVPACDAVVSGQCEKALLFCGTGVGISMAANKIKGIRACCCSDSFSCEYTRRHNDANALCMGGRVVGAGLACQLVDIFLNTEFEGGRHQRRIDKLTALENR

SEQ ID NO: 1703 - protein, 144 aa, Ruminococcus flavefaciens
MIAIGCDHAGVEMKKAIIEELSKKGFEFKDMGTDGEPCDYPNMAEAVCGLITSGECEKGILICGTGIGMSIAANKIKGIRAALCSDSFSTKFTRLHNDSNVMCMGARTLGPGLACELAEIFLTTGFEGGRHQRRVDLITALENK

SEQ ID NO: 1704 - protein, 173 aa, Ruminococcus gnavus
MWMLDNYLWILDNRRELEKERDTRREIMRIGIGNDHSALELKAEIIEFLKEKGHEVVDFGTDSSESCDYPKYGEAVGRAVVAKEVDCGILICGTGLGISLAANKVKGVRAAVCSEPFTAKMSRAHNNCNVLAFGARVVGAELAKMIVDVWLNTEFEGGRHQRRVDMIMEIEER

SEQ ID NO: 1705 - protein, 148 aa, Ruminococcus lactaris
MKIGIGNDHSALELKAEIIELLKERGHEVVDYGTNSPESCDYPVYGEKVGRAVASGEVERGILICGTGLGISLAANKVKGVRAAVCSEPFTAKMSRAHNNCNILAFGARVVGAELAKMIVETWLDTEFEGGRHQRRVDMLMDIENRNE

SEQ ID NO: 1706 - protein, 153 aa, Ruminococcus obeum
MIALGCDHGGYELKQEIIKYLEENNIEYKDFGCDSTDSTDYPIYAKRVAIAIQNGDCEKGILICGTGIGISITANKFKGIRAALCSDCFSAEATRLHNNANILAMGGRVVGPGLAVKIVDTFLNTPFSEEERHIRRIKQIEEDTDITDAYPEI

SEQ ID NO: 1707 - protein, 143 aa, Ruminococcus sp. 5_1_39B_FAA
MIALGCDHGGYELKQEIKKYLDEKGIEYKDYGCDSLDSVDYPVYAKKVAHAILDGECEKGILICGTGIGISITANKFKGIRAAVCTDCFTAEATRLHNDANILALGGRVVGPGLALKIVDTFLNTPFSNDERHIRRINQIETE

SEQ ID NO: 1708 - protein, 146 aa, Ruminococcus torques
MKIGIGNDHSALELKAEIISFLKEKGHEVVDYGTNSSESCDYPVYGEIVARAVAAGEVEQGILICGTGLGISLAANKVKGIRAAVCSEPFTAKMARVHNNCNILAFGARVVGAELAKMIVETWLDAEFEGGRHQRRVDLITAIEEK

SEQ ID NO: 1709 - protein, 143 aa, Subdoligranulum variabile DSM 15176
MIAIGCDHGGYELKQKILAHLRQRGLEYRDFGCDSTASVDYPVYGKAVAHAVASGECEKGIVICSTGIGISIAANKVPGIRCALCGDCFSAKATRLHNNANVLALGALVTGPGLALEIVDIFLDTPFSEEERHSRRVSQLEEE

SEQ ID NO: 1710 - protein, 150 aa, Subdoligranulum variabile DSM 15176
MQFDKPIALAADHGGYELKEAIKAHLDELGVAYEDFGTDSTASVDYPDYAVVGCKAVQDGRCALVILCCGTGVGMSMCANKMQGIRACCCSDTFSAELTRRHNNANALCLGGRVVGAGLACKIVDAFLNAEFEGGRHQTRIDKMMALQNQ

SEQ ID NO: 1711 - protein, 155 aa, Dethiobacter alkaliphilus AHT 1
MKIAIASDHGGFKLKKHIAEYLKEKGYTYKDFGTLTEESVDYPDFAILVAEAVAQGEYDLGILCCGTGIGVNMVANKVPGIRAAHCHDTFSARMTREHNDANVLTMGERVIGRGLAIEVVEAFLQGEYAGGRHACRVEKIKEIEARFLDPDKSGH

SEQ ID NO: 1712 - protein, 148 aa, Anaerocellum thermophilum
MKIAIGSDHAGFSLKEAVKKHLEKKGIEFKDFGTYSQESCDYPDIAKDVALAVKNEEFTFGILICGTGIGISIAANKVRGIRAALCHDTFSAKAARAHNNANILAMGARVIGEGLACEIVDAFLASNFEGGRHQRRIDKIHLIENDQK

SEQ ID NO: 1713 - protein, 142 aa, Blautia hansenii DSM 20583
MIALGCDHGGYELKQEIIKYLEEKNIPYKDFGCHSTEAVDYPIYARMVGKAIQTGECEKGILICGTGIGISIAANKMKGIRAALCTDCFCAEATREHNDANILALGGRVVGPGLAVKIVDTFLNTEFSHAERHQKRIDLIEE

SEQ ID NO: 1714 - protein, 143 aa, Blautia hydrogenotrophica DSM 10507
MIAIGCDHGGFELKQEILAYLREKGIEYKDFGCDSTASVDYPVYAKKVCKAITDGECEKGILICGTGIGISITANKQKGIRAALCTDCFCAEATRLHNDANVLALGGRVVGPGLAVKIVDTFLHTPFSGEERHARRIRMMEED

SEQ ID NO: 1715 - protein, 151 aa, Epulopiscium sp. 'N.t. morphotype B'
MKIAIGNDHVAVALKNYITKYLQEKNIEVIDVGTNNNDRTDYPIPAAKVSELVTSGVADRGILICGTGVGISIAANKIHGIRAVVCSEPYSAKLSVEHNNTNILALGSRVVADELAKMIVSEWLDASYEGGRHQKRIDMITQLEVSGVLTL

SEQ ID NO: 1716 - protein, 142 aa, Epulopiscium sp. 'N.t. morphotype B'
MIAIGSDHGGFALKQEIIAHLKERGIDFADVGCYDEQSTDYPDYAKKVADMVLSKEAETGILICGTGIGISITANKIKGIRCALCHDIFSAKATREHNDANVLAFGGRIIGPGLALAIVDEFLNTPFSNDPRHIRRISKIEN

SEQ ID NO: 1717 - protein, 146 aa, Clostridiales bacterium 1_7_47_FAA
MKIAIGNDHTAIEMKEIIKEFVEGKGYEVIDLGTNSTESCDYPVYGEKVGRAVAGGEADLGIAICGTGVGISLAANKVKGIRACVCSEPYTAKLSRMHNNSNVLAFGARVVGSELAKMITEAWLDAEFEGGRHERRVNMIMDIENS

SEQ ID NO: 1718 - protein, 154 aa, Clostridiales bacterium 1_7_47_FAA
MRVGFGNDHVAIELKNILMGHLREKGYECIDFGPTDPADKVNYPEPGRLVAEALMRGEIDKGVLICGTGIGISLAANKVPGIRAAVCSEPYSAKLTVEHNNANIIAMGARVVGPELAKMIVDEFFGAEFEGGRHAVRVDMISEIEAKYGAKWHE

SEQ ID NO: 1719 - protein, 146 aa, Acidaminococcus sp. D21
MMKIIMGCDHGGFELKETLKKVLIEKGYEVEDYGIHKQERVDYPDYAQKVGEAIASGKGDQGILICGTGIGMSIAANKVKGVRAALCNDCYSAAKARQHNNANVLCMGARVLGPGLAQEIMEAYLNASFLGSYHEGRVEKIMALEK

SEQ ID NO: 1720 - protein, 169 aa, Dialister invisus DSM 15470
MDGVKCVIVIHEMGEIFMRVAIASDHGGYRLKERLKKYLKNKDIDCIDCGTDSEDSCDYPDFAQKACGLVQAQTVNFAILICGTGIGMSIAANKMMGIRAALCGDEFSAHYTRAHNNANVLTLGARVIGEGLAENIVDIFLNSSFEGGRHARRIDKITEIERMKSCTNL

SEQ ID NO: 1721 - protein, 147 aa, Mitsuokella multacida DSM 20544
MNITIGSDHGAVALKDEVKMVLKEYEDIKVTDVGTFGTQSVDYPDIAEKVCADVTSGKADFGIVLCGTGIGISIAANKVKGIRCALCNDVYSAKKAREHNNANVLAMGGRVLGFGPAGEIVRAFVESSFEGGRHERRVNKIMAIEQK

SEQ ID NO: 1722 - protein, 154 aa, Selenomonas flueggei ATCC 43531
MRPVIVFGSDHAGYHMKEFLIRELEQNGYQIEDRGPFCKDPVDSGIYAIAVAEEVARHPQVKLGVLICGTGIGMSMMANKVVGIRASLVSDLFSAKMTRAHNAANVLCLGARIIAENMALEITKTWLAAEPLGGKYAARVAHMMAYEKERCDRG

SEQ ID NO: 1723 - protein, 173 aa, Selenomonas flueggei ATCC 43531
MICFFSLNCVKIRTNIHAEKEELMNITIGSDHGAVDLKEEVKMVLHEFSDIQVTDVGTFGKESVDYPDIAEKVCADIVSGKADRGIVLCGTGIGISIAANKINGIRAALCTDVYSAIMSRKHNDANVLAMGGRVTGIGPAGEIVRAWIRTAFEGGRHARRVDKIMALEQKKDR

SEQ ID NO: 1724 - protein, 150 aa, Selenomonas noxia ATCC 43541
MNIVIGSDHGAVELKEEIKMVLHEFSDIRVKDVGTFGKEAVDYPDVAQKVCAEIIAGKADRGIALCGTGIGISIAANKIDGIRAALCTDVYSAIMSRRHNDANVLAMGGRVTGFGPAGEIVRAWIRTEFEGGRHARRIEKTMALEEQTNH

SEQ ID NO: 1725 - protein, 151 aa, Selenomonas sputigena ATCC 35185
MKKTIVIGADHAGYPMKQFLLQQLTEAGCSVEDAGTYDEASCNTQPYAQKVAEEVAKGEGKLGILVCGTGAAMCIMANKVKGARAVVVHDLFTARMTRTHNDANILCMGQRVIANYMAWEIAKTWLSYEPLGGKYAERRETIARYEEEHMK

SEQ ID NO: 1726 - protein, 146 aa, Thermosinus carboxydivorans Nor1
MLVAIGSDHGGFRLKEEIKRFLEEEKIAYRDFGTYSTDSVDYPDISRSVAQAVATGECDRGIIICGTGIGVSIAANKIKGIRAALCHDVYSAQMSREHNDANILTMGERVIGPGLARAIVAKWLATEFAGGRHARRVCQIASLEEE

SEQ ID NO: 1727 - protein, 145 aa, Veillonella dispar
MKVAIGCDHGGLHLKASVKELLNALGHEVEDFGCHTADSCDYPDIAVPVANAVVSGQADRGILICGTGIGIGIAANKISGIRAALCHDTFSAHACREHNDANILTMGERVIGPGLANDIVAIFMETEFEGGRHARRVEKIKALEK

SEQ ID NO: 1728 - protein, 145 aa, Veillonella parvula
MKVAIGCDHGGLNLKASVKELLNALGHEVEDFGCHTADSCDYPDIAVPVANAVVSGQVDRGILICGTGIGIGIAANKIAGIRAALCHDTFSAHACREHNDANILTMGERVIGPGLAKDIVTIWMATDFEGGRHERRVEKIKALEK

SEQ ID NO: 1729 - protein, 158 aa, Halothermothrix orenii
MKVIKNKQYVIGSDNAGYPLKEIIKELLESEGLEYEDVGVDSDQDKTIYPEIAERVVNRIKKSNYEKEGILICGTGIGMAITANKFSRIYAAVCHDVYSAERARLSNDTNVITMGARVIGPVLAKKIIREWLSLEFKPGRSTPKLKQIKKYENQNFVS

SEQ ID NO: 1730 - protein, 162 aa, Natranaerobius thermophilus JW/NM-WN-LF
MTYLTPKKVLTETGQILGIASDHGGLELKQEIINHLQDSGIKIEDLGCYQDESVDYPDYAEKLTQKLVNNEISYGILVCGTGIGISISANKVPGIRAALCHDCFSARMAREHNDANIIALGERIIGKGLALEVVDTFLNSPFGGGRHERRVNKITKLEQKYS

SEQ ID NO: 1731 - protein, 159 aa, Carboxydothermus hydrogenoformans Z-2901
MKIAIGADHAGFNLKEEIKKHLEKKGIAVIDKGTYSAESVDYPDFGEAVAEAVVQKEVDFGIVICGTGIGISIAANKVPGIRAALCSDTFSAHSAREHNDANVLALGARVVGVGLALDIVDTFLGASFEGGRHARRVEKIAGIEEKYCKPQTSNKRERE

SEQ ID NO: 1732 - protein, 149 aa, Ammonifex degensii
MKIAIGSDHGGFQLKKTICRFLEEEGIAYQDFGTYSSESCDYPDIAFAVAEAVARGEFDRGILICGTGIGMAIAANKVPGIRAALCHDTYSARMSREHNDANVLTLGERVVGPGLAVEIVKAWLSSSFAGERHSRRVEKIKARERGGSK

SEQ ID NO: 1733 - protein, 181 aa, Moorella thermoacetica
MWRTFKYGLILWGRDEVKLRVALGSDHGGFHLKMAIKDYLNRQGIANHDFGTYNAESVDYPDYAHKVAAAVASGEYDRGILCCGTGIGVCIAANKVPGIRAALCHDTFSARAAREHNDANILTLGERVIGPGLALEIVDTWLKAEFSGGRHARRVQKISAIEDQYRGREDRVVVPCCHDGK

SEQ ID NO: 1734 - protein, 153 aa, Thermoanaerobacter italicus Ab9
MMKIILGSDHFGFDLKEVIKEHLQSKGIAVVDIGVYDKNPVDYPDIAVALAERVASGEFERGILICGTGIGMAIVANKVPGVRAAVCHDVYSAERARKSNDAQIMTMGGVIVGPELAKKLVDVWLESEFQGGRSLPKVEKIKMIDAKYRGVAK

SEQ ID NO: 1735 - protein, 148 aa, Thermoanaerobacter mathranii
MRIGIGNDHVGYALKLEIAEHLKKLGHEVVDFGHHSTERTDYPIYAKMVADAVTEKKVDCGILICGTGVGMAIAANKVGGIRAVVCSEPYSAKLSKQHNNTNILTLGARVVGSELAKMIVEEWLGAEYEAGRHARRLEMIEEMEKRQR

SEQ ID NO: 1736 - protein, 148 aa, Thermoanaerobacter pseudethanolicus ATCC 33223
MIALGADHGGYELKEAIKKYLDEKGIAYKDFGTFGTESVDYPDYALKVAEAVASHECSEGILVCGTGIGMSIAANKVPGIRAAHAEDVFSAKAAKEHNNANILCLGGRITGPGLAVMMVEEWLNATFQGGRHQRRIDKIAEIEKKYSK

SEQ ID NO: 1737 - protein, 153 aa, Thermoanaerobacter sp. X514
MMKIILGSDHFGFDLKEVIKEHLQSKGIAVVDIGVYDKNPVDYPDIAVALAERVASGEFERGILICGTGIGMAIVANKVPGVRAAVCHDVYSAERARKSNDAQIMTMGGVIVGPELAKKLVDVWLESEFQGGRSLPKVEKIKMIDAKYRGMAK

SEQ ID NO: 1738 - protein, 150 aa, Caldicellulosiruptor saccharolyticus
MKLKLAIGADHAGFRLKEAVKKHLDKRGIEYKDFGTYSEESCDYPDIARDVAIAVKNGEFDFGILICGTGIGISIAANKIKGIRAALCHDTFSAKAARAHNNANILAMGARVIGEGLACEIVDSFLSAQFEGGRHQRRVDKIHEIENMQD

SEQ ID NO: 1739 - protein, 148 aa, Thermoanaerobacterium thermosaccharolyticum
MIAIGSDHGGYELKEAIKKHLDEKGIEYKDFGTFSEESVDYPDFALKVAEAVASGQFEKGILLCGTGVGISIAANKVPGIRAANVSDAFSARYSKEHNNANVLCMGGRVVGPGLAAILVDEWLNAEFQGGRHQKRLDKITEIEKKYSK

SEQ ID NO: 1740 - protein, 150 aa, Thermoanaerobacterium thermosaccharolyticum
MIISLGCDHGGYELKEIIKKHLEDKNIEYKDFGTHSKESVDYPEYALKVAESIRNGESDLGILCCGTGIGISIAANKVPGIRAAVVGDVFSARACKEHNNANIICLGGRVTGSGLALMIVDEWLNAEFSGGRHQKRIDKITEIEKKYSIK

SEQ ID NO: 1741 - protein, 152 aa, Thermoanaerobacterium thermosaccharolyticum
MIAIGSDHAGFELKEIIKEYLDQRGIEYKDFGTFDKTPTDTADIAQPVAEAVANNECERGILICGTGIGMSIAANKVPKIRAALVENVFSAKSSREHNNANIICLGARVIGSGLALMIIDTWLNTEFKGEDKRIRRINKITNIERKYCNITK

SEQ ID NO: 1742 - protein, 153 aa, Coprothermobacter proteolyticus
MRIVMGADHAGYQLKERLKENLIELGHEVVDKGTNSIESVDYPDYAAEVCTDITKNGGFGILICGTGIGMSITANKFPGIRAALAYDLYAAKKARQHNDANVLCLGGRVLGPDLAMEIVQTFLNTSFEGGRHLRRIRKIEKIEERNLNKGCEA

SEQ ID NO: 1743 - protein, 146 aa, Catenibacterium mitsuokai DSM 15897
MKIAVACDHGGLRLKNVLIDEMKKQGYEVVDYGTYTEDSCDYPDYASKAAKAVASGECEKGVVVCGTGIGVSITCNKVDGIRCALCHDVFSAKATRAHNDTNMIAMGQRVIGEGLAVEILNAWLHTDFEGGRHVKRIEKMMALEKE

SEQ ID NO: 1744 - protein, 151 aa, Erysipelothrix rhusiopathiae
MKIAIAADHGGFETKEGLRLVLEEMGHEVKDFGVYSEESQDYPDFAYPAAKAVAEGLYDRGVVVCGTGVGVSIVANKVRGIRCALVTSTEVAQLTREHNDSNMLALGGRTTPYETNVAILKTWIETPYSEDARHGRRICKISDLETKEGRE

SEQ ID NO: 1745 - protein, 148 aa, Holdemania filiformis DSM 12042
MKIAMACDHGAYKNKEALKAKLIQEGYEVEDFGCFSEESIDYPEVAYPCAKAVADGKADRGIVMCGTGIGVSIVANKVPGIRCAHVHDLETAKLTREHNDSNVLAMGGRIISQELIEQIAEVWLTTPFSNEERHQRRIAQIAELEKHA

SEQ ID NO: 1746 - protein, 151 aa, Clostridium ramosum
MKIGIGNDHVAVEYKNVIREYIEAKYGYEVINYGTDSSERFNYPVSGEAVANAVVNGEVDKGIVICGTGVGISLAANKVNGIRCVTCSEPYSAKLSREHNNTNMLAFGARVVGIELAKMIVDAWLTGEYEGGRHQVRIDMLKEIEERQKSK

SEQ ID NO: 1747 - protein, 150 aa, Clostridium ramosum
MKIGIGNDHVAVEYKNVIREYIEAKYGYEVINYGTDSSERFNYPVSGEAVANAVVNGEVDKGIVICGTGVGISLAANKVNGIRCVTCSEPYSAKLSREHNNTNMLAFGARVVGIELAKMIVDAWLTGEYEGGRHQVRIDMLKDIEVRQCK

SEQ ID NO: 1748 - protein, 147 aa, Clostridium ramosum
MKIAMACDHGGLRLKNVLKDYLEANGYIVEDFGTYSEDSCDYPDYAGKAAKAVASGSCDRGVVVCGTGIGVSITANKVKGIRCALCHDVFSAKATRAHNDTNMIAMGQRVIGEGLALEILTAWLEGKYEGGRHDQRIAKMMAYEGEE

SEQ ID NO: 1749 - protein, 147 aa, Clostridium spiroforme
MKIAVACDHGGFRLKNVLVEYLKDTGYEVEDFGCYNEESCDYPDYAGKAALAVAKGTCDKGIVVCGTGIGVSITANKVKGIRCALCHDVFSAKATRAHNDTNMLAMGQRVIGEGLALEIVKAWLDGQYEGGRHDQRIAKMMAYEGEN

SEQ ID NO: 1750 - protein, 149 aa, Eubacterium biforme
MMKIGMACDHGAYTYKEEIKQMLIDEGHEVVDCGCHDTNSVDYPDMAKACADLVANKEVDKGIVMCGTGIGISIAANKVKGIRCALCTDVTMARLTREHNDANMLSMGQRTTGIETCKDIVHTFLNTPFSEGERHKGRIAKISAIEDAQ

SEQ ID NO: 1751 - protein, 149 aa, Eubacterium dolichum
MIMKIAVACDHGGYDYKEIVKDLLLEMGHEVKDFGCPSTQSVDYTDFAAPCAKAVASKEYDRGIVICGTGIGVSITANKVKGIRCALCSDPVSAQLTRLHNDSNMLAMGARIIGVEMMKEIVRVWVETPFSEDERHIRRIKKISELENE

SEQ ID NO: 1752 - protein, 143 aa, Fusobacterium mortiferum
MKIALGADHGGFELKEKIKSHLLEKGYEVLDLGTNSTASVDYPKFGHAVGHAVVNKDADYGIVVCGTGIGISIAANKVPGVRAALCTNTTMARLTREHNDANVLAMGGRIVGDVLALEMVDIFLSTKFEGGRHTNRINSIETI

SEQ ID NO: 1753 - protein, 149 aa, Fusobacterium nucleatum
MKIALGADHGGYELKEKIKQHLAKKEGIEVIDFGTNSTESVDYPKYGHLVAKSVVDKEVDFGILVCGTGIGISIAANKIKGIRAANCTNTTMAKLTREHNNANILALGARIVGDVLALDIVDEFLSASFEGGRHQKRVDQIEVEECNLF

SEQ ID NO: 1754 - protein, 149 aa, Fusobacterium nucleatum
MKIALGADHAGFELKEKIKEYLLKKGGIEVIDKGTNNKESVDYPKYGHAVANAVVSKEVDFGILVCTTGVGISIAANKIKGVRAALCTDTTTAKLTREHNDANILALGSGIVGQFVALDIVDTFLSTSFEGGRHQKRVDQIEVEGCNLF

SEQ ID NO: 1755 - protein, 149 aa, Fusobacterium nucleatum
MKIALGADHAGFELKEKIKEYLLKKGGIEIIDKGTNSKESVDYPKYGHAVANAVVSKEVDFGILVCTTGVGISIAANKIKGVRAALCTDTTTAKLTREHNDANILALGSGIVGQFVALDIVDTFLSTAFEGGRHKTRVDQIEVEGCNLF

SEQ ID NO: 1756 - protein, 147 aa, Fusobacterium periodonticum
MKIALGADHGGYELKEKIKQHLSKKEGIEVIDFGTNSTESVDYPKYGHLVANSVVNKEVDFGILVCGTGIGISIAANKIKGIRAANCTNTTMAKLTREHNDANILALGARIVGDVLALDIVDEFLAASFEGGRHQKRIDEIETCNLF

SEQ ID NO: 1757 - protein, 147 aa, Fusobacterium sp. 2_1_31
MKIALGADHGGFELKEKIKQHLSKKEGIEVIDFGTNSTESVDYPKYGHLVANSVVNKEVDFGILVCGTGIGISIAANKIKGIRAANCTNTTMAKLTRQHNDANILALGARIVGDVLALDIVDEFLAASFEGGRHQKRIDEIEACNLF

SEQ ID NO: 1758 - protein, 149 aa, Fusobacterium sp. 3_1_33
MKIALGADHGGYELKEKIKQYLSIRKGIELIDFGTNSTESVDYPKYGHLVAKSIIDKEVDYGILVCGTGIGISIAANKIKGIRAANCTNTTMARLSRQHNDANILALGARIVGDVLALDIVDEFLSASFEGGRHQKRVDQIEIEECNLF

SEQ ID NO: 1759 - protein, 147 aa, Fusobacterium sp. 3_1_5R
MKKIGLGADHGGFALKEVIKKHLLEKGYEVEDFGTHSTESVDYPKYGKLVAHAVIDKKVDCGILVCGTGIGISIAANKLSGIRAALCTNVTMAKLTRQHNDANILALGGRIIGDVVALEIVDTFLTTEFEGGRHSRRIESIESCELF

SEQ ID NO: 1760 - protein, 149 aa, Fusobacterium sp. 4_1_13
MKIALGADHAGFELKEKIKEYLLKKGGIEVIDKGTNSKESVDYPKYGHAVANAVVSKEVDFGILVCTTGVGISIAANKIKGVRAALCTDTTTAKLTREHNDANILALGSGIVGQFVALDIVDTFLSTAFEGGRHKTRVDQIEVEGCNLF

SEQ ID NO: 1761 - protein, 149 aa, Fusobacterium sp. 7_1
MKIALGADHGGYELKEKIKQYLAKKGGIEVIDFGTNSIESVDYPKYGHLVAKSIVEKKVDFGILVCGTGIGISIAANKIKGIRAANCTNTTMARLARQHNDANILALGARIVGDVLALDIVDEFLVSSFEGGRHQKRVDQIEIEECNLF

SEQ ID NO: 1762 - protein, 149 aa, Fusobacterium sp. D11
MKIALGADHGGYELKEKIKQYLSMKKGIELIDFGTNSTESVDYPKYGHLVAKSIIDKEVDYGILVCGTGIGISIAANKIKGIRAANCTNTTMARLSRQHNDANILALGARIVGDVLALDIVDEFLSASFEGGRHQKRVDQIEIEECNLF

SEQ ID NO: 1763 - protein, 147 aa, Fusobacterium sp. D12
MKKIGLGADHGGFALKEEIKQHLLEKGYEVEDFGTHSTESVDYPKYGKLVAHAVVDKKVDCGILVCGTGIGISIAANKISGIRAALCTNVTMARLTRQHNDANILALGGRIIGDVVALEIVDTFLETEFEGGRHSRRIESIESCDLF

SEQ ID NO: 1764 - protein, 143 aa, Fusobacterium ulcerans
MKIALGADHGGFELKEKVKTHLIEKGYEVLDLGTNSTDSVDYPEFGHAVGHAVADKKAEFGIVICGTGIGISIAANKVPGVRAALCTNTTMARLTREHNNANILAMGGRIVGDVLALEMVDTFLGTEFQGGRHEKRINKIESI

SEQ ID NO: 1765 - protein, 143 aa, Fusobacterium varium
MKIALGADHGGFELKEKVKTHLIKNGYEVLDLGTNSTDSVDYPEFGHAVGHAVVEKKAEFGIVICGTGIGISIAANKVPGVRAALCTNTTMARLTREHNNANILAMGGRIVGDVLALEMVDVFLATEFQGGRHEKRINKIETI

SEQ ID NO: 1766 - protein, 142 aa, Leptotrichia buccalis DSM 1135
MKIAIGNDHAGVEFKNKLMEELRSKGYEIMNVGTDTLDSVDYPDIAKKVSEKVLNGEAKFGILICGTGIGISIAANKIKGIRAALCHNEYTAKLSRLHNDANIIALGARVLGEDLGLACVEAFVNTEFEGGRHAKRVGKIEL

SEQ ID NO: 1767 - protein, 144 aa, Leptotrichia goodfellowii F0264
MKIAIGNDHAGVDLKHKIVEFLRKKGHEVTNVGTDTLDSVDYPDIAKEVAEKVLSGEAKYGVLICGTGIGISISANKVKGIRAALVHNEFTARLSRLHNDANVIALGARVLGDELAAMCVDTFINTEFEGGRHARRVGKIEEEK

SEQ ID NO: 1768 - protein, 143 aa, Leptotrichia goodfellowii F0264
MKIAIGSDHVGLELKPVIVEYLKELGHEVEDFGAYSKERTDYPIYGEKVAKAVIEGNYDCGIVMCGTGVGISIAANKIKGIRAVVCSEPYSAKLSKEHNNTNILAFGSRVIGSELAKMIVKEWLEAEFEGGRHANRVNMLDNM

SEQ ID NO: 1769 - protein, 142 aa, Leptotrichia hofstadii F0254
MKIAIGNDHAGVEFKNKMMKELRSKGYEIVNVGTDTLDSVDYPDIAKEVGEKVLAGEVDFGILICGTGIGISIAANKIKGIRAALCHNEYTAKLSRLHNDANIIALGARVLGEDLGLACVEAFINTEFEGGRHAKRVGKIEL

SEQ ID NO: 1770 - protein, 149 aa, Sebaldella termitidis
MNIALGCDEAGFDLKQIIAAKLKELGHSIEDYGCYDKNPVLYPDIGRKVAEAIAGGKHERGVLICGTGIGMCITANKIPGVSAAVCHDSFSAVRSRCSNNAQIMCMGARVIGNELAKQLLEIWLSNDFSGGGSTDKVEMINEIEKIYRR

SEQ ID NO: 1771 - protein, 143 aa, Sebaldella termitidis
MKIAIGNDHAGVDLKEKVADFLKGKGYEVENVGTDTKESVDYPDIARKVAKLVNDKECEFGIVICGTGIGISIAANKVPGIRCALCHNSFTAKLSRLHNNSNVLSLGARVIGDELALDIVDAYLTTDFEGGRHARRVDKIEEC

SEQ ID NO: 1772 - protein, 147 aa, Sebaldella termitidis
MKLAIGSDHVGLELKPIIIDYLKELGHEVEDFGPYTAERTDYPVYGKKVAEEVVSGNFDLGILICGTGVGISIAANKVKGIRAVVCSEPYSAKLSREHNNTNILAFGARVIGSELAKMIVKEWLDAEFEGERHANRVKMISEIENER

SEQ ID NO: 1773 - protein, 150 aa, Streptobacillus moniliformis
MKIAIGNDHSGVDFKNQLVDYLLSKGIEVLNVGTDSADSVDYPDIAKEVSKNVLNKNVDFGILICGTGIGISIAANRISGIRAALVTNELCARLSRQHNDANVLVLGARVTGIELAKSCIDAFLSADFEGGRHSGRFSKIECNCGSGVID

SEQ ID NO: 1774 - protein, 160 aa, Gemmatimonas aurantiaca T-27
MAHPGERIPIASDHAGFELKERLRTVLSEMGYSVDDIGTHSTASTDYPDYAHPLSQQVSDGAVQRGVLLCGTGLGMSYVANRYPGVRAAVSWSPEIAALARKHNDANVLVLPARFVSDEDAIAILRTWLETPFEGGRHQGRVAKIEQTNEHGDDTPGSGA

SEQ ID NO: 1775 - protein, 158 aa, Leptospirillum rubarum
MMESSQSRIVIGSDHAGYPLKESLRKRLEKDGYPLLDVGTFSEESVDYPDYAEKVARALHAGEGDIGILLCGTGIGVSIAANKIKGIRAALIYNDETASLAHRHNNANVICFGGREVSEDQAHTWTRLFLSASFEGGRHQRRIDEISALESPGNIGHS

SEQ ID NO: 1776 - protein, 158 aa, Leptospirillum sp. Group II '5-way CG'
MMESSQARIVIGSDHAGYPLKESLRKRLEKDGYPLLDVGTFSEESVDYPDYAEKVARALHAGEGDIGILLCGTGIGVSIAANKIRGIRAALVYNDETASLAHRHNNANVICFGGREISLEQAHTWTRLFLSASFEGGRHQRRIDEISALESPGSTGQS

SEQ ID NO: 1777 - protein, 152 aa, Leptospirillum ferrodiazotrophum
MILYFGSDHAGRELKDILLAHAKSKGISTTDCGTNADLSVDYPDYARKVGEAVMSTPEAYGVLVCGTGIGMSIAANKIRGIRAALVYNEETARLAHQHNNANIIVFGGREMAAKDASSWLDTFLSAAFEGGRHGRRIEKIAEIEQENHGTNP

SEQ ID NO: 1778 - protein, 150 aa, Thermodesulfovibrio yellowstonii
MKIAIGADHAGFELKELISQIVEDAGYEVIDMGTGSSCSVDYPDYAEAVAQAVSDEKAERGILICGTGIGMSIVANKFKNVRAALCNDLFTAKMSRLHNDANILCMGARVIGKGLAIEIVKTWLSTPFEAERHLKRVEKINIIERKVINK

SEQ ID NO: 1779 - protein, 145 aa, Blastopirellula marina DSM 3645
MKIVVASDHAGFHYKQAILEYLQKLGHEAADYGTFSAESCDYPDFIMPAAQAVADGKFERGIVLGGSGNGEAIAANRIRGVRCAYCWSVETAQLGRRHNNANVIAMGERLIELPLALEIVDAWLAGEFEGGRHQRRIEKLDVFEG

SEQ ID NO: 1780 - protein, 153 aa, Blastopirellula marina DSM 3645
MRIAIGSDHRGVGVRHSIIELLKRLGHEVQDVGAFDCGSVDYPDIAATVSQSVAAEEVDRGILICGSGIGMAIVANKVPGVRAATCHDDLTAEMSRRHNNVNVLCLSADMLGERLIDRMVEIWLTTEFEGGRHARRIEKISEFEKRLHEPKSP

SEQ ID NO: 1781 - protein, 151 aa, Gemmata obscuriglobus
MKVAVGNDHRGLCVRPRVLGLLAELGHEVHDLGASGPAGVDYPDYAIPVAEEVAAGKADRGVLICATGHGMCIAANKVHGIRAVNSRDVIDAELSRRHNDSNILCLAADLLGEDQIERIIRAWLLTDFEGGRHTRRREKVDAYEKSHENRT

SEQ ID NO: 1782 - protein, 157 aa, Planctomyces limnophilus
MRIALGCDHGGFPLKAKVAEVVKSCGHEIVDLGTDSSCSVDYPDYGLTGGLAIARREADRAILLCGSGIGISVAANKVPGVRAGVCHDTYSAHQGVEHDDMNVLCLGARIVGEALALEIVQSFLNARYTHEERHARRLAKLLEIERRANSGEWTPAS

SEQ ID NO: 1783 - protein, 153 aa, Planctomyces limnophilus
MMKIAVASDHRGVQIKSKILALVSDLGHQALDFGPQDHESVDYPDYGARVAKAVSRAEVDRGILICGTGMGMCIVANKFRGVRAATCHDDVTAELSRRHNNANVMCLSGDLLGEPFAMRMVEIWLTTEFEGARHARRVDKISHYESEEFSSNS

SEQ ID NO: 1784 - protein, 153 aa, Planctomyces maris
MTSPTPAETPVKSIVIASDHAGYRYKRRIIEYLTKEGYQVEDMGTDSTESVDYPDFIMPAARAVAEGKYTRGIVLGGSGNGEAIAANRIKGVRCAVCWNEKSARLASMHNNANMISIGERMVSLHDVYEIIDIWLSTPFEGGRHARRIEKLDE

SEQ ID NO: 1785 - protein, 151 aa, Planctomyces maris
MKIAVASDHRGFATKAKILTLLNQLGHVAFDYGPEDGESVDYPDYAVKVAKAIGEKAIDRGILICGTGMGMCIVANKFPGVRATPCHDDITAQMSRLHNDSNVLCLSADLLGDRLVNRMIEIWLKEEFEGGRHARRLEKLHKVEEENMPPH

SEQ ID NO: 1786 - protein, 172 aa, Rhodopirellula baltica SH 1
MASLFWLVLSSVPGPMSQNADSVSPIRLAVGGDHAGFALKQLVVERFGSQVTSLIDCGTDDETSCDYPDFAVEVAERINSGEADRGLLICGSGVGVSVAANKITGIRAAICHDTYSARQGVEHDDMNVLCIGGRIIGSELAFEIISSFLNAKYTPEERHQRRLDKILALECD

SEQ ID NO: 1787 - protein, 157 aa, Rhodopirellula baltica SH 1
MTIKVGLASDHRGVHIKARLLQTLQREGFEVCDEGTDSTDPVDYPDFAIRVAEQIRDGRLDRGILICGTGIGMAIVANKFHGVRAASCYDEVIVEMSRRHNDVNVLCLPGDLIGERPVDELVLMWLRTDFECGRHAQRVDKITAIDSIDTPDINRGV

SEQ ID NO: 1788 - protein, 155 aa, Candidatus Kuenenia stuttgartiensis
MCDDKMKIAIGSDHAGLWLKKSFIAHFDKPEYQLIDVGTYSTEPVDYPDYAEAVGRKLLDGSADRGILICCSGVGASVAANKIPGIRAGLCHDTYSAHQGVEHDDMNILVLGACIVGLKLAIELVQSFLGATFNGEERHKRRVGKIQFIEKRYKG

SEQ ID NO: 1789 - protein, 169 aa, Candidatus Kuenenia stuttgartiensis
MENRDNFFVHFFMEDCETTMKIAIASDHRGYDFKERIKVTLKELGHSVTDFGTSSKSESVDYPDFGMKAALSVGHGECDRGILICGTGIGMSLVANKVRGVRATLCHNLYTVEMSRRHNDANVLCIGADIIDEELLEQKVKLWLETPFEGGRHARRLEKIVELENGGGI

SEQ ID NO: 1790 - protein, 148 aa, Caulobacter sp. K31
MRIAIASDHAAIELKAELAEWLTGEGHDVADLGSDGAARVDYPDYGYELAAYIAAGWAERGIALCGSGIGISIAVNRNPACRCALVNDPVSATLGRAHNDANVIALGARLVGLDVAKACVAKFLETEFAGGRHGPRVEKLGLLPAPRC

SEQ ID NO: 1791 - protein, 153 aa, Aurantimonas manganoxydans SI85-9A1
MKLAIAGDSAGAPLAKALAEHLTGKAGLEVSEVSNPPEGAEKFYADLSDRVASGILDGTYHRAILCCGTGIGVCLSANKVPGIRAAQTHDTYSAERAALSNNAQIITMGARVVGSELAKSIAEAYLACEFDPNGRSADNVKAIDALDAKYHGA

SEQ ID NO: 1792 - protein, 151 aa, Brucella abortus
MKVAVAGDSAGEGLAKVLADHLKDRFEVSEISRTDAGADAFYANLSDRVASAVLDGTYDRAILVCGTGIGVCIAANKVPGIRAALTHDTYSAERAALSNNAQIITMGARVIGAEVAKTIADAFLAQTFDENGRSAGNVNAINEVYAKYNKF

SEQ ID NO: 1793 - protein, 164 aa, Brucella abortus
MRHQGSSELRSKIMKVAVAGDSAGEGLAKVLADHLKDRFEVSEISRTDAGADAFYANLSDRVASAVLDGTYDRAILVCGTGIGVCIAANKVPGIRAALTHDTYSAERAALSNNAQIITMGARVIGAEVAKTIADAFLAQTFDENGRSAGNVNAINEVDAKYNKF

SEQ ID NO: 1794 - protein, 151 aa, Brucella melitensis
MKVAVAGDSAGEGLAKVLADHLKDRFEVSEISRTDAGADAFYANLSDRVASAVLDGTYDRAILVCGTGIGVCIAANKVPGIRAALTHDTYSAERAALSNNAQIITMGARVIGAEVAKTIADAFLAQTFDENGRSAGNVNAINEVDAKYNKF

SEQ ID NO: 1795 - protein, 164 aa, Brucella melitensis
MRHQGSSELRSKIMKVAVAGDSAGEGLAKVLADHLKDRFEVSEISRTDAGADAFYANLSDRVASAVLDGTYDRAILVCGTGIGVCIAANKVPGIRAALTHDTYSAERAALSNNAQIITMGARVIGAEVAKTIADAFLAQTFDENGRSAGNVNAINEVDAKYNKC

SEQ ID NO: 1796 - protein, 151 aa, Brucella suis
MKVAVAGDSAGEGLAKVLADHLKDRFEVSEISRTDAGADAFYANLSDRVASAVLDGTYDRAILVCGTGIGVCIAANKVPGIRAALTHDTYSAERAALSNNAQIITMGARVIGAEVAKTIADAFLAQTFDENGRSAGNVNAINEVDAKYNKC

SEQ ID NO: 1797 - protein, 152 aa, Ochrobactrum anthropi
MMKVAVAGDSAGEGLAKVLADHLKDRFEVSEISRTDAGADTFYANLSDRVASAVLDGTYDRAILVCGTGIGVCIAANKVPGIRAALTHDTYSAERAALSNNAQIITMGARVIGSEVAKTIADAFLAETFDENGRSAGNVNAINEVDAKYNKG

SEQ ID NO: 1798 - protein, 151 aa, Ochrobactrum intermedium LMG 3301
MKVAVAGDSAGEGLAKVLADYLKDRFEVSEISRTDAGADAFYANLSDRVASAVLDGTYDRAILVCGTGIGVCIAANKVPGIRAALTHDTYSAERAALSNNAQIITMGARVIGSEVAKTIADAFLAQTFDENGRSAGNVNAINEVDAKYNKG

SEQ ID NO: 1799 - protein, 151 aa, Ochrobactrum intermedium LMG 3301
MNIVVGSDHAGFPLKADVIEVLKELGHQVEDIGSFTPDPVDFPDIAGLLCKKVRDGSAERGILVCGTGVGAAIAANKINGIRAAVCHDVHSAHQSVEHDDVNVMCIGAKIVGSWLARDLVLSYLNARFDRNEDFVRRVEKLSALENAQSVA

SEQ ID NO: 1800 - protein, 148 aa, Methylobacterium sp. 4-46
MRLVIGSDHAGWMLKGAVIDHVRSLGHELIDVGSFDEHPVDFPDIAREVARKVTSGEADRGLMVCGTGVGASIAANKMKGIRAAVCHDVHSAHQCVEHDDVNVMCIGAQIVGPWLAKDLIAAYLTAEFSTDADFRRRVEKLHAMDAEG

SEQ ID NO: 1801 - protein, 148 aa, Mesorhizobium sp. BNC1
MKIIIGSDHAGYPLKADIISHIESLGHEVIDVGCHSTDPVDFPDIAQDLTDKLLKGEGDRGLMVCGTGVGAAIAANKRAGIRAAVGHDVYSAHQCVEHDDVNVLCIGAQIVGAWLARDLVSAYLSAEFSTSEEFRRRVEKLNEMDGRR

SEQ ID NO: 1802 - protein, 146 aa, Mesorhizobium opportunistum WSM2075
MKIAIGADSAGKPLLDVIAAHLATKPGLTVSDLSQAGYYADLSQKLAQTIVDGDNDRGILFCGTGIGVSISANKVPGIRAALTHDTYSAERAAKSNNAQIITMGARVIGPELAKAIVDTWLASEFDEKGPSAGNVQAINRLDTAKA

SEQ ID NO: 1803 - protein, 151 aa, Agrobacterium radiobacter
MKLAIAGDSAGEGLAKVLADHLKDRYDVSEVSRTDAGPDAFYANLADRVASGVIDGTYDKAILVCGTGIGVSISANKVPGIRAALTHDTYSAERAALSNNAQIITMGARVIGTELAKAIADAFLARTFDTNGRSAGNVQAIDEVDAKYNAR

SEQ ID NO: 1804 - protein, 148 aa, Rhizobium etli
MKIAIGADSAGKPLLDVIAAHLAGKADLEVHDLSQSGFYADLSQRLAQTIVDGEHERGILFCGTGIGVCISANKVPGIRAALTHDTYSAERAAKSNNAQIITMGARVIGPELAKSIVDVWLASEFDPDGPSAGNVQAIDRLDAEKHGA

SEQ ID NO: 1805 - protein, 148 aa, Rhizobium etli
MKIAIGADSAGKPLLDVIAAHLAGKADLEVHDLSQSGFYADLSQRLAQTIVDGEHERGILFCGTGIGVCISANKVPGIRAALTHDTYSAERAVKSNNAQIITMGARVIGPELAKSIVDVWLASKFDPDGPSAGNVQAIDRLDAEKHGA

SEQ ID NO: 1806 - protein, 149 aa, Rhizobium etli
MTASNRIVLSSDHAAVELRQAIAAHIAARGWTVVDIGPMTAESTPYPKNGEAAARLVASGDCRFGIILCGTGQGIMMAANKVKGIRCGVCSDTFSARMIRQHNDANMLSIGVRVVGQGLALDIVDAFLSAQFEGGRHATRVEMIEALES

SEQ ID NO: 1807 - protein, 149 aa, Rhizobium leguminosarum
MTATNRIALSSDHAAIQLRQAIAGHIAAQGWVAVDIGPTTPESTHYPKHGEAAARLVASGDCRFGIILCGTGQGIMMAANKVKGIRCGVCVDTFSARMIRQHNDANMLSIGVRVVGEGLALDIVDAFLTAQFEGGRHATRVGMIEALEG

SEQ ID NO: 1808 - protein, 148 aa, Rhizobium leguminosarum
MKIAIGADSAGKPLLDVIAAHLAGKADLEVHDLSQSGFYADLSQRLAQTIVDGEHQRGILFCGTGIGVCISANKVPGIRAALTHDTYSAERAAKSNNAQIITMGARVIGPELAKSIVDVWLASEFDPDGPSAGNVEAIDRLDAQKHGS

SEQ ID NO: 1809 - protein, 151 aa, Rhizobium leguminosarum
MKLAIAGDSAGEGLAKVLADHLKERFDVYEVSRTSAGADPFYANLSDRVASGVIDGTYDKAILVCGTGIGVCISANKVPGIRAALTHDTYSAERAALSNNAQIITMGARVIGTELAKSIADAFLAQTFDENGRSAGNVKAMDDLDAKYSAR

SEQ ID NO: 1810 - protein, 149 aa, Rhizobium leguminosarum
MPATNRIALSSDHAAIQLRQAIAGHVVAQGWIAVDIGPTTPESTHYPQHGEAAARLVASGDCRFGIILCGTGQGIMMAANKVRGIRCGVCADPFSARMIRQHNDANMLSIGVRVVGEGLALDIVDAFLTARFEGGRHATRVGMIEALEV

SEQ ID NO: 1811 - protein, 157 aa, Rhizobium sp. NGR234
MKVAIAGDSAGEGLAKVLAEHLKGRFDVYEVSRTEAGPDRFYANLSERVASGVLDGTYDKAILVCGTGIGVCIAANKVPGIRAALTHDTYSAERAALSNNAQIITLGARVIGPEHAKSIAETFLGKTFDEGGQSAGNVRAINDLDSKYHPRAPSSSR

SEQ ID NO: 1812 - protein, 145 aa, Rhizobium sp. NGR234
MKIAIGADSAGKPLLDVIAAHLAGRSDVEVKDLSQAGFYADLSEHLAKTITAGENDRGILICGTGIGVCISANKVPGIRAALTHDTYSAERAAKSNNAQIITMGARVIGPELAKSIVDTWLAAEFDPYGPSAGNVQAIDRLDAGK

SEQ ID NO: 1813 - protein, 145 aa, Sinorhizobium medicae WSM419
MKIAIGADSAGKPLLDVIAAHLATKSGLEVKDLSQSGYYADLSRDLAQTITAGENERGILICGTGIGVCISANKVPGIRAALTHDTYSAERAAKSNNAQIITMGARVIGPELAKSIVDTWLASEFDPNGPSAANVDAIDRLDAVK

SEQ ID NO: 1814 - protein, 148 aa, Sinorhizobium medicae WSM419
MRIVIGSDHAGFPLKATIIDHIVSLGHEVHDAGSYDPSPVDFPDIAKTVTSSIIDGKADRGLMVCGTGVGASIAANKVKGIRAAVCHDVHSAHQSVEHDDVNVMCIGAQIVGAWLAKDLVAAYLAAEFSTDEDFRRRVRKLAEMDEQR

SEQ ID NO: 1815 - protein, 145 aa, Sinorhizobium meliloti
MKIAIGADSAGKPLLDVIAAHLAKRSDLEVKDLSQTGYYADLSRDLAQTITAGENERGILICGTGIGVCISANKVPGIRAALTHDTYSAERAAKSNNAQIITMGARVIGPELAKSIVDTWLASEFDPNGPSAANVEAIDRLDQAK

SEQ ID NO: 1816 - protein, 148 aa, Sinorhizobium meliloti
MRIVIGSDHAGFHLKATIIDHVTSLGHEVYDAGSYDANPVDFPDIAKMVTSSIIEGKADRGLMVCGTGVGASIAANKVKGIRAAVCHDVHSAHQSVEHDDVNVMCIGAQIVGAWLARDLVAAYLAAEFSTDEDFRRRVRKLAEMDEQR

SEQ ID NO: 1817 - protein, 149 aa, Oceanibulbus indolifex HEL-45
MTAKPRIIISSDHADIALRQDIARHVADRGYEVEDIGPTTAESTDYPKHGEAAARRIAAGEFDLGILICGTGQGIMMAANKVKGIRCGVCADTFSAKMIRAHNDANMLSMGARVIGGGLALEIVDAFLDTEFEGGRHGRRVDMITAIED

SEQ ID NO: 1818 - protein, 151 aa, Octadecabacter antarcticus 238
MKIAIAGDTAGEGLAKTLADHLKATHDVTDLSRVQGEADQFYASLSDRVASAVMDGEFDRAILVCGTGIGVQIAANKVSGIRAAQCHDTYSATKAATSNNAHIITMGARVIGVELAKDIAEAFLNASFDPQGRSAGNVDAIDAVDSKYSRS

SEQ ID NO: 1819 - protein, 151 aa, Phaeobacter gallaeciensis 2.10
MDQKKPTRVVLSSDHAAIELRQAIADHIAANGWEVVDIGPTTPESTHYPKHGAAAAERVASGDCDLGIILCGTGQGIMMAANKVKGVRCGVCSETFSAKMIRQHNNANMLSIGARVVGDSLAIEIVDAFLNAEFEGGRHATRVDMIEPQDS

SEQ ID NO: 1820 - protein, 151 aa, Phaeobacter gallaeciensis BS107
MDQKKPTRVVLSSDHAAIELRQAIADHITANGWEVVDIGPTTPESTHYPKHGAAAAERVASGDCDLGIILCGTGQGIMMAANKVKGIRCGVCSDTFSAKMIRQHNNANMLSIGARVVGDSLAIEIVDAFLNAEFEGGRHATRVDMIEPQDS

SEQ ID NO: 1821 - protein, 152 aa, Rhodobacter sp. SW2
MKLAIAGDSVGFGLAHLLAEHLKGRFDVAEVTETASGPDPFYATLADRVASGVASGLYDRAILICGTGIGVSIAANKVPGIRAALCHDTYSAERAALSNNAQIITMGARVIGTELAKAIAEAFLAQSFDPAGKSASNVAALDAVDAKYHKPR

SEQ ID NO: 1822 - protein, 151 aa, Roseobacter denitrificans
MKIAVAGDSAGEGLAKTLAEHLGAHHDVVEMSRTQDGPDAFYADLSNRVARAVIAGEVERAILVCGTGIGVCLSANKVPGIRAAQCHDTYSAGKAATSNNAQIITLGARVVGAELAKDIVDAYLSSHFDPEGRSAGNVQAIDRLDAAYNKA

SEQ ID NO: 1823 - protein, 151 aa, Roseobacter litoralis
MKIAVAGDSAGEGLAKTLAEHLGAHHDVVEMSRTQDGPDAFYADLSNRVAHAVIAGEVERAILVCGTGIGVCLSANKVPGIRAAQCHDTYSAGKAATSNNAQIITLGARVVGAELAKDIVDAYLSSHFDPEGHSAGNVQAINRLDAAYNKA

SEQ ID NO: 1824 - protein, 148 aa, Roseobacter sp. CCS2
MTNKRVVLSSDHAAIEMRQQIADHITAKGWEAVDIGPTTPESTPYPAHGEAAARRVASSDCTFGIILCGTGQGIMMAANKVKGIRCGVCSDVFSAQMIREHNDANMLAMGARVIDNATALKIVDAFLFTDFGGGRHATRVDMIKALED

SEQ ID NO: 1825 - protein, 149 aa, Roseobacter sp. MED193
MTASKRVVLSSDHADIQLRQTIAEHIANQGWEVLDLGPTTSESTDYPKHGREAAERVAAGDCDLGIIVCGTGQGIMMAANKVKGIRCGVCADTFSARMIRQHNDANMLSIGARVVGKGLALDIVDAFLSAEFEGGRHATRMEMIEPAED

SEQ ID NO: 1826 - protein, 149 aa, Roseobacter sp. SK209-2-6
MTTSKRIVISSDHADIPLRQAIAEHVAAKGWEVTDIGPVTAESTHYPKHGKEAAERVASGECQFGIIVCGTGQGIMMAANKVKGIRCGVCSDTFSARMIREHNDANMLSIGARVVGKGLAFDIVDAFLDAKFEGGRHATRVDMIEPAED

SEQ ID NO: 1827 - protein, 149 aa, Roseovarius nubinhibens ISM
MSTEKRIVLSSDHAAIELRQAVAEHAKSLGWEVEDIGPISPESTHYPKHGKAAARKVASGDCALGIILCGTGQGIMMAANKVKGIRCGVASDTFSAKMIRQHNDANMLSIGARVVGEGLALEIVEAFLGAEFEGGRHGTRVDMIKAIEG

SEQ ID NO: 1828 - protein, 153 aa, Roseovarius sp. HTCC2601
MKIAVAGDSAGEPLAIALAEYLAQNPGYEVAEISRTEAGPDDFYANLSDRVATQVLDGTYDKAILCCGTGIGVCLAANKVPGIRAAQTHDTYSAGKAATSNNAHIITMGARVVGVELAKDIADAFLSSSFDPEGKSAGNVRAIDAVDAKYHTA

SEQ ID NO: 1829 - protein, 149 aa, Ruegeria pomeroyi DSS-3
MTASKRIVLSSDHAAIDLRRAVADHISAQGWEVVDIGPQTTESTHYPKHGRAAAERVASGDCSLGIILCGTGQGIMMAANKVAGIRCGVCFDTFSARMIRMHNDANMLSLGARVVGEGLALDIVDAFLSAEFEGGRHATRVDMIETPEG

SEQ ID NO: 1830 - protein, 147 aa, Ruegeria sp. R11
MTTSKRIVLSSDHAAIPLRQAVADHIAQQGWEVVDIGPTTPESTHYPIHGAAAAERVASGDCDLGIILCGTGQGIMMAANKVKGIRCGVCSDTFSAAMIRQHNNANMLSIGARVVGEGLALEIVDAFLGAEFEGGRHATRVDMIEAN

SEQ ID NO: 1831 - protein, 149 aa, Ruegeria sp. TM1040
MTASKRIVLSSDHAAIALRRTIAKHIEALGYTVTDLGPTTPESTHYPKHGEAAARHVAAGESDLGILLCGTGQGIMMAANKVKGIRCGVCSDTFSAQMIRAHNDANMLSIGARVVGEGLALEIVDAFLKTEFEGGRHGTRVDMITEIEG

SEQ ID NO: 1832 - protein, 149 aa, Silicibacter sp. TrichCH4B
MTASKRIVLSSDHAAIELRQTIAKHIEARGYSVTDLGPTTPESTHYPKHGEAAARHVAAGESDLGVLLCGTGQGIMMAANKVKGVRCGVCSDTFSAQMIRAHNDANMLSIGARVVGEGLALEIVDAFLNTEFEGGRHGTRVDMISAIEG

SEQ ID NO: 1833 - protein, 144 aa, Thalassiobium sp. R2A62
MATRIVLSSDHAALDLRPKIAAHIQALGYEVVDIGPTTSESTHYPKHGQAAAERVASGDCELGIILCGTGQGIMMAANKVPGIRCGVCMDTFSARMIREHNNANMLSMGVRVVGEGLALDIVDAFLNAKFEGGRHATRVDMIEG

SEQ ID NO: 1834 - protein, 149 aa, Rhodobacteraceae bacterium KLH11
MTIAKRIVLSSDHAAIELRKAVADHVTAQGWEVVDIGPTTPESTHYPIHGKAAAEAVASGRCQLGVILCGTGQGIMMAANKVPGIRCGVCSDTFSARMIRQHNDANMLALGARVVGEGQALDIVDAFLTAEFEGGRHATRVDMIEADNS

SEQ ID NO: 1835 - protein, 147 aa, Rhodobacterales bacterium HTCC2083
MTNLKRIVLSSDHSAIELRQTIAQHIAGQGWDVLDIGPTTTESTHYPTHGQAAAERVVSGECALGIILCGTGQGIMMAANKVTGIRCGVCSDTFSAQMIRAHNDANILSLGARVLGAGLALEIVDAFLSTEFEGGRHATRVDMIEPA

SEQ ID NO: 1836 - protein, 146 aa, Rhodobacterales bacterium HTCC2654
MTQNKRIVLSSDHAAIELRQTIAKHIEAEGWEAVDIGPTTPESTHYPLHGQAAAQKVASGECALGIILCGTGQGIMMAANKVAGIRCGVCSDTFSARMIRQHNDANILSLGARVVGEGLALDIVDAFLNAEFEGGRHATRVEMIEG

SEQ ID NO: 1837 - protein, 150 aa, Acidiphilium cryptum
MSENMTLVVGADHAGFELKDRLAEAARAAGWAVIDCGTNSAASVDYPDIAHEVSMRIEAGSARFGLLVCGSGIGMAIAANRHTGVRCAQAHDATEARLSRMHNNANILALGARLTGEMVALDALNAFLTTEFEGGRHEKRLAKLTPEPKT

SEQ ID NO: 1838 - protein, 160 aa, Gluconobacter oxydans
MRIAIGGDSAGEGLARLLVEHLSTLGRHVVVDMSHPEDERAELYSELSERVALAVLHGEFDRGILCCGTGIGVCISANKIPGIRAALTHDTYSAERAALSNNAHIITMGSRVIGSEVAKSIAEAWLACTFDPRSASARNVAGIDALGKKYRQQAPVGASC

SEQ ID NO: 1839 - protein, 149 aa, Magnetospirillum gryphiswaldense
MTKDIIALASDHGGLEMKAMVAALLQEKGFGVLDLGAHDGQSVDYPDFAVAMAQALKDGRATRGVLMCGSGIGISIAANRFAHVRAALVHDSYGARMCRLHNDANVLVLGGRTTGPEVAKECIEIFLATPFEGGRHARRVAKLAENGQA

SEQ ID NO: 1840 - protein, 150 aa, Magnetospirillum magneticum AMB-1
MMSTKIMAIACDHGGIELKELLAKDLAASGWSVLDLGTNGPESVDYPDFAVTLADALKSGKAERGVLLCGTGIGISIAANRFPHVRAALVHDAFGARMCRQHNDANVLVMGGRTTGPEVARDCLKIFIETEFEGGRHARRVSKLSGNGPA

SEQ ID NO: 1841 - protein, 131 aa, Magnetospirillum magnetotacticum
  misc_feature (107)..(107): Xaa can be any naturally occurring amino acid
MRVHIAADHAGYELKTHLVEHLGAAGHDVVDHGAHTYDAQDDYPSFCFAAGEAVAAEPGSLGVVIGGSGNGEQIAANKVVGVRAALAWNLETARLGRQHNDANVVRXWARASTRWTRRSRSSTRSSRSRSA

SEQ ID NO: 1842 - protein, 142 aa, Magnetospirillum magnetotacticum
MAIACDHGGVDLKDVLIKDLAASGWTVLDLGTDGPESVDYPDFAVKLAQALKDGKAERGVLLCGTGIGISIAANRFDHIRAALVHDAFGARMCRQHNDANVLVMGGRTIGPEVARDCLKIFTETEFEGGRHARRVSKLSANG

SEQ ID NO: 1843 - protein, 144 aa, Rhodospirillum centenum
MTAETIAIASDHAGYDLKASLKEMLEGEGRAVLDLGTDGRESVDYPDFADVIAAALKDGRAQRGILICGTGIGISIAANRHRHVRAALCHDITTARLSRQHNDANVLVLGARTTGIEVARDCAATFLATPYEGGRHARRVAKLG

SEQ ID NO: 1844 - protein, 148 aa, Rhodospirillum rubrum
MKIAIGCDEAAYDLKETLTSFITAQGHEVTDFGTFDRKPVLYPDIAHALATEVAAGTQDRGVLLCGTGIGMAITANKVKGIRAAQCHDTYSAERARLSNDAQIITMGARVIGPELAKAIVRTFLSNEFVNGSSTPKIERITAYENSPG

SEQ ID NO: 1845 - protein, 158 aa, Rhodospirillum rubrum
MAETAKPKIVVGADHLGRELKDLLRDHLTAQGYEVCDMGTATSDPVDYPDVALPVAQAIAKGDFDRGILVCGTGAGVCVSANKVPGVIAVQVSDPYTAERARASNNAQIITFGALTIGPATAKALTDIFMAAEFQGGGSAKKVQKMLDIDQHYKKLAS

SEQ ID NO: 1846 - protein, 162 aa, Rhodospirillum rubrum
MTDREDSSIVPDHSRAEATIALASDHGGVELKALLVDHLRATGHDVLDLGTQGPESVDYPDIANTLAQALRAGRAGRGVLICGTGIGISIAINRHADMRGALVHDAFGARLARQHNDANVLVLGGRTTGPEIAKDCADIFLSTPFEGGRHARRVAKLGTPSA

SEQ ID NO: 1847 - protein, 150 aa, Anaplasma centrale
MLVVDRVFVSSDHAGVQLRLLLGAYLEGLGCSVADCGCDVSDDAVDYPDYVPGVVDYVSDTSFGVLICGTGIGMSIAANRSRWVRAALCHDSLFARLAREHNDANVLCFGSRYIDPDVAKSVLYTFLTTKFLGGRHSARVKKLGEVGSCS

SEQ ID NO: 1848 - protein, 146 aa, Anaplasma marginale
MLVVDRVFVASDHAGVQLRLLLGAYLGDLGCEVADCGCDVGDDAADYPDCVPGVVDCVSDTSFGVLICGTGIGMSIAANRNKWIRAALCHDPTFARLAREHNDANVLCFGARYVEPDVAKSVLYTFLTTRFLGGRHAARVKKLGSG

SEQ ID NO: 1849 - protein, 144 aa, Anaplasma marginale
MVDRVFVASDHAGVQLRLLLGAYLGDLGCEVADCGCDVGDDAADYPDCVPGVVDCVSDTSFGVLICGTGIGMSIAANRNKWIRAALCHDPTFARLAREHNDANVLCFGARYVEPDVAKSVLYTFLTTRFLGGRHAARVKKLGSG

SEQ ID NO: 1850 - protein, 146 aa, Anaplasma marginale
MLVVDRVFVASDHAGVQLRLLLGAYLGDLGCEVADCGCDVGDDAADYPDCVPGVVDCVSDTSFGVLICGTGIGMSIAANRNKWIRAALCHDPTFARLAREHNDANVLCFGARYVEPDVAKSVLYTFLTTKFLGGRHAARVKKLGSG

SEQ ID NO: 1851 - protein, 143 aa, Anaplasma phagocytophilum HZ
MVKRVFLSSDHAGVELRLFLSAYLRDLGCEVFDCGCDPKEHSVDYPDYVHDVVREVSDTSFGVLICGTGIGMSIAANRHKNIRAALCSSTMLAKLSREHNDANVLCFGSRYIDPDTAQSVLYTFMTTAFLGGRHAVRVQKLGE

SEQ ID NO: 1852 - protein, 149 aa, Ehrlichia canis
MLVMQKVFISSDHAGVELRLVIKLYLNNLGYIVEDYGCVESGVPVDYPDYVQNVVDCVINDSLAFGILICGTGIGMSIVANRHRKIRAALCYNVEVARLAREHNDANVLCLGARHISYEDAQSIVYNFLTTKFSEGRHVQRIIKIDNCL

SEQ ID NO: 1853 - protein, 148 aa, Ehrlichia chaffeensis
MLTMQKIFISSDHAGIELRLVIKLYLSNLGYVVEDYGCMESSIAVDYPDYVQNVVDCVINTLGFGILICGTGIGMSIVANRHRKIRAALCYNVEVAKLAREHNNANVLCLGARYINHGEAQSIVYQFITTKFSEGRHVQRIAKIDNCL

SEQ ID NO: 1854 - protein, 146 aa, Ehrlichia ruminantium str. Welgevonden
MQKIFISSDHAGVELRLFIKLYLESLSYTVEDYGCVISDVIVDYPDYVQDVVHCVTSNDSGFGILICGTGIGMSIAANRYKKVRAALCYTTELARFAREHNNANVLCLGARYITYEKAKLIVYKFLNTKFAEGRHTQRIEKIDSYL

SEQ ID NO: 1855 - protein, 148 aa, Ehrlichia ruminantium str. Welgevonden
MNMQKIFISSDHAGVELRLFIKLYLESLSYTVEDYGCVISDVIVDYPDYVQDVVHCVTSNDSGFGILICGTGIGMSIAANRYKKVRAALCYTTELARFAREHNNANVLCLGARYITYEKAKLIVYKFLNTKFAEGRHTQRIEKIDSYL

SEQ ID NO: 1856 - protein, 146 aa, Neorickettsia risticii str. Illinois
MRVSIGADHAGFALKAVLIDFFKARGCSPVDRGAYCSDVSDYPDFAKSVSLDVLDGRVDFGILICGSGIGMSITANRYKKIRAALCYDVRAAKMAREHNDANVLCLAGRALTVSRCLEIVEVFVSSEFSCEERHKKRIEKIDVGGE

SEQ ID NO: 1857 - protein, 152 aa, Neorickettsia sennetsu str. Miyayama
MNVRVSIGADHAGFALKAVLIDFFRARGCLPVDRGAYCLDVSDYPDFAKSVSLDVSDGRVDFGILICGSGIGMSITANRYKKVRAALCYDVRAAKMAREHNDANVLCLAGRDLTVSRCLEIVEAFVSSKFSCEERHKKRIEKIDEGGGNSVF

SEQ ID NO: 1858 - protein, 160 aa, Orientia tsutsugamushi str. Boryong
MKVFLLPRFFFMVSSNIIAIASDQKEYELKTKICQHLSEQERFISFSVLDLGGNNNQQVDYPDIANLLCDTIINNRARYGILICTTGIGMSIAANRHSDIRAALCFNEYMAEQSRLHNNANILIIGAKVSNFRSVINMISKFITTKFEGGRHLTRLEKLR

SEQ ID NO: 1859 - protein, 149 aa, Orientia tsutsugamushi str. Ikeda
MVSSNIIAIASDQKEYELKTKICQHLSEQERFISFSVLDLGGNNNQQVDYPDIANLLCDTIINNRAKYGILICTTGIGMSIAANRHSDIRAALCFNEYMAEQSRLHNNANILIIGAKVSNFRSVINMISKFITTKFEGGRHLTRLEKLR

SEQ ID NO: 1860 - protein, 148 aa, unknown
  alpha proteobacterium HIMB114
MSKTFITKKIFISSDHAGYDLKKYLINQISKKKIKIIDLGPFSKDSVDYPDFAKKLSKKITNINFGILVCGTGIGMSIMANRYRKVRASLVFNSKTAKLAREHNNANVLVLGSRVTNKKNALKITEVFFKTKFLKGRHLRRVKKFNNV

SEQ ID NO: 1861 - protein, 141 aa, Candidatus Pelagibacter sp. HTCC7211
MRKIFIASDHAGFDLKEVIKEYLSKKKLAFQDLGPDNDKSVDYPIYAHNVAKKVKVNKNNVGILICGSGTGMNITANKHKNIRAAQCFNLKSTKLSRLHNDANIITLGSRLITKKNALNFIGIFLKTKFEGGRHSKRIRKI

SEQ ID NO: 1862 - protein, 141 aa, Candidatus Pelagibacter ubique HTCC1062
MKKIFLSSDHAGYKLKELIKLHLDKKKINYTDLGPFNSESVDYPDYAHKVAKKVKTNNNHAGILVCGSGMGMNIAANRHKNIRAAQCFNLKSTKLSRLHNNANIITLGSRLLTKKTAINCVSVFLNTKFEGGRHAKRIKKI

SEQ ID NO: 1863 - protein, 148 aa, Erythrobacter litoralis
MATRMKIAIASDHAAVELKAELRDWLIEQGHEVADLGPDTTDSVDYPDFGYKLAGVVADGTAERGVALCGSGIGISMSVNRNPAVRCALVGEPLSAALSREHNDANVIAMGARLTGSDMAKACLTAFLETEFGGGRHQRRVDKLSNPN

SEQ ID NO: 1864 - protein, 159 aa, Erythrobacter sp. NAP1
MRIAIASDHAATDLKASLAEWLMDEGHEVADLGPEEGESVDYPDYGYKLAEVVADGTAQFGIALCGSGIGISISVNRHPALRCALVSEPLSAALAREHNNANCIALGARLIGIEMAKSCVATFLNTEFADEGDPAGRHQRRVAKLGNPPTSPDHIETHQ

SEQ ID NO: 1865 - protein, 149 aa, Erythrobacter sp. SD-21
MGAAMRIALASDHAAIELKAALRDWLIEQGHEVADLGPETNESVDYPDFGYKLAGVVADGTAERGIALCGSGIGISMSVNRNPGVRCALVSEPLSAALAREHNDANCIALGARLTAVDMAKACVTAFLETEFAGGRHQRRVDKLCNPSL

SEQ ID NO: 1866 - protein, 145 aa, Novosphingobium aromaticivorans DSM 12444
MRIAIASDHAAVDLKSTLREYLIDLGHEVADLGPETADRVDYPDYGYKLASVVAEGIADFGVALCGSGIGISIAVNRNPACRCALVSEPLSAALAREHNDANVIAMGARLTGEDMAKACLDAFLSTEFGGGRHAGRVEKLSNPAI

SEQ ID NO: 1867 - protein, 145 aa, Sphingomonas sp. SKA58
MNIAIASDHAAVELKAELAQWLRAEGHLVEDLGPATADRVDYPDYGYKLATAIASGAADRGIALCGSGIGISIAVNRNPACRCALVGEPLSAALSREHNDANVLAMGARLTGVDMAKACVTAFLTTEFGGGRHAGRVDKLSQPAL

SEQ ID NO: 1868 - protein, 152 aa, Sphingomonas wittichii RW1
MAETIAIASDHAAFDMKAALTEWLRAEGHEVLDLGPDSAASVDYPDYGYRLAEAIAAGEAARGIALCGSGIGISISVNRHPAARCALVNEVLSARLCREHNDANVIALGARLIGIEQAKACVSAFLSTGFAGDRHQRRVDKLSHPRFHKEHA

SEQ ID NO: 1869 - protein, 150 aa, Sphingopyxis alaskensis RB2256
MRIAIAADHAAYELKALLADWLREKGHEVEDLGTNGPDSVDYPDYGYRLGGAIADGRADRGVALCGSGIGISISVNRNPAARCALVSEPLSAKLAREHNDANVIAMGARLTGIDMAKACLDAFLTTDFAGDRHARRVDKLSNPPQLETSR

SEQ ID NO: 1870 - protein, 157 aa, Zymomonas mobilis
MTSAVPSNTKKKLVIASDHAAFELKSTLITWLKELGHEVEDLGPHENHSVDYPDYGYKLAVAIAEKTADFGIALCGSGIGISIAVNRHPAARCALITDNLTARLAREHNNANVIAMGARLIGIETAKDCISAFLATPFGGERHVRRIDKLSNPQFNI

SEQ ID NO: 1871 - protein, 153 aa, unknown
  alpha proteobacterium BAL199
MSDDVIALASDHAGLALKTTLIDELKRLGHVVVDLGTHSGASVDYPDYGYRIAAALADGKADRGVAICGSGIGICIAANRFAWVRAVNCHDVTSARLSREHNDANVIAFGERVIGVEVAKEALRVFLQTPFAGDRHVARVNKLGAPPKIPSVS

SEQ ID NO: 1872 - protein, 164 aa, Burkholderia mallei
MKVAIGCDEAAYALKESIKRHLRATHPELELVDFGTHSADEAVLYPDIAIEVAQRVAAGEFPRAILLCGTGIGVAISANKVPGIRAAQCHDTYSAERARRSNDAQIVTMGARVIGTELANSIVDAWLRAEFDGGRSQPKVQRIADYERRAGLTQAGPNDAHRGS

SEQ ID NO: 1873 - protein, 164 aa, Burkholderia oklahomensis EO147
MKVAIGCDEAAYALKESIKRHLRATHPEVELLDFGTHSADEAVLYPDIAIEVAQRVAAGEFPRAILLCGTGIGVAISANKVPGIRAAQCHDTYSAERARRSNDAQILTMGARVIGTELANSIVDAWLRAEFDGGRSQPKVQRIADYERRTGLTQAGPNDAHCGS

SEQ ID NO: 1874 - protein, 162 aa, Burkholderia pseudomallei
MAIGCDEAAYALKESIKRHLRATHPELELVDFGTHSADEAVLYPDIAIEVAQRVAAGEFPRAILLCGTGIGVAISANKVPGIRAAQCHDTYSAERARRSNDAQIVTMGARVIGTELANSIVDAWLRAEFDGGRSQPKVQRIADYERRAGLTQAGPNDAHRGS

SEQ ID NO: 1875 - protein, 164 aa, Burkholderia thailandensis MSMB43
MKVAIGCDEAAYALKESIKRHLRAAHPEVELTDFGTHSADEAVLYPDIAIEVAQRVATGEFARAILLCGTGIGVAISANKVPGIRAAQCHDTYSAERARRSNDAQIITMGARVIGTELANSIVDAWLRAEFDGGRSQPKVQRIADYERRAGLTQAGPNDAHCGS

SEQ ID NO: 1876 - protein, 162 aa, Burkholderia thailandensis MSMB43
MRQAMKLAIGCDEAAFELKEIIKQHLLKLGVDVTDFGTYEAEPVHYPNIAFAVAEKVAAGEYERAVLLCGTGIGMAIAANKVRSIRAAQCHDTYSADRASKSNDAQIITIGARVVGPELAKAIVDKWLGAHFDGGRSIPKVNLIREYEDNHQENRNNPNACV

SEQ ID NO: 1877 - protein, 157 aa, Delftia acidovorans SPH-1
MKLAIGCDEAACDLKNAVKQHLLAQGHEVADFGTHDGEPVLYPDIGIAVAQAIVQGRHERGVLLCGTGIGMAIAANKVAGIRAAQAHDTYSAERASRSNDAQIITLGSRVIGVELAKAIVDRFLASRFDGGSSALKVDAITGFERSQAAAAGRGQGA

SEQ ID NO: 1878 - protein, 149 aa, Polaromonas sp. JS666
MKLAIGCDEAAYDLKQTLKKHMIDAGHEVTDFGTHDAQPVLYPDVAFAVAEQVAGGAYERALLLCGTGIGMAISANKVKGVRAAQCHDTYSAERASRSNDAQIITIGARVVGPELAKSIVDAWLRSGFDGGRSQPKVDLIQAYEAGHSL

SEQ ID NO: 1879 - protein, 159 aa, Verminephrobacter eiseniae EF01-2
MKTPMKIAIGCDEAANAMKDCLKAALLAQGHQVTDFGTHDHQPVLYPDIGIAVAQAIARGQAERGLLLCGTGIGMAIAANKVPGIRAAQAHDTYSAERAALSNDAHIITIGARVIGIELAKSIVQTFLAAQYVAGPRSQPKLDALAAHEQRLRQAGDSG

SEQ ID NO: 1880 - protein, 149 aa, Leptothrix cholodnii
MKIAIGCDEAACQMKDAIKAELAAQGHEVQDYGTHDNAPVLYPDIGVALAEGVARGEAQRGLLFCGTGIGMAISANKVPGIRAAQAHDTYSAERASKSNDAQIITIGARVVGIELAKAIVQAFIGSSFEPRSQSKLDALAAHEQRLRQP

SEQ ID NO: 1881 - protein, 158 aa, Bdellovibrio bacteriovorus
MIVYVGCDHAGLDLKLKVMAALPDIQWKDMGTHSADSVDYPDYADQVCREVVKVELQNQKNNLIDSQKGPALGLLICGSGQGMAIRANKFPQIRAALCWNTDIARLSREHNNANILCLSERFTSPDDAVKMLQTFLSTSFAGGRHQQRVDKLSSDTGC

SEQ ID NO: 1882 - protein, 152 aa, Desulfobacterium autotrophicum
MDMAIDTTAPIIIGCDHAAFPLKEKIIVFLKGLGIEVKDAGTFSQESVSYVDYGKKVAKAVSEGEYSRGILLCGTGLGMSMVANRFPRVRAALCSDIFSVRMSREHNDSNILVLGGRIIGDALAFELVRTWLETPFEGGRHLDRIKSLETSV

SEQ ID NO: 1883 - protein, 148 aa, Desulfococcus oleovorans Hxd3
MNIIIASDHAGFRTKRDIIDYLRRNHATWEVTDLGPEDDAPVDYPIYAHMVASAVAAGDYRRGILICGSGIGMSMMANRFQGVRAALCVTPQMAELSRQHNRSNVLCLAGRLVELEENIQIVNTWLNTDYTDEARHTRRYRLMDLLQS

SEQ ID NO: 1884 - protein, 142 aa, Desulfotalea psychrophila LSv54
MNIIIASDHGGYELKELLKKKIVALGHTIEDVGCDSLDSVDYPDYAQRAVDALVEHGDRGVLICGTGIGMSIAANRNRSVRAALCHDEYTAAMSREHNDANILCMGARVLSPERAQQVLHTWLTTEFVGGRHLQRITKFSDI

SEQ ID NO: 1885 - protein, 140 aa, Desulfurivibrio alkaliphilus AHT2
MKIALGSDHGGFGLKETVLTVLQQLGHEIRDCGTMDGQSVDYPQIVDAVCELVTAGTCQRGIMICGTGIGVSMAANRRRGIRAALCTEGFSARMSREHNDANVLCLGGRTIGPGQAEEIVRIWLSTEFAGGRHLRRIQMF

SEQ ID NO: 1886 - protein, 150 aa, Desulfohalobium retbaense
MPEAPIVFGSDHAGLPLKSALLEILQQQGIATEDQGTHTFDSCDYPVLASEVCQRIQQTRGLGVLVCGSGLGMSMVANRYQGIRAALCTNEYLARMARLHNNANILCLGDRVLGIDLAQSILETFLNTPFEGGRHQRRVDLIDTLPQRGQ

SEQ ID NO: 1887 - protein, 144 aa, Desulfonatronospira thiodismutans ASO3-1
MNKTVVFGSDHAGLWLKRVLMDRLSNDRQTIDVGTEDDSSCDYPVYAGRLCEKVLELQCLGVLICGSGLGMSMTANRFRGIRAALCCNEYMARMARKHNNANVLCMGERVIGVDLAGSILDVFLETGFEGGRHAKRLDIIEEIA

SEQ ID NO: 1888 - protein, 149 aa, Desulfomicrobium baculatum DSM 4028
MRTIIFGSDHAGFGLKNILMEHLAGRFDTVDVGTHSLESCDYPNIAGKLATEVIALKATGILICGSGIGVSITANRFEGIRAALCANEYMARMSRMHNDANVLCMGERIIGVDLAKAIADAFLGTEFEGGRHQRRVDLIDRQTPSHQPS

SEQ ID NO: 1889 - protein, 146 aa, Desulfovibrio aespoeensis Aspo-2
MSRTIVIGSDHGGYTLKQALIKALADWGCLVEDQGPDCLDSCDYPIYAAKVVERVRNDNGVLGVLICGTGQGMTMTANRMGVRAALCTNEFLARMAREHNDARILCLGERVTGQGLALAILKTFLETGFGGERHQRRIDLMDTVSK

SEQ ID NO: 1890 - protein, 144 aa, Desulfovibrio desulfuricans
MQSIHLASDHAGIDLKTTLAEHLGKKGINVVNHGTDSRESCDYPVLAHKLCAAVEASGELGILICGTGIGVSIAANRHSGIRAALCTTELHARFSRLHNNANVLCLGARVTGVELAQAIVDAFLEAPFEGGRHQRRLDMLNLPA

SEQ ID NO: 1891 - protein, 146 aa, Desulfovibrio desulfuricans
MAKQVIIGSDHAGFSLKELLVSELTKSGYDVHDMGPATAESCDYPLFAQKVCERVLQQKAQGILICGTGIGMSMAANRIDGIRAALCTTEFHARATRLHNNANVLCLGERVTGPGVALELARLFLETEFEGGRHQRRIDLFDSASA

SEQ ID NO: 1892 - protein, 151 aa, Desulfovibrio magneticus RS-1
MPKTVFLGSDHAGLELKTVVAAHLAAAGHAVVDLGPSEAKSVDYPDFAKAVCAKVLETTGSCGILICGTGIGMSMAANRIPGIRAALCVNEYLARMTRLHNDANVLCLGERVIGQGLAASIVDAFMDTAFEGGRHQRRVDLIETCRPGCGL

SEQ ID NO: 1893 - protein, 142 aa, Desulfovibrio piger ATCC 29098
MKSIHMACDHAGIELKETLRAHLEKMGYTVTDHGTYSKESCDYPVFAHALCNAVEAEDVPGILICGTGIGMSIAANRHKGIRAALCTTELHARFTRLHNNANVLCLGARVTGVELALAIVDTFLSTEFEGGRHQRRIDLLNA

SEQ ID NO: 1894 - protein, 143 aa, Desulfovibrio salexigens
MAGKVVIGSDHGGFTLKAFAIKLLSDMGYDVIDAGPEEAVSCDYPVYAEKVAEMVTGEDIPGILICGTGLGMSMAANKIKGIRAAMCTNEYMAKMARAHNNANILCLGERVIGPGLAEEIIRAFMTSEFEGDRHLRRINLFDK

SEQ ID NO: 1895 - protein, 147 aa, Desulfovibrio vulgaris
MARKVFVGSDHAGFALKQSIVDSLRNAGHDVEDLGPESAVSCDYPHYAQKVCDRVLAEEALGILICGTGIGMSMAANRIPGIRAALCTCEFHARATRQHNNANVLCLGERVTGPGVALELARLFLDTDFEGGRHQRRIDLFDLNGCR

SEQ ID NO: 1896 - protein, 150 aa, Desulfovibrio vulgaris
MSAPVIIGSDHAGLALKQVIIAHLKATGRQVEDLGPQTAESCDYPLYAAKVTERVLATGGFGILVCGTGIGMSMAANRFPGIRAALCTCEFHARATRQHNDANVLCLGERVTGPGVAMGLVDLFLNTPFEGGRHQRRIDQFDGPACTGGC

SEQ ID NO: 1897 - protein, 142 aa, Lawsonia intracellularis
MLKVYIASDHAGFSLKNTLIEQLQDNDYIVRDLGPMTSEPCDYPLYAQYVCEQVLDEIGSFGILICGTGIGMSMAANRIKGIRAALCTSEFQARATRLHNNANILCLGERVIGKSIAIEIVNIFLTTPFEGGRHLQRIASFD

SEQ ID NO: 1898 - protein, 150 aa, Desulfuromonas acetoxidans
MLLIASDHGGLELKQILVDYLKQQGVDVKDLGVHAEDSVDYPDYAALVAEPISKQEADQGILVCGTGIGMSIAANKFPGVRAALAHDEFTAQMAREHNNANILVLGGRVLDPELACRMVSVWYDGAYEGGRHQNRLNKIIQLERHCDADA

SEQ ID NO: 1899 - protein, 151 aa, Geobacter bemidjiensis Bem
MIVLGSDHGGLELKNEIKNLLDQRGIPCEDLGTHNGDSVDYPDFGVAVSRRVSEGSAEKGILVCSTGIGMSIVANKFPGVRAALATDVFMATMAKEHNNANILVLGGRVLKTELAREMVAAWLDTAFAAGRHQGRLDKIAAVERQLGTKLS

SEQ ID NO: 1900 - protein, 149 aa, Geobacter lovleyi SZ
MKIAIGSDHGGFELKQALIPFLQGRDIEVADAGTYSTDSVDYPEFAEAVALLVVHGEADAGIVICGTGIGISIAANKLPGIRAALVTTPQMAELAKQHNNANILALGGRILSLETAEACVAAWLDAVYEGDRHQRRLDKITTIEKKSCQ

SEQ ID NO: 1901 - protein, 150 aa, Geobacter metallireducens
MRIGIAADHGGFTMKERMAAALREAGYELTDFGAERLDPDDDYPDFVIPLAQAVGEGKLDRGIAFCSSGVGASIAANKVPGARAALIHDDYSAHQGVEHDDMNIICLGSLVVGYAQSWELVRAFLAATFSGAERHRRRLAKVAALEQCGR

SEQ ID NO: 1902 - protein, 148 aa, Geobacter metallireducens
MILVGSDHGGLELKEAIKLLLTERGITVEDCGTDNGNSVDYPDFGIKVARKISAGEAEKGILFCGTGIGMSIVANKFPNVRAALATDPFMARMAKEHNNANILVLGGRVLDEATAREMVCVWLDATFEGGRHQGRLDKIAALEKELMK

SEQ ID NO: 1903 - protein, 148 aa, Geobacter sp. FRC-32
MIALGSDHGGLALKVEIKKLLLERGIPFEDCGTDNGDSVDYPDFGEKVARKVSKGEVEKGILVCGTGIGMSIVANKFPHVRAAIVTDSFMARMAKEHNNANILVLGGRVLDNDGAREMVSTWLDAAFEGGRHQGRLDKIALIEKELYK

SEQ ID NO: 1904 - protein, 148 aa, Geobacter sp. M18
MIVLGSDHGGLELKNEIKKLLEERGLPCEDLGTHNGDSVDYPDFGERVARRVSEGSAEKGILVCGTGIGMSIVANKFPGIRAALATDVFMATMAKEHNNANILVLGGRVLDTGKARDMVAAWLDTEYAAGRHQNRLDKITALERELKG

SEQ ID NO: 1905 - protein, 151 aa, Geobacter sp. M21
MILLGSDHGGLELKNEIKNLLDERGIPCEDLGTHNGDSVDYPDFGERVARRVSEGSAEKGILVCGTGIGMSIVANKFPGVRAALATDVFMATMAKEHNNANILVLGGRVLKTELAREMVAAWLDTAFAAGRHQGRLDKIAAVEGQLGTKLS

SEQ ID NO: 1906 - protein, 148 aa, Geobacter sulfurreducens
MIVVGSDHGGLELKEAVKRLLAERGETFEDCGTDNGNSVDYPDFGIKVARRVSNGEAGKGILLCGTGIGMSIVANKFPRVRAALATDAFMARMAKEHNNANILVLGGRVLEEAVAREMVIAWLDGVYEGGRHQGRLDKIAALERELMK

SEQ ID NO: 1907 - protein, 149 aa, Geobacter uraniireducens Rf4
MIAIGSDHGGLSLKEALKKLLAERGISFEDCGTDNGDSVDYPDFGVKVARKVSSGEVEKGILVCGTGIGMSIVANKFPRVRAALVTDSFMAQMAKEHNNANILVLGGRVLDENAARTMVATWLDATFEGGRHQARLDKIEDIEKELRRS

SEQ ID NO: 1908 - protein, 151 aa, Pelobacter carbinolicus
MFLIASDHGGLELKEQVKAYLKQRNIEVRDLGTDNGDSVDYPDFGERVGRAISTGEAEKGILICGTGIGMSIVANKFPGVRAALIWDEFTARMSKEHNNANIIVMGGRMLSDDKASQMVGVWLDATFEGGRHQKRLDKIAQIEEDIRSGRL

SEQ ID NO: 1909 - protein, 148 aa, Pelobacter propionicus
MIVIGSDHGGLDLKQALTRYLADRAIKVSDIGTDNGDSVDYPRFGLKVAEMVASGSADRGILVCGTGIGMSIAANKVPGIRAALATDVFMGRMAKEHNNANILVLGGRVLDEQEACDIVGVWLDATFEGGRHQGRLDQIAEIEKKYCK

SEQ ID NO: 1910 - protein, 160 aa, Stigmatella aurantiaca
MRIALAADHAGFELKNWLLRALEGAGHTLVDKGTYSTEPVDYPDCAQAVGEALRGGDVDRAILICGSGVGASIAVNKMPGVRGGLCHDTYSAHQGVEHDDMNVLVLGARVIGLALAEELARAFLAARFSGEERHKRRLSKVHALEARFAPGAGPLTSPER

SEQ ID NO: 1911 - protein, 147 aa, Anaeromyxobacter dehalogenans 2CP-1
MAERVIAGSDHAGLNLRAEAVKVARAAGFEVEDLGPFSGESVDYPDYARQVAEAVAAGRARLGILVCGTGIGMSISANKVHGVRAAHCVTEFDARMARAHNDANVLCIGERVLGLGLGAAVVKAFLETPFEGGRHQRRVDKIGALER

SEQ ID NO: 1912 - protein, 147 aa, Anaeromyxobacter dehalogenans 2CP-C
MAERVIAGSDHAGLHLRAEAVKVARAAGFDVEDLGPFTGESVDYPDYARQVAEAVAAGRARLGILVCGTGIGMSISANKVHGIRAAHCVTEFDARMARAHNDANVLCMGERVLGLGVAAAVVKAFLETPFEGGRHQRRVDKIGALER

SEQ ID NO: 1913 - protein, 161 aa, Anaeromyxobacter sp. Fw109-5
MRVAIAADHAGVALAAMLRAELAVLGHEVVDLTPRDQGPEDDYPDHAVSVGEAIRSGRAERGVLVCGSGVGVAIAANKLPGIYAGACHDTYSAHQGVEHDAMNVLALGARVVGEALAREILGAFLGARPSGEERHRRRISKTRGIEARALQGAPGTSGEPR

SEQ ID NO: 1914 - protein, 147 aa, Anaeromyxobacter sp. Fw109-5
MADRVIAGSDHAGLSLRAEAVKVAREAGFEVEDVGPFSGESVDYPDYARQVAEAVASGRARLGLLVCGTGIGMSIAANKVKGARAAHCASEYEARMARLHNDANVLCIGERVVGLGLGAAIVKAFLETRFEGGRHERRVQKLKDMEK

SEQ ID NO: 1915 - protein, 147 aa, Anaeromyxobacter sp. K
MAERVIAGSDHAGLNLRAEAVKVARAAGFEVEDLGPFSSESVDYPDYARQVAEAVAAGRARLGILVCGTGIGMSISANKVHGVRAAHCVTEFDARMARAHNDANVLCIGERVLGLGVAAAVVKAFLETPFEGGRHQRRVDKIGALER

SEQ ID NO: 1916 - protein, 147 aa, Myxococcus xanthus
MKVILASDHAGLELRQELVAALTARGVAHEDVGPVTRDSVDYPDFAARVSRAVTSGEATLGVLVCGTGIGMSIVANKHKGIRAALCTTEFEARMARAHNDANVLCLGQRVVGAGVGRAILEAFLSTAFEGGRHERRVQMIREAESQG

SEQ ID NO: 1917 - protein, 160 aa, Haliangium ochraceum DSM 14365
MKWFAGADHAGYELKQQLVAVLRALGDEVEDLGTHGSESVDYPDFGAAVGRKVAAEAGTLGLVVCGSGMGICIAANKIAGVRAVAVSCAYAARMARAHNDANVLALGQRIVGVGVAEDALRAFRDGVFEGGRHQRRVDKLSALEGADPAAGADPAGADSV

SEQ ID NO: 1918 - protein, 155 aa, Plesiocystis pacifica SIR-1
MRFHVGSDHGGVELRKVLVAALAEWEIPVLAEYGPAAPGEKADYPNVARELAQAVLRDRGQGGGEDVFGLLVCGTGQGVAMTANKVPGVRAGVVSDVFSAKMIRAHNDAQVLCLGERVLGTELAKQLLRAFIDAPFEGGRHARRVGLMEPAGEER

SEQ ID NO: 1919 - protein, 152 aa, Syntrophus aciditrophicus SB
MEQKIIIGADHAGFQLKETVKSFLEEKGWVVSDIGTDSEEAVDYPDFGEKVAGAVSAGVFSRGILVCGSGVGMAIVANKFDGIRAAVCLDTETARLSRLHNDTNILILAGRRTLPETARQIVDVWLETPFEGGRHRGRLDKIRALENEKGKA

SEQ ID NO: 1920 - protein, 161 aa, Syntrophobacter fumaroxidans MPOB
MRVGIAADHGGFELKRQLVEELAATGHDVVDFGARRFDPADDFPDYVVPLARAVVERTVERGLAVCGSGVGASIAANKVPGARAALITDVYSARQGVEDDDMNMMCLGGRVVGVELAKELLRAFLKARYRPAERFERRLAKVAALEDESSRTAHGTTRREE

SEQ ID NO: 1921 - protein, 146 aa, Syntrophobacter fumaroxidans MPOB
MKIMVGCDHGGFELKEKIVAHLGTLGHEVVDAGTNSLESVDYPHYAMKVARAVARGEADRGILVCGSGIGMNMTANRVSGIRAVLAYEPYGAIMSRRHNDSNVLCMGGRFTGLDMALQIVDVWLREPFEGGRHQRRIELIDRLVDA

SEQ ID NO: 1922 - protein, 141 aa, unknown
  delta proteobacterium MLMS-1
MKVALGCDHGGFALKETVAQRLRAASCEIEDCGVMEATAVDYPDIASRLCRLVADGVCQRGILICGTGIGMSMAANRYTAIRAALCHEPFSARMSREHNDANVLCLGARVIGPGLAAAIVDAWLAGEFAGGRHLQRITMFS

SEQ ID NO: 1923 - protein, 141 aa, unknown
  delta proteobacterium MLMS-1
MKVALGCDHGGFALKETVAQRLRAASCEIEDCGVMEATAVDYPDIASRLCRLVADGVCQRGILICGTGIGMSMAANRYTAIRAALCHEPFSARMSREHNDANVLCLGARVIGPGLAAAIVDVWLAGEFAGGRHLQRITMFS

SEQ ID NO: 1924 - protein, 151 aa, Arcobacter butzleri
MKYFIGADHAGIEIKAFVKDLFEQRGHQVEDLGPFNKDRVDYPDYASKVCKKVLENEGTMGILICGSGLGMSMAANKFDGIRAALCHNEYSARMARKHNDANVICLGERVSGEGMIEAIIKAWDKAEFEGGRHEGRVAKINALGKMGSCRA

SEQ ID NO: 1925 - protein, 145 aa, Campylobacter coli
MLREKIYIASDHAGFLLKEKICAFLEEKQIPFDDLGTKDPTSCDYPDYAHLLASKIDEQSFGILICGSGIGISIAANRHKNIRCALCNESLSAKLARKHNDANVLAFGGRLIGIDAAIDMIENFIQTPFDQGRHVKRIQKIEVDC

SEQ ID NO: 1926 - protein, 147 aa, Campylobacter concisus
MKIDKVFLASDHAGFELKNELKEAIKGLGYEVVDLGTNDKNSVDYPDYAHLLASKLEPNCYGVLVCGTGIGISIAANRHENVRCALCHDEFTARLAREHNDANVIAFGARVIGAGVAISAAEAFLKTEFAGGRHERRVQKIELKAGK

SEQ ID NO: 1927 - protein, 149 aa, Campylobacter curvus
MDIEKIFIASDHAGFELKNELKTILSNLGHEVIDLGTNDGKTSVDYPDFAHSMAKNLASKCYGVLICGTGIGISIAANRHQNIRCALCHDEFTARLAREHNDANVIAFGARVIGAGVAGEMLKVFFSTEFQGGRHERRVGKIEPNKEIS

SEQ ID NO: 1928 - protein, 148 aa, Campylobacter fetus
MKVAQIFIASDHAGFDTKEFVKSYLSNFEFDVVDLGAYSKDMSVDYPDFADKMAENINNDFKFGILICGTGIGISIAANRHPHIRCALCHDATTAKLAREHNDANVLCFGGRIVGTSIIQDMVKVFFTTEFAGGRHEKRVYKLGNYKC

SEQ ID NO: 1929 - protein, 148 aa, Campylobacter hominis ATCC BAA-381
MQIEKIFIASDHAGFDAKQIAKKTLNQMNFEVIDLGTNDSQKSVDYPDFAYALSKEIAKDEKNYGILICGTGIGISIAANRNPKIRCALCHDALTAKLAREHNDANILAFGGRILGSAEIESIIKIFFNTEFLGGRHARRIAKLGEIK

SEQ ID NO: 1930 - protein, 145 aa, Campylobacter jejuni
MLREKIYIASDHAGFELKEKICVFLKEKNIIFNDLGTNTCASCDYPDYAHLLAEKINKRSFGILICGSGIGISIAANRHKNIRCALCHESLSAELARRHNDANVLALGGRLIGVELAIDIIEKFIQTPFEEGRHMQRIQKIEVKI

SEQ ID NO: 1931 - protein, 145 aa, Campylobacter jejuni
MLREKIYIASDHAGFELKEKICALLKEKNIIFNDLGTNTCASCDYPDYAHLLAEKIDERSFGILICGSGIGISIAANRHKNIRCALCHESLSAELARRHNDANVLALGGRLIGIELAIDIIEKFIQTPFEGGRHMQRIQKIEVKI

SEQ ID NO: 1932 - protein, 145 aa, Campylobacter jejuni
MLREKIYIASDHAGFELKEKICVFLKEKNIIFNDLGTNTCTSCDYPDYAHLLAEKIDERSFGILICGSGIGISIAANRHKNIRCALCHESLSAELARRHNDANVLALGGRLIGVELAIDIIEKFIQTPFEEGRHMQRIQKIEVKI

SEQ ID NO: 1933 - protein, 145 aa, Campylobacter jejuni
MLREKIYIASDHAGFELKEKICVFLKEKNIIFNDLGTNTCASCDYPDYAHLLAEKIDERSFGILICGSGIGISIAANRHKNIRCALCHESLSAELARRHNDANVLALGGRLIGVELAIDIIEKFIQTPFEEGRHMQRIQKIEVKI

SEQ ID NO: 1934 - protein, 145 aa, Campylobacter lari
MLREKIYIASDHAGFILKQEIINFLQEKNISFEDLGPFSNDRCDYPDYAHLLSSKINETSFGILVCGSGIGMSIAANRHTNIRCALCNEPLSAKLSREHNDANVLALGSRLTGIDMAFEIINNFINTSFSGGRHCARISKIEAKL

SEQ ID NO: 1935 - protein, 146 aa, Campylobacter rectus
MKIDKIFIASDHAGFDLKAQICELLKNEGFSVCDLGTHSKDSVDYPDFAALLAQNLRHENEYGVLICGTGIGISIAANRHTHVRCALCHDVTTAKLAREHNDANVLAMGARTIGDAVAADTIKAFFATEFAGGRHERRVKKLGGEK

SEQ ID NO: 1936 - protein, 146 aa, Campylobacter showae
MKIDKIFIASDHAGFDLKAQICRLLKNEGFDVCDLGTHSKDSVDYPDFAELMAQNLRGDNEYGVLICGTGIGISIAANRHSHVRCALCHDVTTAKLAREHNDANVLAMGARTIGDAVAADMIKAFFATEFAGGRHERRVKKLGGEK

SEQ ID NO: 1937 - protein, 144 aa, Campylobacter upsaliensis
MLRERLYIASDHAGYELKTKLCAFFKEVQIPFIDLGTNDEKSCDYSDFAHLLTSKIDEKSFGILICGSGIGISIAANRHKNIRCALCNESLSARLARKHNDANVLAFGGRLVGFDLAVDMIENFIKTPFDEGRHMKRIQKIEVD

SEQ ID NO: 1938 - protein, 142 aa, Sulfurospirillum deleyianum DSM 6946
MKFFIATDHAGVAIKPDVTAMLQKLGHDVIDLGPFNDERVDYPDFAHRLCLEVLNHEGTQGILICGSGIGMSLSANKHVGIRAALCHDAYTAQMARAHNDANVLCFGQRIVGLGVVESILDAWCKTSFEGGRHAQRVSKIEL

SEQ ID NO: 1939 - protein, 153 aa, Helicobacter acinonychis str. Sheeba
MNKPLNIAQVFIGSDHAGLHLAEFVQHFLEDKQFKIQAFLPTARVDYPDYAKLVCQKVLENAQSYGILVCATGIGMSMGANRFKGIRAALCLDAYMAKMTRLHNNANVLCLGEKISGIGVVESILEAFFSTEFEQDRHVLRIQKLDESLKSST

SEQ ID NO: 1940 - protein, 145 aa, Helicobacter bilis
MLFIASDHAGLKIKQVATKYCKEHNIAFKDLGVHVSDSVDYPDMAEAVCQEMLKDIENSRGILICGSGIGMSIAANRHRAIRAALCFDPYMAAVARKHNNANVLCLGERVIGAGVAEAVIEVFLNETFEGGRHAIRVEKLTNTKD

SEQ ID NO: 1941 - protein, 141 aa, Helicobacter canadensis MIT 98-5491
MKFFIASDHAGFELKESLIQILEKMGYEVTNLGPVNNDRVDYPDFANLLCQEVLATPQSLGILICGSGIGMSIAANRHKGIRAALCNEPYGATMARAHNDANVLCLGARVVGLGMAECILQSFIKGEFEGGRHTQRVEKLQ

SEQ ID NO: 1942 - protein, 150 aa, Helicobacter cinaedi
MRENKKQTYVIGTDHAGANLKDFVMTFLREKGFSVIDLAPQDTQRVDYPDYAKKVCDVLKENPQYKGILICGSGIGMSIAANRYKHIRAALCHDAYMAKMARLHNDANVLCMGERISGVGEVESILEAFVDFEFEGGRHAQRVEKLGDME

SEQ ID NO: 1943 - protein, 147 aa, Helicobacter hepaticus
MTYVIGTDHAGFKLKEFTISFLQKKGFEIIDLAPQTNQRVDYPDYAKKVCEAVGEEVNRRGILICGSGIGMSIAANRFKHIRAALCVDAYMAKMARAHNDANVLCMGERISGLGEVESILEAFVSSEFEGERHLVRVEKLGNLGQIL

SEQ ID NO: 1944 - protein, 141 aa, Helicobacter pullorum
MKIFVASDHAGFELKESVAEILKSMGHQVVNLGPYDNNRVDYPDFANLLCGEVLKEEGSLGVLVCGSGIGMSIAANRHKGIRAALCNEPYGAMMARAHNDANVLCLGARVIGIGMAEIILQSFISGKFEGGRHAIRVEKLQ

SEQ ID NO: 1945 - protein, 151 aa, Helicobacter pylori
MNKLLKFSQVFIGSDHAGLHLAEFVQRFLEDKDFKIQAFLPTMRVDYPDYAKLVCQKVLENAQSYGILVCATGIGMSMGANRFKGIRAALCLDAYMAKMTRLHNNANVLCLGEKISGIGVVESILEAFFSTEFEQGRHVLRIQKLDESLKS

SEQ ID NO: 1946 - protein, 151 aa, Helicobacter pylori
MNKPLKPSQIFIGSDHAGLHLAEFVQHFLKDKDFKIQAFLPTMRVDYPDYAKLVCQKVLENPQSYGILVCATGIGMSIGANRFKGIRAALCLDAYMAKMTRLHNNANVLCLGEKISGIGVVGSILEAFFSTEFEQGRHVLRIQKLDESLKS

SEQ ID NO: 1947 - protein, 151 aa, Helicobacter pylori
MNKPLKPSQVFIGSDHAGLHLAEFVQHFLEDKGFKIQTFLPTMRVDYPDYAKLVCQKVLENPQSYGILVCATGIGMSMGANRFKGIRAALCLDAYMAKMTRLHNNANVLCLGEKISGIGVVESILEAFFSTEFEQGRHVLRIQKLDESLKS

SEQ ID NO: 1948 - protein, 153 aa, Helicobacter pylori
MNKPLKPSQIFIGSDHAGLHLAEFVQHFLEDKDFKIQAFLPTMRVDYPDYAKLVCQKVLENPQSYGILVCATGIGMSMGANRFKGIRAALCLDAYMAKMTRLHNNANVLCLGEKISGIGVVGSILEAFFSTEFEQGRHVLRIQKLDESLKSST

SEQ ID NO: 1949 - protein, 151 aa, Helicobacter pylori
MNKPLNIAQVFIGSDHAGLHLAEFVKHFLEDKRFKVQAFLPTMRVDYPDYAKLVCQKVLENPQSYGILVCATGIGMSMGANRFKGIRAALCLDAYMAKMTRLHNNANVLCLGEKISGIGVAESILEAFFSTEFEQGRHVLRIQKLDESLKS

SEQ ID NO: 1950 - protein, 149 aa, Helicobacter pylori
MNKPLNIAQVFIGSDHAGLHLAEFVKHFLEDKHFKIQAFLPTMRVDYPDYAKLVCQKVLENPQSYGILVCATGIGMSMGANRFKGIRAALCLDAYMAKMTRLHNNANVLCLGEKISGIGVAESILEAFFSTEFEQGRHVLRIQKLDETR

SEQ ID NO: 1951 - protein, 153 aa, Helicobacter pylori
MNKPLNIAQVFIGSDHAGLHLAEFVKHFLEDKRFKIQAFLPTMRVDYPDYAKLVCQKVLENPQSYGILVCATGIGMSMGANRFKGIRAALCLDAYMAKMTRLHNNANVLCLGEKISGIGVTESILEAFFSTEFEQGRHVLRIQKLDESLKSST

SEQ ID NO: 1952 - protein, 153 aa, Helicobacter pylori
MNKPLNIAQVFIGSDHAGLHLAEFVKHFLEDKDFKIQAFLPTMRVDYPDYAKLVCQKVLENPQSYGILVCATGIGMSMGANRFKGIRAALCLDAYMAKMTRLHNNANVLCLGEKISGIGVTESILEAFFSTEFEQGRHVLRIQKLDELLKSST

SEQ ID NO: 1953 - protein, 151 aa, Helicobacter pylori
MNKPLKFSQVFIGSDHAGVHLAEFVQHFLEDKDFKIQAFLPTMRVDYPDYAKLVCQKVLENAQSYGILVCATGIGMSMGANRFKGIRAALCLDAYMAKMTRLHNNANVLCLGEKISGIGVVESILEAFFSTEFEQGRHVLRIQKLDESLKS

SEQ ID NO: 1954 - protein, 151 aa, Helicobacter pylori
MNKPLNTAQVFIGSDHAGLHLAEFVKHFLEDKRFKIQAFLPTTRVDYPDYAKLVCQKVLENAQSYGILVCATGIGMSMGANRFKGIRAALCLDAYMAKMTRLHNNANVLCLGEKISGIGVAESILEAFFSTEFEQGRHVLRIQKLDESLKS

SEQ ID NO: 1955 - protein, 151 aa, Helicobacter pylori
MNKPLNIAQVFIGSDHAGLHLAEFVKHFLEDKRFKVQAFLPTMRVDYPDYAKLVCQKVLENAQSYGILVCATGIGMSMGANRFKGIRAALCLDAYMAKMTRLHNNANVLCLGEKISGIGVTESILEAFFSTEFEQGRHALRIQKLDESLKS

SEQ ID NO: 1956 - protein, 151 aa, Helicobacter pylori
MNKPLKPSQIFIGSDHAGLHLAKFVQHFLEDKDFKIQAFLPAMRVDYPDYAKLVCQRVLENAQSYGILVCATGIGMSMGANRFKGIRAALCLDAYMAKMTRLHNNANVLCLGEKISGIGVVESILEAFFSTEFEQGRHVLRIQKLDESLKS

SEQ ID NO: 1957 - protein, 141 aa, Helicobacter winghamensis ATCC BAA-430
MQFFIASDHAGFMLKGSILGILEQMGHRVVDLGPLDAERVDYPDFANTLCEKVLDNEGSFGILICGSGIGMSIAANRHKGIRAALCAEPYSAAMSRAHNDANVLCLGARIVGIGMVESILKSFCEGVFEGGRHSCRIGKLQ

SEQ ID NO: 1958 - protein, 145 aa, Sulfurimonas denitrificans DSM 1251
MKFYIATDHAGLDLKDYTVELLKDKGHEVVDLGPFCKDRVDYPDYATKVCEAVLKDNSAFGILICGSGIGMSMAANRYSNIRAALCHDAYTASVARGHNDANVLCFGERIIGKGVAESIIDAWIAGSFEGGRHEQRVAKIEAINT

SEQ ID NO: 1959 - protein, 143 aa, Wolinella succinogenes
MTYFIATDHAGFSIKDHVKEFIRQKGHEVIDLGPASADRVDYPDYAHELCQKVLENRESAGILICGTGIGMSITANRHKGIRAALCHDAYTATLTRMHNDANVLCMGERVVGLGVVDSILEAFLSTPFEGGRHACRIGKIEQE

SEQ ID NO: 1960 - protein, 145 aa, Campylobacterales bacterium GD 1
MKFYIATDHAGIDLKDYTVELLKEKGHEVIDLGPFSKDRVDYPDYAVKVSESVLGDPTSQGILICGSGIGMSMAANRHTGIRAALCHDAYTAMVARGHNDANILCFGERIVGKGVAESILDSWIASSFDGGRHCGRVDKIEAINA

SEQ ID NO: 1961 - protein, 142 aa, Caminibacter mediatlanticus TB-2
MKYFIGTDHAGFEVKDFVIDYLQKKGIEVEDLGCYSTESVDYPDLAHKVANAVLENEGSKGILICGSGIGMSLAANKHKGIRAALCHDYYTASMARKHNNANILCFGARIVGKGEIESILEGWLNSEFEGGRHQRRVEKIDI

SEQ ID NO: 1962 - protein, 142 aa, Nautilia profundicola AmH
MKYFIGTDHAGYEIKPFVIEYLQKKGIEVEDLGTYSTDSVDYPDYAHKVAEAVLANPGTMGILICGSGIGMSLAANKHKGIRAALCHDHYTAKMARLHNNANILCFGARIVGLGVVESILDAWLDTEFEGGRHQRRVEKIDI

SEQ ID NO: 1963 - protein, 146 aa, Nitratiruptor sp. SB155-2
MKKVYIGCDHAGFAIKGLVIKLLQKRGYEVEDLGTYSSERVDYPDYAEKVARAVAADKESFGVLICGTGIGMSIAANKIKGIRAAEVHDYYTAQMARAHNDANIVCFGERVVGPGVVESIIDAWCNTEFEGGRHENRVKKIMALEE

SEQ ID NO: 1964 - protein, 153 aa, Sulfurovum sp. NBC37-1
MSKKFYIATDHAGYAVKAYVKELVTNLGHEIIDLGPDSADRVDYPDFAKKCTEAVIANPGSFGILICGTGIGMSIAANKVSGIRAALCHDHYTAQLTRQHNDANVLCFGERVVGKGVIEDIIDAFASTEFEGGRHATRIGKIEAGCSFGADLG

SEQ ID NO: 1965 - protein, 152 aa, Tolumonas auensis
MNTIAIGADDAAFDFRNKIIEYLKEKNIPFIDYSSDKAPENKLYPDVAHNVASAIKDGKHERGILICGTGIGMSIVANKVPGIRAAQCHDPFSAERARKSNNAQIISFGARVIGTELAKNILKTWFESEYEGGNSAPKVDRINYYQEFYSHK

SEQ ID NO: 1966 - protein, 155 aa, Tolumonas auensis
MKIAFGSDHVGYEMKCEIMAYLAEKGIECTDFGPYTTDRVDYPDYALAVANAVNQGAFEKGILICGTGVGISIAANKVNGIRAVVCSEPYSAQLSRQHNNTNVLAFGARVVGIELAKMIVDCWLAGQYEGDRHQIRVNKIAEIEKLQDVAEGACS

SEQ ID NO: 1967 - protein, 151 aa, Citrobacter koseri ATCC BAA-895
MSMKKIAFGCDHVGFILKQDILTHLTQRGITVIDKGTWSPERTDYPHYASEVAQAVVSGEVDGGILVCGTGVGISITANKFAGVRAVVCSEPYSAQLSRQHNDTNVLAFGSRVVGLELAKMIVDAWLDAGFEGGRHQKRVEAIMAIEQQGK

SEQ ID NO: 1968 - protein, 152 aa, Dickeya dadantii Ech703
MKPIAIGADDAAYELRSTITNYLDSLNIPWVDFSSDKNADNRYYPDVAHAVAMSIKAGQQDRGILICGTGIGMSIVANKVPGIRAAQCHDTFSAERARKSNNAQIVTLGARVIGAELGKQIIRAWLNAEYEGGGSAAKVERIDYYQNQHIAE

SEQ ID NO: 1969 - protein, 163 aa, Edwardsiella ictaluri 93-146
MLPIAIGADDAAITLKETLVAYLQQRHIPFTDYTDAIRDSDYPDIAVRVAQAIREAHHQRGILLCGTGIGMSIMANKVPGIRAAQCHDTYSAQRARKSNDAHIITLGARVIGPELAKAIVDAWLIAEFEGGGSTIKVAKIGNYEQIFSEKYRGELRINASTHR

SEQ ID NO: 1970 - protein, 149 aa, Escherichia coli
MKKIAFGCDHVGFILKHEIVAHLVERGVEVIDKGTWSSERTDYPHYASHVALAVAGGEADGGILICGTGVGISIAANKFAGIRAVVCSEPYSAQLSRQHNDTNVLAFGSRVVGLELAKMIVDAWLGAQYEGGRHQQRVEAITAIEQRRN

SEQ ID NO: 1971 - protein, 149 aa, Escherichia coli
MKKIAFGCDHVGFILKHEIVAHLVERGVEVIDKGTWSSERTDYPHYASQVALAVAGGEVDGGILICGTGVGISIAAKKFAGIRAVVCSEPYSAQLSRQHNDTNVLAFGSRVVGLELAKMIVDAWLGAQYEGGRHQQRVEAITAIEQWRN

SEQ ID NO: 1972 - protein, 178 aa, Escherichia coli
MKTKIAIASDDVGFARKEEIKKYLIEEKNMEIVYDPVTCKEQGVNNFARLADEMAGIIQRDECRLGIYICGTGIGFTCQINKHWGIRAVAVTNPYSAKRARLSNNAQVIGLGCRVNDLEYSKMIVDAWLDNPFDFTTARENSKKNLLEAERNDNALLVKPADVRWNMGFRPDDEKSEG

SEQ ID NO: 1973 - protein, 149 aa, Escherichia coli
MKKIAFGCDHVGFILKHEIVAHLVERGVEVIDKGTWSSERTDYPHYASQVALAVAGGEADGGILICGTGVGISIAANKFAGIRAVVCSEPYSAQLSRQHNDTNVLAFGSRVVGLELAKMIVDAWLGAQYEGGRHQQRVEAITAIEQQRN

SEQ ID NO: 1974 - protein, 149 aa, Escherichia coli
MKKIAFGCDHVGFILKHEIVAHLVERDVEVIDKGTWSSERTDYPHYASQVALAVAGGEADGGILICGTGVGISIAANKFAGIRAVVCSEPYSAQLSRQHNDTNVLAFGSRVVGLELAKMIVDAWLGAQYEGGRHQQRVEAITAIEQQRN

SEQ ID NO: 1975 - protein, 149 aa, Escherichia coli
MKKIAFGCDHVGFILKHEIVAHLVERGVEVIDKGTWSSERTDYPHYASQVALAVAGGEVDGGILICGTGVGISIAANKFAGIRAVVCSEPYSAQLSRQHNDTNVLAFGSRVVGLELAKMIVDAWLGAQYEGGRHQQRVEAITAIEQWRN

SEQ ID NO: 1976 - protein, 149 aa, Escherichia coli
MKKIAFGCDHVGFILKHEIVAHLVERGVEVIDKGTWSSERTDYPHYASQVALAVAGGEADGGILICGTGVGISIAANKFAGIRAVVCSEPYSAQLSRQHNDTNVLAFGSRVVGLELAKMIVDAWLGAQYEGGRHQQRVEAITAIEQRRN

SEQ ID NO: 1977 - protein, 149 aa, Escherichia coli
MKKIAFGCDHVGFILKHEIVAHLVERGVEVIDKGTWSSERTDYPHYASQVALVVAGGEADGGILICGTGVGISIAANKFAGIRAVVCSEPYSAQLSRQHNDTNVLAFGSRVVGLELAKMIVDAWLGAQYEGGRHQQRVEAITAIEQRRN

SEQ ID NO: 1978 - protein, 149 aa, Escherichia coli
MKKIAFGCDHVGFILKHEIVAHLVERDVEVIDKGTWSLERTDYPHYASQVALAVAGGEADGGILICGTGVGISIAANKFAGIRAVVCSEPYSAQLSRQHNDTNVLAFGSRVVGLELAKMIVDAWLGAQYEGGRHQQRVEAITAIEQQRN

SEQ ID NO: 1979 - protein, 152 aa, Escherichia fergusonii
MLTIAIGADDAATELKNLVKSHLQSKGIEVVDFSHDVADNSLIYPDIAFNLASAVSDGTYLRGILLCGTGIGMAIVANKVPGIRAAQCHDTYSAERARKSNDAQIMTMGARVIGPELAKNIVDVWLASEFEGGRSAPKVDKISYYEKQGKSA

SEQ ID NO: 1980 - protein, 149 aa, Escherichia fergusonii
MKKIAFGCDHVGFILKEEILTHLAQRGIEVLDKGTWSGERTDYPRYASAVAQAVVAGEADGGILICGTGVGISITANKFAGIRAVVCSEPYSAQLSRQHNDTNVLAFGSRVVGLELAKMIVDAWLDAKFEGGRHLARVEAIKAIEMRDD

SEQ ID NO: 1981 - protein, 152 aa, Klebsiella pneumoniae
MKTIAIGADDAAYAFRDTIVAYLNGLGINVADYSSDKRQGSTVYPDVAHAVAMSIKQGEHERGILICGTGIGMSIVANKVPGVRAAQCHDTFSAERARKSNNAQIITLGARVIGTELGKKIIQAWLESEYEGGGSAPKVERIDYYEHQHARD

SEQ ID NO: 1982 - protein, 152 aa, Klebsiella pneumoniae
MKTIAIGADDAAYAFRDAIVAYLNGLGINVADYSSDKRQGSTVYPDVAHAVAMSIKQGEHERGILICGTGIGMSIVANKVPGVRAAQCHDTFSAERARKSNNAQIITLGARVIGAELGKKIIQAWLESEYEGGGSAPKVERIDYYEHQHARD

SEQ ID NO: 1983 - protein, 152 aa, Klebsiella pneumoniae
MKTIAIGADDAAYAFRDSIVAYLNGLGINVADYSSDKRQGSTVYPDVAHAVAMSIKQGEHERGILICGTGIGMSIVANKVPGVRAAQCHDTFSAERARKSNNAQIITLGARVIGAELGKKIIQAWLESEYEGGGSAPKVERIDYYEHQHARD

SEQ ID NO: 1984 - protein, 152 aa, Pantoea sp. At-9b
MKTIAIGADDAAIELKNLIKRYLEEKQYDVQDYSNDAQNDRPMYPDVAFALATAIQQGEHDRGILLCGTGIGVAIVANKVAGVRAAQCHDTFSAERARKSNNAQIMTMGSRVIGPELAKNIVNAWLASEFEGGGSTAKVEKIGYYEQVCQAK

SEQ ID NO: 1985 - protein, 152 aa, Pectobacterium atrosepticum SCRI1043
MLSIAIGADSAAIDLKNTITDYLQQKGLTVTDYSYDPTGENPIYPDVAYTLAHAIKDGKHQRGILLCGTGIGMCIVANKVNGIRAAQCHDTYSAQRARKSNNAQVIALGARVIGPELAKEIIGAWLDAEFEGGGSAPKVEKIGYYEHQEKHQ

SEQ ID NO: 1986 - protein, 152 aa, Pectobacterium carotovorum subsp. carotovorum PC1
MKPIAIGADDAAWSLRDILTRYLDSLAIPWVDFSSDKNQDNTIYPDVAHAVAVSIKAGTYERGILLCGTGIGMSIVANKVTGVRAAQCHDTYSAQRARKSNNAQIIALGARVIGPELAKEIVSTWLDAEFEGGGSTSKVEKIGYYEHQESAR

SEQ ID NO: 1987 - protein, 152 aa, Pectobacterium carotovorum subsp. carotovorum WPP14
MLSIAIGADSAAIDLKNTITDYLQQKGLTVTDYSYDPTGENPIYPDVAYTLAHAIKDGKHQRGILLCGTGIGMSIVANKVNGIRAAQCHDTYSAQRARKSNDAQVIALGARVIGPELAKEIVGAWLDAEFEGGGSAPKVEKISYYEHQENHR

SEQ ID NO: 1988 - protein, 152 aa, Pectobacterium wasabiae WPP163
MKPIAIGADDAAWSLRDTLTRYLDSLNIPWVDFSSDKNQDNASYPDVAHTVAISIKEGTHERGILLCGTGIGMSIVANKVTGVRAAQCHDTYSAQRARKSNDAQIITLGARVIGPELAKEIVAAWLESEFEGGGSAPKIEKISYYEHQENTR

SEQ ID NO: 1989 - protein, 158 aa, Proteus mirabilis
MEQKIIVMGADPSGYELKNAVKSHLQAKNYTIKDITESGPIGYCDVGDKVGAIISEHPEYIGFVFCGTGMGVSISANKHKNVYCGVCESVTTARFCKVINNCNMLAMGGLLITPFKANMMVDAYLSAIFTQGFSEATPDDLQCGLQTMKEVEKRIYTD

SEQ ID NO: 1990 - protein, 158 aa, Proteus mirabilis
MEQKIIVMGADPSGYELKNAVKSHLQAKNYTIKDITESGPIGYCDVGDKVGAIISEHPEYIGFVFCGTGMGVSISANKHKNVYCGVCESVTTARFCKVINNCNMLAMGGLLITPFKANMMVDAYLSATFTQGFSEATPDDLQCGLQTMKEVEKRIYTD

SEQ ID NO: 1991 - protein, 158 aa, Proteus penneri ATCC 35198
MENRTIIMGADPSGFELKNAIKSYLLEKNYTIKDLTESGPIGYCDVGDKVGSIISEHPEYIGFVFCGTGMGVSISANKHKNVYCGVCESVTSARFCKIINNCNILAMGGLLITPFKAKMMVDAYLSATFTEGFSEATPEDLQSGLNSMKQVEKKIYKN

SEQ ID NO: 1992 - protein, 150 aa, Providencia rettgeri
MLSIAIGADDAAFEMKDLIKAHLAELNIEVTDYCLNTGVADEMYPDVAHAVATAIVQGKHQRGILICGTGIGMSIVANKVTGIRAALCHDTYSAERAQKSNDAQIITFGARVIGPELAKTIVDTWLASHYEGGRSAPKVARISEYENGER

SEQ ID NO: 1993 - protein, 178 aa, Salmonella enterica
MKTKIAIACDDVGFDRKEEIKKYLEEEKNADVVYDPVKRKEDGFNNFARLADEMAGVIQRDECRLGIYICGTGIGFTCQINKHWGIRAVAVTNPYSAKRARLSNNAQVIGLGCRVNDLEYTKMIVDAWYDNAFDFATARENSKKNLLEAERSDNALLTKPEDVRWNMGFRPDDEKSEG

SEQ ID NO: 1994 - protein, 151 aa, Yersinia bercovieri
MLSIAIGCDDAAIDMKNQILAFLQNKNITVVDYSCDQQREPTIYPDIAVQVAQAIKDGKHERGILICGTGIGMSITANKVLGIRAAQCHDPFSAQRARKSNNAQIICLGARVIGVELAKTLVDTWLECDFDGGSSTEKVERISYYEQRQNL

SEQ ID NO: 1995 - protein, 148 aa, Yersinia frederiksenii
MKIAIGCDHVGIILKPAITEHLIARGITVIDKGAHEDTRTDYPIYGKAVAEAVVSGEANLGIVFCGSGIGISIAANKVKGIRAVVCSEPYSAKLSREHNNTNVLSFGSRVIGSDLAKMIVDAWLDAKFEGERHQKRVEMIAAIEEEQA

SEQ ID NO: 1996 - protein, 151 aa, Yersinia intermedia
MKSIALGCDHVGFILKADIVAHLQTRGIKVIDKGWWSTERTDYPRYANEVAEAVTSGEVDGGVLICGTGVGISITANKHPGIRAVVCSEPYSAQLSRQHNNTNVLAFGSRVVGLELAKMIVDAWLDAEFEGGRHQTRVDAITEVEARFNAL

SEQ ID NO: 1997 - protein, 151 aa, Yersinia mollaretii
MLSIAIGCDDAAIDMKNQILAFLQNRGMTVVDYSCDQQRESTLYPDIAIQVAQAIKDGKHERGILICGTGIGMSITANKVLGIRAAQCHDPFSAQRARKSNNAQIICLGARVIGIELAKTLVDTWLDCDFDGGGSTEKVERISYYEQQQNI

SEQ ID NO: 1998 - protein, 151 aa, Yersinia pestis
MLSIAIGCDDAAIEMKNQIVIFLQSKNITVVDYSCDQHQEPTMYPDIAIQVALAIKAGKHERGILICGTGIGMSISANKVFGVRAAQCHDTFSAQRARKSNNAQIICLGARVIGPELAKTLIEAWLDAEFDGGGSTEKVERIRYYEQSLHD

SEQ ID NO: 1999 - protein, 147 aa, Legionella longbeachae
MKIAVCSDELYPVNDFVIQEVEHLGHQVILFGALKSRHTESWVETARVAAEAIKSGMCDEGIFFCWTGTGISIVANKIPGIRAALCTDAQTTRGARVWNSANVLALSNRLLTQDLAKEILDAWFNTSLNDSNEKIIEEIGFIERKYR

SEQ ID NO: 2000 - protein, 142 aa, Methylococcus capsulatus
MKIGIASDHAGFDYKERLRAWLASLGHEVVDYGCFSDERTDYPTWIRPCAQAVAAGEVERGIVLGGSGNGEAIVANRVKGCRCGYCFNEETAYLTRWHNDANCIAIGQRIVTLDMAKKIVETFLSTGFEGGRHIPRIVAIDA

SEQ ID NO: 2001 - protein, 166 aa, Chromohalobacter salexigens DSM 3043
MSDSRTASHTAPMRVALGGDEAAYELKALLIEHVRALGHEAVDFGTYDAEPVLYPDVAVKVARAIEAGEVERGVLVCGTGIGVAISANKVRGIRAAQAHDTYSAAKARSSNDAQIVTLGARVVGPELAKTIVTTFLATEFAGGGSREKVARILAYERETFRDPPRV

SEQ ID NO: 2002 - protein, 148 aa, Chromohalobacter salexigens DSM 3043
MKIVIGSDHAGYRLKASVVEYVESLGHEVIDVGSHDDTPVDFPDIAKQMAGKVTSGEAARGLMVCGTGVGASIAANKIRGIRAAVCHDIHSAHQCVEHDDVNVMCIGAQIVGPWLANDLIKAYLEAEFSTSEEFRRRVEKLHAMENDG

SEQ ID NO: 2003 - protein, 153 aa, Marinomonas sp. MWYL1
MRIAIAGDSAGEGLAKILADHLKDRYDVEEVSRTDSGEVEPFYANLSDRVANAVLDGKYDRAILCCGTGIGVCIAASKVPGIRAALTHDTYSAERAALSNNAQIITMGARVIGQELAKSIADAFLVQVFDENGRSADNVKAINSIDEKYHARP

SEQ ID NO: 2004 - protein, 149 aa, Actinobacillus succinogenes 130Z
MKIAIGCDEAAYRLKVEIMKHLDAIGVEYDDFGAGEGDVVLYPDVAEAVAVAVAEGKYERAILTCGTGIGMCITANKVPGVRAAVCHDVFSTERSRKSNDAQIMCLGERVIGVELAKSLIDVWFKCDFAGGGSAPKVARINEIDAKYHK

SEQ ID NO: 2005 - protein, 150 aa, Actinobacillus succinogenes 130Z
MKIAIGCDDAAYNLKIELIKYLETLGIECDDFGAGAGDLTLYPDVAEKVALAVSEGKYERGILTCGTGIGMCITANKVPGVRAAVCHDVFSAERSRKSNDAQIICFGERVIGVELAKSLLKVWLECDFAGGGSTPKLAKIKEIDAKYNKR

SEQ ID NO: 2006 - protein, 157 aa, Haemophilus somnus
MKTIAIGSDHIGLALKTFLIEKLEKQGHNLLDLGAVSQERTDYPIYAEKVAYAVKRNVADVGILICGTGVGISIAANKISGIRCALCSDELTALMCREHNNCNIIAFGANIISSEKAISLATLWLNTPYDGGRHQKRLDMMEMLEKTGSYCGLVTER

SEQ ID NO: 2007 - protein, 150 aa, Mannheimia succiniciproducens MBEL55E
MKIAIGCDEAAYRLKVEIMKHLDELGIEYDDFGAGEGDVVLYPDVAEAVAVAVAEGKYQRAILTCGTGIGMCITANKVPGIRAAVCYDVFSTERSRKSNDAQIMCLGERVIGVELAKSLIDVWFKCEFAGGGSAPKVKRINEIDAKYNKR

SEQ ID NO: 2008 - protein, 151 aa, Pasteurella multocida
MKIAIGCDDAAYNLKVELIKFLTSLGIECDDFGAGAGDTTLYPNVAEKVAIAVAKGEYDRGILTCGTGIGMCITANKIPGIRAAVCHDVFSAERARKSNDAQIICFGERVIGVELAKALLKTWLACDFAGGGSTPKVAQINEIDSKYHRSL

SEQ ID NO: 2009 - protein, 157 aa, Azotobacter vinelandii
MNEPFSVAIGCDEAGFELKELLKRHIEDLGYRLKDFGCYSTDPVLYPDIATAVATAISAGQHRLGVLICGTGIGMAISANKIQGIRAAQAHDTYSAERARKSNDAQIVSIGARVIGPELAKNIVKSFLESEFEAGRSGPKVERIKAVEKADREQSPK

SEQ ID NO: 2010 - protein, 153 aa, Pseudomonas syringae
MNTPFPVAIGCDEAGYELKELLKRHIESLGYPVTDFGTHSTAAVLYPDIALAVATAINAGQQRLGVLVCGTGIGMAISANKVFGIRAAQAHDTYSAERARKSNDAQILSVGARVIGAELAKSIVKSFLESEFEAARSGAKVERINAIERDGHQ

SEQ ID NO: 2011 - protein, 153 aa, Pseudomonas syringae
MNTPFPVAIGCDEAGYELKELLKRHIESLGYPVTDFGTHSAAPVLYPDIALAVATAINAGQQRLGVLVCGTGIGMAISANKVFGIRAAQAHDTYSAERARKSNDAQILSIGARVIGTELAKSIVKSFLESEFEAARSGAKVERINAIERDGHQ

SEQ ID NO: 2012 - protein, 153 aa, Pseudomonas syringae
MNTPFPVAIGCDEAGYELKELLKRHIESLGYPVTDFGTHSTAPVLYPDIALAVATAINAGQQRLGVLVCGTGIGMAISANKVLGIRAAQAHDTYSAERARKSNDAQILSVGARVIGAELAKSIVKSFLESEFEAARSGAKVERINAIERDGHQ

SEQ ID NO: 2013 - protein, 141 aa, Reinekea sp. MED297
MIVALACDHAGFYYKESIRKALLERGVSVQDFGAHSEEPVDYPDIVRPAAEAVARNDCQRGIIVGGSGNEAIVANRIRGIRCAVVWNLRTAELSMAHGNCNMIAIGQRMMTETDALAIVDHWLAATFAGGRHQRRIDKIDV

SEQ ID NO: 2014 - protein, 146 aa, Vibrio harveyi
MKIAIGCDHVGIEHKELVIKHLESKGIEVIDFGTHSAERTDYPQYGLAVAKAVTSGDADQGLLICGTGVGISLAANKVPGIRAVVCSDPYTAQLSKQHNNTNILAFGSRVIGIELAKMIIDSWLEAKFEGGRHQNRVNQIAEIEER

SEQ ID NO: 2015 - protein, 148 aa, Vibrio shilonii AK1
MIAIGCDDAAVDLKECLKAHLAAKGIEYVDYGIDPENASLYPDIAKEVSLAVSAGKHERGIILCGTGIGVSIVANKVPGIRAALCHDTFSAERARKSNDAQIITMGSRVIGSELAKAILDTWLDSEFSDGPSTPKVNRIKEIEKEFIG

SEQ ID NO: 2016 - protein, 148 aa, Magnetococcus sp. MC-1
MRIFFACDHGASELKQHLMAYLAKRDRVELVDLGCDGTTSVDYPDYAATLCKAVLASAGDRGVLLCGTGIGISIAANRFAGIRAALCHDAYTARLCREHNDANVLVLGGRTTGPAVAEEMLDLWLDTPYAGGRHQRRLDKIESNAREV

SEQ ID NO: 2017 - protein, 168 aa, Brachyspira hyodysenteriae WA1
MLLLIDYYNNKIYMKEIKTMKIAIGCDHSAVELKKEIIKYLEELGHNVTDFGTHTTESVDYPIYGKKVADAIVSKECECGVLICGTGIGISLAANKVKGIRAAVCSEPYSAKLSKQHNNSNIIAFGARVVGVDLAKMIVKEWLDAEYEGGRHARRVDLLTKIENGEEI

SEQ ID NO: 2018 - protein, 149 aa, Brachyspira murdochii DSM 12563
MKIAIGGDHSSIELKKEITRYLEELGHDVKDFGTYTPESVDYPIYGKKVADEVASGRYEGGVLICGTGIGISLAANKVKGIRAAVCSEPYSAKLSKQHNNSNIIAFGARVVGVDLAKMIVKEWLDAEYEGGRHSRRVELLTKIENGEEI

SEQ ID NO: 2019 - protein, 145 aa, Leptospira biflexa
MKEKIGIATDHGGFALKEFLRKSLEETYEMVDYGTKSEESVDYPTIIGDACRKVLSNEVPRLIALCGTGIGASIAANRMKGIRAALCHDEFTAEMSRRHNNANVLVLGGRVLGTDLALRIVKKWIETDFEGGRHQKRLGLIEEQS

SEQ ID NO: 2020 - protein, 145 aa, Leptospira borgpetersenii
MKKIGIASDHGGFELKEFLRDSLSRELEIIDYGTKNETSVDYPIVISEACKKVLSKEVEGLIALCGTGIGASIAANRMKGIRAALCHDQFTAEMSKRHNNANVLVLGGRIVGKELALNIVRTWVNTVFEGGRHERRVNQLESLNS

SEQ ID NO: 2021 - protein, 145 aa, Leptospira interrogans
MKKIGIASDHGGFELKEFLRKSLAGELEIVDYGTKDESSVDYPIVISAACKKVLSKEVEGLIALCGTGIGASIAANRMSGIRAALCHDQFTAEMSKRHNNANVLVLGGRIIGKELALNIVRTWINTSFEGGRHERRVNQLETLNS

SEQ ID NO: 2022 - protein, 150 aa, Treponema denticola
MKIGFGSDHSGVALKHILMEHVRNKGYECVDYGAADSKVPANYAEFGLKVAEAIKSQEVEKGVMVCGSGVGISLAANKVPGVRAAACSEPCTAKLAVEHSDINAVAMGVCIVGPEEAKMIVDAFLDARFEGGVYTERVDTLSAIERKYGK

SEQ ID NO: 2023 - protein, 150 aa, Treponema vincentii ATCC 35580
MKVGFGCDHASVGLKHILMEHVRNKGYECVDYGTTDPKVPVDYPEFGLKVAEAIKSKEVEKGILICGSGIGISLAANKVPGIRAAACSEPCTAKLAVEHSDINIVSMGVCIVGPEIAKAIVDAFFDAQFEGGSYTKRVNMIGDIEKKYGK

SEQ ID NO: 2024 - protein, 146 aa, Acholeplasma laidlawii
MKIGIGADHAGFNRKTEIIEYLTKKGYDVVDFGAHSVDRVDYPDYAKTVSEAVVNKEVEVGLLVCGTGIGMSIAANKVKGIRAAHVFDELTARLAREHNHANVIAFGGRNQTTSESKIIVDAYLNAHEESRHQHRVDKIAAIENGE

SEQ ID NO: 2025 - protein, 146 aa, Mesoplasma florum
MNKIYIANDHTAIEMKNAIKNHLEKKGYEVIDLGNNDGNSCNYANIGITLAEAVVADENNKGIALCGTGIGISIAANKVKGARAGLVYEVQTAELTRQHNNANILATGARLIAVDKALLLVDTFLNTEFEGGRHQERVGTLDEYNK

SEQ ID NO: 2026 - protein, 143 aa, Spiroplasma citri
MKIVIGNDHTGIDMKKAIVKHLIEQKHEIINLGTDSIEAVDYSDIGQAVGERVIKEKNSVGIIICGTGIGISIAANKVKGIRAALCNETVLAKLAREHNNANVLALGARVIANQNAIWIVDMFLNTTFDSGRHALRVEKLNNL

SEQ ID NO: 2027 - protein, 148 aa, Mycoplasma agalactiae
MKKGKVVLASDHGGCDLKNEIKDYVSNLGYETVDLGPEDSSKSISYAEQGHKLANYLLDNKDVSFGIGLCGTGLGISYALNRHNGIRAARVTSVEDANLAKLHNNANVLVMGGRQVNIEQAKAMIDEYINTAYEGGRHQARIDQIDKF

SEQ ID NO: 2028 - protein, 162 aa, Mycoplasma arthritidis
MIKNKIIITSDHAGHKMKMDLADKLRREGYVVETRGSSNEDETLSYSEVGIEFANEYLHDPQRDEKQFIALCGSGIGISTSLNRFKQIRCARVTNSEEARLARLHNNANILSFGGRLISLDQAYEIFKQWEATEFEGGRHIFRVLKLDEVGQDVDDVAETKE

SEQ ID NO: 2029 - protein, 144 aa, Mycoplasma conjunctivae
MYKRIAFASDHAGFQRKQELIDYYQKQGYEIIDLGPSDETSTSYATYGKKLATHLLENPDELAIGICGTGLGMSYALNRFKNVRAARITSENDAYLAKLHNDANALALSARFNSKEDSISFVNKFLDTRYEGGRHQDRIDELDK

SEQ ID NO: 2030 - protein, 178 aa, Mycoplasma fermentans
MEKFRKKDKFLPNFSRILLYHLKIDTKEANMAKKNIIALASDHGGCELKNEMRDYVKSLGYEVVDLGPADGSKSISYAEQGHNLAKYIDEHKNTIGLGFCGTGLGISYALNRHKHIRAARVVTVEDARLAKLHNNANVLVMGGRYVPFAEAQAMFNEYIKTEYEGGRHQARIDQIDEF

SEQ ID NO: 2031 - protein, 159 aa, Mycoplasma gallisepticum
MAIMDKRKIIFVADHTGVFLKQELISMLKTEYHNQYEVIDLGSDDEKSADDYPDFAFMLEDYFKDENTRNIGVAICGTGVGICIAANKIKNVRAGLVTDVQYAELAIQHDNCNVLVLGARTTSIDVNKEILRKFLSAQFEGGRHQRRVDKISNYEKKQD

SEQ ID NO: 2032 - protein, 152 aa, Mycoplasma genitalium
MSFNIFIASDHTGLTLKKIISEHLKTKQFNVVDLGPNYFDANDDYPDFAFLVADKVKKNSDKDLGILICGTGVGVCMAANKVKGVLAALVVSEKTAALARQHDNANVLCLSSRFVTDSENIKIVDDFLKANFEGGRHQRRIDKIIRYEKETE

SEQ ID NO: 2033 - protein, 155 aa, Mycoplasma hominis
MKTTVKITSDHAGYDAKINLAKRLENEGYNVELFGSKTNNNSDSYADAAIELVNEIHKDGNPDENKNVKYVAFCGSGIGIEMTLNKFKGIRAARVTNENESHLAKLHNNANVLCMGGRLLEGNEVEKIFHSWENTEFEGGRHLERIKKLSSIGEN

SEQ ID NO: 2034 - protein, 144 aa, Mycoplasma hyopneumoniae
MPKKFAITSDHAGFKRKEEIIEYLKNQGFEVNDLGPKNEESVSYAVYGNKLANFLLENPEQIGIAICGTGLGMSYALNRFKKIRAARVTSENDAYFAKLHNNANVIALSGRFNSKDESISFIKKFLETEYEGGRHQERIDELDK

SEQ ID NO: 2035 - protein, 144 aa, Mycoplasma hyopneumoniae
MPKKFAITSDHAGFKRKEEIVEYLKNQGFEVNDLGPKNEESVSYAVYGNKLANFLLENPEQIGIAICGTGLGMSYALNRFKKIRAARITSENDAYFAKLHNNANVIALSGRFNSKDESISFIKKFLETEYEGGRHQERIDELDK

SEQ ID NO: 2036 - protein, 144 aa, Mycoplasma hyopneumoniae
MPKKFAITSDHAGFKRKEEIIEYLKNQGFEVNDLGPKNEESVSYAVYGNKLANFLLENPEQIGIAICGTGLGMSYALNRFKKIRAARVTCENDAYLAKLHNNANVIALSGRFNSKDESISFIKKFLETEYEGGRHQERIDELDK

SEQ ID NO: 2037 - protein, 148 aa, Mycoplasma mobile
MKKSKFILASDHAGYKLKEEIKKYLIEKGLPYTDLGTNSETESVSYSEFGKKLGKYVHENPNDYGIGICGTGLGMSYAVNRFKNVRGARIHSVEDAHLAKQHNNANVLIFGGRQQKIEDIKKMIDEFINTEFEKGRHLDRIKDLDDEI

SEQ ID NO: 2038 - protein, 165 aa, Mycoplasma capricolum
MLKILKNIIVKYFKREVSMSNRIYIGNDHSAVEMKQAIVNHLKSKNYEVIDLGNNDGKSCNYAKIGQTVAEYVVKDTNSRGIVICGTGIGISIAANKVKNARAALVYEKETTELARIHNDANIIALGARMIAIPKAINLVDIFLNTPFEGGRHIERVDTLNEYKN

SEQ ID NO: 2039 - protein, 147 aa, Mycoplasma mycoides
MSNRIYIGNDHSAVEMKQAIVKHLQEKNYEVIDLGNNDGKSCNYAKIGQVVAEHVVSDTNSRGIVICGTGIGISIAANKVKTARAALVYEKETAELARIHNDANILALGARIIAISKAINLVDVFLNTPFEGGRHIERVNTLNEYKN

SEQ ID NO: 2040 - protein, 165 aa, Mycoplasma mycoides
MLKILKNIIVKYFKREVSMSNRIYIGNDHSAVEMKQAIVKHLQEKNYEVIDLGNNDGKSCNYAKIGQVVAEHVVNDTNSRGIVICGTGIGISIAANKVKTARAALVYEKETVELARIHNDANILALGARIIAISKAINLVDVFLNTPFEGGRHIERVNTLNEYKN

SEQ ID NO: 2041 - protein, 158 aa, Mycoplasma penetrans
MSESKKQLKKIKVYIGSDHGGFDMKEKIRNNHELLEILDFVDLGTYSGDESVDYPDYAEKIGENLLKDKGSYGIGICGTGIGICIALNKIKGIYAANVNKTIEAELAREHNNVNVITLSGRFTSVEDNVEIIKKFFSSHFESGRHEKRLDKITKLENK

SEQ ID NO: 2042 - protein, 152 aa, Mycoplasma pneumoniae
MQMNHPIYIASDHTGLELKSLVIKHLEQQKLQVIDLGPTELDPLDDYPDYAFLLAQTMQANPNSLGILICGTGVGVCMAANKAKGILAALVVDSKTAALARQHDDANVLCLSSRFVVPEENIKIVDEFLQAQFEGGRHSKRVGKIIAYEREK

SEQ ID NO: 2043 - protein, 155 aa, Mycoplasma pulmonis
MKKIAIASDHAGYSLKESIKKHYKDQNYEVIDLGTNSEESTSYSEYGHKLAEYMQNKDNKVDFGIGICGTGLGISYALNRHEGIIAARVTSEEDAYLAKAHNNANVLALGSRQISLEKAVKIIDKYQQSSFEGGRHIPRIEGIEIKDCFKKTKCS

SEQ ID NO: 2044 - protein, 147 aa, Mycoplasma synoviae
MNKVIPLASDHAGFELKERLEKHFQALGYKIVDLGAKSNLDSDNNYALAGHDLAHYMLENKCEFGIGICGTGLGISYALNRHNHIRAARVTSNEDAHLAKLHNDANVLVFGARQVSFDQAKEMIENYINTTFEGGRHLKRINDIDRT

SEQ ID NO: 2045 - protein, 154 aa, Ureaplasma parvum serovar 3 str. ATCC 700970
MIKKIYFGNDHAAYEIKDQIITHLKQKGYQIIDEGAQAALGSVDYSTYALKVANDVVNDTKNDSIGILLCGTGIGMNIAASKVHGTRVALVYNESSAKLAKEHNNANIITIGARENSLNQILKMIDDFLTSKFLGERHQKRLDIIAKYEKEQNS

SEQ ID NO: 2046 - protein, 153 aa, Ureaplasma urealyticum
MIKKIYFGNDHAAYEIKDQIIAHLKQKGYEIIDEGAQVELGSVNYSPYALKVANDVVNDAKNDSLGILLCGTGIGMNMAASKVKGARVALIYNESSAKLAKEHNNANVITIGARENSLEQIIKMIDDFLESKFVGERHQKRLDIITEYEKNQK

SEQ ID NO: 2047 - protein, 153 aa, Ureaplasma urealyticum
MIKKIYFGNDHAAYEIKDQIIAHLKQKGYEIIDEGAQVELGSVNYSPYALKVANDVVNDAKNDSLGILLCGTGIGMNMAASKVKGARVALIYNESSAKLAKEHNNANVITIGARENSLEQIIKMIDDFLESKFMGERHQKRLDIITEYEKNQK

SEQ ID NO: 2048 - protein, 147 aa, Mollicutes bacterium D7
MKIAMACDHGGLRLKNVLKDYLEANGYIVEDFGTYSEDSCDYPDYAGKAAKAVASGSCDRGVVVCGTGIGVSITANKVKGIRCALCHDVFSAKATRAHNDTNMIAMGQRVIGEGLALEILTAWLEGEYEGGRHDQRIAKMMAYEGEE

SEQ ID NO: 2049 - protein, 145 aa, Fervidobacterium nodosum
MKVAIGSDHAAFELKEKVKEYLRNKGIEVIDCGTYSIESVDYPDYAKKVAEKVKSKECHFGILMCGTGIGMSIAANKIKGIRAALCLFPDMATYARKHNDANVLVLPGRLMGIELAKWTVDAFLDSSFEGGRHERRVKKIEELEE

SEQ ID NO: 2050 - protein, 151 aa, Kosmotoga olearia TBF 19.5.1
MKVAIASDHAGFAMKKELIDFLSSAGYEITDYGTYSEESVDYPDYAAKVAEAVTEGTAERGILICGTGLGMSIAANRYKGVRAALCLYPEMARMTRKHNDANVLVLSGRLIGVELARRIVEVFFETGFEGGRHERRIRKIDDLPDLRRRSD

SEQ ID NO: 2051 - protein, 144 aa, Petrotoga mobilis SJ95
MKIAIASDHAGYEMKEQLKNYLLEKKFNIIDLGTNSNASVDYPDYAKKLGEKVTKGEADFGIGICGTGIGMSIAVNKVKGVRGALCLYPSMAEYARKHNDANVLVLAGRLMGIDLAIWTVVKFLSTDFEGGRHKRRVDKIDEIK

SEQ ID NO: 2052 - protein, 145 aa, Thermosipho africanus
MKIAIGSDHAGFELKNKLVDYLSKKGIEIIDVGTNSTESVDYPDYAKEVGKLVVNKDADFGILICGTGIGMSIAANKIKGIRAALCMIPEMGKLARNHNNANILVLPGRLIGFELATWIVEEFLNADFEGGRHERRINKIVELEK

SEQ ID NO: 2053 - protein, 145 aa, Thermosipho melanesiensis BI429
MKIAIGSDHAGFELKEKIKKYLMDKDIDVLDFGTDNKESVDYPDFAEKVGTSVKNKEVEFGILICGTGIGMSIAANKIKGIRAALCTIPEMASLARKHNNANILVLPGRLIGFELATWILDAFLNATFEGGRHERRISKISRLEE

SEQ ID NO: 2054 - protein, 145 aa, Thermotoga lettingae TMO
MKIAIGCDHAGFKLKEAIKGYLVSKGFNILDEGTYSEDSVDYPDFAAKVALDIKNQRADFGILICGTGIGMSIAANRIKGIRAALCLFPEMAKLARSHNNANILVLPGRFIAVELAQWIVDAFIEEKFEGGRHENRVQKIEEMDK

SEQ ID NO: 2055 - protein, 143 aa, Thermotoga neapolitana
MKIAIASDHAAFELKEKVKNYLLNKGIEVLDHGTHSEESVDYPDYAKKVVQSVLSNEVDYGILLCGTGLGMSIAANRYRGIRAALCLFPDMARLARSHNNANVLVLPGRLIGSELAFWIVDTFLSTPFDGGRHERRIRKIDEV

SEQ ID NO: 2056 - protein, 142 aa, unknown
  candidate division TM7 single-cell isolate TM7a
MKIVIGNDHAGVEFKNKIMQALRSKGYEIINVGTDTLDSVDYPDIAKEVSKKIINKEANFGILICGTGIGISIAANKINGIRAALCHNEYTARLSRLHNDANIIALGARVLGEDLGLACVETFINTEFEGGRHARRVGKIEQ

SEQ ID NO: 2057 - protein, 150 aa, Candidatus Cloacamonas acidaminovorans
MFDGGGKMKIAIASDHAGFEMKEAIKNAFPEIEFVDFGTHNTESMDYPDTGFPAAKAVAEKQCEKGILICGSGIGMSITANKVKGIRAALCGNTDVARLSRLHNDANILVLAGRFTAIPYAIEITKVWLNTPFEGGRHLNRINKIQQGER

SEQ ID NO: 2058 - protein, 163 aa, Thermobaculum terrenum ATCC BAA-798
MARRYVVGVGADGLGAELKNLIRDRLRDHPRVAEVVDFGVGDPSDSCEYPRVGIQVAEAVASGAIDRAVLVCGTGIGMAISANKVRGVRATVAYDPYSVERSVLSNNCQVLCLGARVVGPELAWYVVRQWLTYEFDPSSPSAHKIQLICDYEQGHLTNSGGDS

SEQ ID NO: 2059 - protein, 150 aa, Paramecium tetraurelia
MNQIKIFIGNDHAALDYKNTLLEYSKKKGYDIEDLGTHTNQSCDYNDYALNVCKEVIKSNAIGILICGSGVGISIMANKVKGIRCGQVNDYDSTLKALEIGCNVISFGARTVGIEIAKQIVDTFLSNQNRAKNHEVEKEIQSIEELTYGK

SEQ ID NO: 2060 - protein, 163 aa, Paramecium tetraurelia
MNTIRTITYYQFSKKNQYKIYIGNDHAGLEYKNIIIDHLKQQEYDIINRGTNTKQSCDYNEIATELCSDVLRDKGLGILICGSGVGMSIMSNKVKGIRCGQINDYNSAKQAAEIGCNVIALGSRILGIEVAKQVIDAFLNSYQNVHTEINETISQIEQDNFRK

SEQ ID NO: 2061 - protein, 176 aa, Perkinsus chesapeaki
MSSSTPQKLLFEPAAARLQNGLKLVFGSDHAGIDLKNEMIDFVKNTLKAPEGSITDVGTYTHDSVDYPDFAEKTCKTLLSTSDDTSKALGVVICGSGLGISMSANKCKGIRCALCSSNYDARYSRLHNNANVLAMGGRTTGVEVAREILATYINTDFEGGRHQKRIDKMMALEQKD

SEQ ID NO: 2062 - protein, 174 aa, Perkinsus marinus
MSTPQKLLFEPATARLQNGLKLVFGSDHAGIDLKNEMIDFVKNVLKAPEGCITDVGTYTHESIDYPDFAEKACKTLLSISNDTTKALGVVICGSGLGISMSANKCKGIRCALCSSNYDARYSRLHNNANVLAMGGRTTGVEVAREILATYINTDFEGGRHQKRIDKMMALENKN

SEQ ID NO: 2063 - protein, 176 aa, Perkinsus marinus
MEYQQTEKLLFAPAAERLQKGLKLVLCSDHAGIDLKNQVIDFIKNDLKAPEGCIEDVGCFTHDSVDYPDFAEKLGRKVVAVDDTTKLLGIAICGSGLGMSISVNKVKGIRCGLCHGNYDARYLRMHNNGNVLAMGGRTTGIEIAKEIVATFINTNFCGGRHQRRLDKISAIEQRGD

SEQ ID NO: 2064 - protein, 176 aa, Perkinsus marinus
MEYPQTEKLLFAPAAERLQKGLKLVFCSDHAGIDLKNQVIDFIKNDLKAPEGCIEDVGCFTHDSVDYPDFAEKLGRKVVAVDDTTKLLGIAICGSGLGMSISVNKVKGIRCGLCHGNYDARYLRMHNNGNVLAMGGRTTGIEIAKEIVATFINTNFCGGRHQRRLDKISAIEQRGD

SEQ ID NO: 2065 - protein, 146 aa, Entamoeba dispar
MEVIIGSDHAGFPLKEIVKKYLIEKGIKVDDMGTYSTERCDYPDFAEKVAREVLKTGKKGILVCGSGIGISIAANKINGIRCALCHDHYTAVMCRRHNDANIIAFGARVIGSDIATDMVDAFLSTPFDGMQHTARVEKIHKLEQNH

SEQ ID NO: 2066 - protein, 146 aa, Entamoeba histolytica
MEVIIGSDHAGFPLKEIVKKYLIEKGIKVNDMGTYSTERCDYPDFAEKVAREVVKTGKKGILVCGSGIGISIAANKINGVRCALCHDHYTAVMCRRHNDANIIAFGARVIGSDIATDMVDVFLSTPFDGMQHTARVEKIHKLEQNH

SEQ ID NO: 2067 - protein, 172 aa, Leishmania infantum
MPKRVALGCDHAAYATHQEIMDMVNASGAASKVMYMGPSSDTSVDYPDYAAQVCEAILKGEADTGILVCGTGIGMSIAANKFRGIRAALCYDHVTAQLSRQHNNAHILCIGVRTSGMEVIRDIIETFLTTEPLAEGRHGNRVDKITVIEEEQMKDEQRWCFSGCGGLKEEGK

SEQ ID NO: 2068 - protein, 172 aa, Leishmania major
MSKRVALGCDHAAYAAHREIMDMISASGAVSKVMYMGPSSDTSVDYPDYAAQVCEAILKGEADAGILVCGTGIGMSIAANKFRGIRAALCYDHVTAQLSRQHNNAHILCIGVRTSGMEIIRDIITTFLTTEPLAEGRHSNRVDKITVIEEEQMKDEQRCCFSGCGGRKEEGK

SEQ ID NO: 2069 - protein, 156 aa, Leishmania braziliensis
MSKRVALGCDHAAYDIHQEIMDMITTTGVVSKVIYMGPSSASSVDYPDYAAQVCEAILKGEADTGILVCGTGIGMSIAANKFSGIRAALCNDHVTAQLCRQHNNANVLCLGARTCGREILRDIIITFLTAEPSKEGRHGSRIAKITEIEREQMKKE

SEQ ID NO: 2070 - protein, 159 aa, Trypanosoma cruzi
MTRRVAIGTDHPAFAIHENLILYVKEAGDEFVPVYCGPKTAESVDYPDFASRVAEMVARKEVEFGVLACGSGIGMSIAANKVPGVRAALCHDHYTAAMSRIHNDANIVCVGERTTGVEVIREIIITFLQTPFSGEERHVRRIEKIRAIEASHAGKKGVQ

SEQ ID NO: 2071 - protein, 155 aa, Trypanosoma brucei
MTRKVAIGADHIGFPIHESIVRYVREAGEEFEPVYIGPHSLERVDYPDYALNVARMVARGEADVGILVCGSGIGMSIAANKVPGIRAALCFDHYTAVMARQHNDANVVCLGERTTGPAVLREIIMTFLQTPYSGEDRHTQRLEKIKAAESNTNGC

SEQ ID NO: 2072 - protein, 145 aa, Giardia intestinalis
MKVAFASDHGGRGLRLFLQQRAGANGYAVVDLGTESDASVDYPDFAKIGCEAVLSGRADCCVLICGTGIGISIAANKMKGIRCALCSSEYDAEMARKHNNANALALGGRTTGPEVASSILLRFLATEFEGGRHATRLEKIKAMEE

SEQ ID NO: 2073 - protein, 145 aa, Giardia lamblia ATCC 50803
MKVAFASDHGGRDLRMFLQQRASAHGYEVMDLGTESDASVDYPDFAKIGCEAVTSGRADCCILVCGTGIGISIAANKMKGIRCALCSTEYDAEMARKHNNANALALGGRTTGPEVAASILSRFLSTNFEGGRHAARIAKISAMEE

SEQ ID NO: 2074 - protein, 171 aa, Pyrenophora tritici-repentis
MTSPTPLRIAIGCDDAGVSYKNAIKADLEASPLVSTITDVGVPTNTDKTAYPHIAVNAAKLVTSGAADRALLICGTGLGVAIAANKVPGVRAVTAHDSFSVERAVLSNDAQVLCMGERVVGIELARRLVREWLGYRFDTASASAKKVDAIMEHERVNFKGLEADLEGAKGC

SEQ ID NO: 2075 - protein, 157 aa, Aspergillus nidulans FGSC A4
MSQSLRIVFAADEAGQPYKETLKEVLSKNPNVSEVLDVGVNSTSDKTAYPHPAVEGAKLIRDGKADRGLFICGTGLGVAISANKVPGIRAVTAHDSFSVERAILSNDAQVLCFGQRVIGLELAKRLANEWVTYKFDPNSSSAPKVQAIKDYEAEFAK

SEQ ID NO: 2076 - protein, 162 aa, Aspergillus clavatus
MSADLQPLRIVMACDEAGQPYKEIIKAALEKNPLVASVTDVGVNSTSDKTAYPHPAVAGAVLIKEGKADRGLFICGTGLGVAIAANKVPSIRAVTAHDPFSVERAILSNDAQVLCFGQRVIGIELAKKLANDWLTYRFDPQSASAAKVQAISDYEKQFATAQ

SEQ ID NO: 2077 - protein, 162 aa, Aspergillus flavus
MSADLKPLRIVMACDEAGQPYKETLKAALEKNPLVESVDDVGVNSTSDKTAYPHPAVAGAKLIKEGKADRGLFICGTGLGVAIAANKVPGIRAVTAHDSFSVERAILSNDAHVLCFGQRVIGIELAKKLANEWVTYRFDPKSASAAKVQAISDYEAEFAKAQ

SEQ ID NO: 2078 - protein, 162 aa, Aspergillus niger
MSADPKPLRIVVACDEAGQPYKETLKAALEKNPLVESIQDVGVNSTSDKTAYPHPAVAGAKLIKEGKADRGLFICGTGLGVAISANKVPGIRAVTAHDSFSVERSILSNDAQVLCFGQRVIGIELAKKLANEWVTYRFDPKSASAAKVQAISDYEKELAGTA

SEQ ID NO: 2079 - protein, 151 aa, Aspergillus oryzae
MACDEAGQPYKETLKAALEKNPLVESVDDVGVNSTSDKTAYPHPAVAGAKLIKEGKADRGLFICGTGLGVAIAANKVPGIRAVTAHDSFSVERAILSNDAHVLCFGQRVIGIELAKKLANEWVTYRFDPKSASAAKVQAISDYEAEFAKAQ

SEQ ID NO: 2080 - protein, 161 aa, Aspergillus terreus
MASPAPLRIVFACDEAGQPYKETLKAALEKNPLVSEILDVGVNSTSDKTAYPHPAVAGAKLIKEGKADRGLFICGTGLGVAISANKVPGIRAVTAHDSFSVERSILSNDAQVLCFGQRVIGIELAKKLANEWVTYRFDPKSASAAKVQAISDYEAQLAGAQ

SEQ ID NO: 2081 - protein, 153 aa, Aspergillus terreus
MACDDAGHDYKEAVKKALESNPLVDSIIDVGVDSPADKTAYPHPAVKAALLVRDGQADRALLICGTGMGVSIAANKVPGIRAVTAHDPFSVERAILSNNAQVLCFGQRVIGVELAKKLAAEWVQYRFDPKSASAEKIAMIHDYERTLAAGGGQ

SEQ ID NO: 2082 - protein, 159 aa, Penicillium chrysogenum
MSTPFRIVMACDEAGVPYKDAIKATLEKNPLVAEIIDVGVNSTSDKTAYPHPAVEGAKLIMDGKADRGLFICGTGLGVAIAANKVPGIRAVTAHDPFSVERSILSNDAQVLCMGQRVIGVELAKKLATDWLNYRFDPKSASAAKVQAITDYEVQFRTAA

SEQ ID NO: 2083 - protein, 160 aa, Penicillium marneffei
MGTDLKPLRIVMAGDEAGYDYKAAIKDLLEKSPLVESVVDVGATSLTDKTAYPHSAVEGAKLIAEGKADRGLFICGTGLGVAIAANKVPGIRAVTAHDPFSVERAILSNDAQILCFGQRVIGIELAKKLTLDWLNYRFDPKSGSAAKVQAISDYEKTLNA

SEQ ID NO: 2084 - protein, 162 aa, Neosartorya fischeri
MSTDLKPLRIVMACDEAGQPYKEIIKAALEKNPLVESITDVGVNSTSDKTAYPHPAVAGAKLIKEGNADRGLFICGTGLGVAIAANKVPGIRAVTAHDSFSVERSILSNDAQVLCFGQRVIGIELAKKLANEWLTYRFDPKSASAAKVQAITDYEREFAAAQ

SEQ ID NO: 2085 - protein, 158 aa, Ajellomyces dermatitidis
MTPAPLRIVMACDEAGHSYKETLKAHLSNNPLVASITDVGVPSADDKTAYPHVAVQAAQLIKEGKADRALLICGTGLGVAIAANKVAGIRAVTAHDPFSVERSVLSNDAQVLCFGQRVIGIELAKKLAADWLNYRFDTSSASSAKVKVIGEYEAKFAC

SEQ ID NO: 2086 - protein, 163 aa, Microsporum canis
MAASLPPLRIAVACDDAGHSYKEAIKAHLEKNPLVASITDVGVPAPTDKRAYPHVAVEAAHLIKDGKVDRALMICGTGLGVAIAANKVAGIRAVTAHDPFSVERSVLSNNAQVLCFGQRVIGIELAKKLVGDWLTYRFDESSASAEKVKAIGEYEAKFGESKQ

SEQ ID NO: 2087 - protein, 163 aa, Coccidioides immitis
MAATPLPPLRLAIACDDAGVSYKEALKAHLSDNPLVSSITDVGVTSTTDKTAYPHVAIQAAQLIKDGKVDRALMICGTGLGVAISANKVPGIRAVTAHDTFSVERAILSNDAQVLCFGQRVIGIELAKRLAGEWLTYRFDQKSASAQKVQAISDYEKKFVEVN

SEQ ID NO: 2088 - protein, 176 aa, Coccidioides posadasii C735 delta SOWgp
MAATPLPPLRLAIACDDAGVSYKEALKAHLSNNPLVSSITDVGVTSITDKTAYPHVAIQAAQLIKDGKVDRALMICGTGLGVAISANKVPGIRAVTAHDTFSVERAILSNDAQVLCFGQRVIGIELAKKLAGEWLTYRFDQKSASAQKVQAISDYEKKFVEGGTYGRVGKLDEFKK

SEQ ID NO: 2089 - protein, 158 aa, Paracoccidioides brasiliensis
MSPAPLRIVIACDEAGHSYKEILKAHLSSNPLVSSVTDVGVPSASDKTAYPHVAVQAAQLVKERKADRALLVCGTGLGVAIAANKVPGIRAVTAHDPFSVERAVLSNNAQVLCFGQRVIGIELAKKLAADWLNYRFDSSSASAAKVKIIGEYEAKFAC

SEQ ID NO: 2090 - protein, 158 aa, Paracoccidioides brasiliensis
MSLAPLRIVIACDEAGHSYKEILKAHLSSNPLVASVTDVGVPSASDKTAYPHVAVQAAQLVKERRADRALLICGTGLGVAIAANKVPGIRAVTAHDPFSVERAVLSNDAQVLCFGQRVIGIELAKKLAADWLNYRFDSSSASAAKVKIIGEYEAKLAC

SEQ ID NO: 2091 - protein, 163 aa, Uncinocarpus reesii
MATASLPPLRLAIACDDAGVSYKDTLKAHLSNNPLVSSITDVGVASSTDKTAYPHVAIQAAQLIKEGKVDRALMICGTGLGVAISANKVPGIRAVTAHDPFSVERAVLSNDAQVLCFGQRVIGIELAKKLASEWLTYRFDQKSASARKVETISEYEKKFGEVY

SEQ ID NO: 2092 - protein, 162 aa, Gibberella zeae
MPGLRIVIGGDDAGFPYKSIIAEALLNDPRVETVIDAGPSTESDKTAYSTFAIAAAEKVARGEADRALLICGTGLGVAIAANKVRGIRAVTAHDSFSVERSVLSNNAQVLCLGQRVVGIELAKRLVKEWLGYTFDPNSSSAAKVKIIEDYDRQQTLMTTVAT

SEQ ID NO: 2093 - protein, 156 aa, Nectria haematococca
MAPKWRIAMGCDEAGISYKNAIKQDFESDGRVEEVLDVGSNHHADKTPYPLRAAEAARLVAEGKADRALLICGTGLGVAISANKVKGIRAVTAHDSFSIERSVKSNNAQVLCFGERVIGLELARRLATEWLDYEFDPSSNSAKKVDEIVQLEAVAA

SEQ ID NO: 2094 - protein, 160 aa, Verticillium albo-atrum
MAVLSESRLRIAIGCDDAGVHYKDKIKQDFEKDPRVVLIEDVGSYTGDDKTAYPHRAASAAKLVADGTCDRALLICGTGLGVAITANKIKGVRAVTAHDSFSVERAVLSNNAQVLCMGERVVGLELARRLAKEWLGYRFDPQSASAAKVDAIVALESDSD

SEQ ID NO: 2095 - protein, 156 aa, Magnaporthe grisea
MPGLRIVLGGDDAGFAYKSTLAADLDADPRVASVDDVGPLADSDKTAYSTFAIRAAEKVASGEADRALLICGTGLGVAIAANKVPGVRAVTAHDSFSVERSVLSNDAQVLCIGQRVIGIELARRLVKEWLGYTFDPNSASAAKVKIINDYNADKSK

SEQ ID NO: 2096 - protein, 165 aa, Chaetomium globosum
MSSPKWRIVVGCDDAGVGYKNKIKADFAADDRVASVIDVGADDKTAYPHVAAKAAKLVASGECDRALLICGTGLGVAISANKIKGIRAVTAHDSFSVERAVLSNNAQVLCMGERVVGLELARRLAKEWLGYVFDESSPSAAKVAAIHEYEEGEGGLSGHEEVKGC

SEQ ID NO: 2097 - protein, 169 aa, Podospora anserina
MSSPQWKIAVGCDDAGVSYKNKIKEDFAADPRVISVVDVGATGKEDKTAYPHIAAAAAKLVASGEVDRALLICGTGLGVAIAANKIKGIRAVTAHDSFSVERAVLSNNAQVLCMGERVVGLELARRLAKEWLGYVFDEKSASAAKVAAIHEYEEGEHGLSGAAEEVKGC

SEQ ID NO: 2098 - protein, 173 aa, Neurospora crassa
MSTTTPQPRWRIAVGCDDAGINYKNKIKSDLSSDPRVISVIDVGVAHDSQDRSTAYPHIAAAAAKLVASGECDRALLICGTGLGVAIAANKIKGIRAVTAHDSFSVERAVLSNNAQVLCMGERVVGLELARRLAKEWLGYVFDESSASAEKVRAIHEYEGREGGREAEWVKGC

SEQ ID NO: 2099 - protein, 156 aa, Yarrowia lipolytica
MGFTIVVGCDEAGVDYKNRIKADLEKSPRVDKVIDVGVKASEDKTAYPNIAIAAAEKVASGEADRAILICGTGLGVAISANKVAGVRAVTAHDSFSVERSILSNNAQILCMGQRVVGIELARRLVAEWLTYEFDQTSASAAKVADIETYEKKHIAA

SEQ ID NO: 2100 - protein, 163 aa, Debaryomyces hansenii
MGQRIRIVVGCDQAGYEYKEAIKKDLQNNPLVESIKDIGVPSNTDSTSYPLIGIKAGEMIQTGEADRAILICGTGLGVAISANKVSEIRAVTAHDSFSVERSILSNNCQVLCMGQRVVGLELARRLASEWLTYIFDETSGSAAKVKALVDYEHKSPQVSSPNI

SEQ ID NO: 2101 - protein, 163 aa, Debaryomyces hansenii
MGQRIRIVVGCDQAGYEYKEAIKKDLQNNPLVESIKDIGVPSNTDSTSYPLIGIKAGEMIQTGEADRAILICGTGLGVAISANKVSEIRAVTAHDSFSVERSILSNNCQVLCMGQRVVGLELARRLASEWLTYIFDETSGSAAKVKALVDYEHKSPQVLLPNI

SEQ ID NO: 2102 - protein, 156 aa, Debaryomyces hansenii
MSNIKLRIVVGCDQAGYEYKEQIKKDLESNTNVEKVIDVGVDSNGSKTAYPLIGIDAAEKIAKGEAHRAILICGTGLGVAISANKVKGIRAVTAHDSFSVERSILSNNCQVLCMGQRVIGLELARRLVKEWLTYAFDQTSASAKKVTAIENYEGCA

SEQ ID NO: 2103 - protein, 156 aa, Pichia stipitis
MTTAGLRIVIGCDEAGFEYKQKLQQDLEKNDLVSEVIDIGINTKGDHLAYPHVGIKAGELIRDGKADRALLICGTGLGVAISANKVAGIRAVTAHDSFSVERSILSNNCHVLCMGQRVIGIELARRLVAEWLTYNFDESSASASKVAVLKRYESIC

SEQ ID NO: 2104 - protein, 169 aa, Cryptococcus neoformans var. neoformans JEC21
MSQPPYTIVLACDSAGHEYKSALKALLESDKRVKGVIDVGINKDASGKLEDTAYPHIAVDAARKVAKGEADRGLLICGTGMGVAISANKVPGIRASVAHDSFSVERLIKSNNAQILCLGQRVIGIELAKKLVAEWLGHVFDPSSASNDKVKVIHDYDGYEYEAVPGGCT

SEQ ID NO: 2105 - protein, 161 aa, Ustilago maydis
MAAPQQKWKIAFGCDEAGVDYKNALIKDFEADARVESVIDVGVPSNADKTAYPHVAVTAARKVASGEVDRALLICGTGLGVAIAANKVNGVRAVTAHDSYSVERAILSNDAQVLCMGQRVIGLELARKLAKEWLSYRFDASSASAAKVQAICSYEHAADKQ

SEQ ID NO: 2106 - protein, 144 aa, Trichomonas vaginalis
MKIVVGCDHGGFALKQTVIDTVKSLGHEVIDVGTNSTESVDYPDFAQAAAKEIESGNAQLGVLICGTGIGISIAANKCKGIRCALCHEHLTAQLCRQHNNANIVAMGARIIGPETAIDIVKTFLTTDFLGDRHERRVNKIMALE

SEQ ID NO: 2107 - protein, 144 aa, Trichomonas vaginalis
MKVVVGCDHGGFALKQTVIDTIKSLGHEVIDVGTNSTESVDYPDYAQKAAHEIQSGNAQFGVLICGTGIGISIAANKCKGIRCALCHEHLTAELCRQHNNANIVAMGARIIGPETAIDIVKTFLTTNFLGDRHERRVCKIMSLE

SEQ ID NO: 2108 - DNA, 660 bp, Escherichia coli
atgacgcaggatgaattgaaaaaagcagtaggatgggcggcacttcagtatgttcagcccggcaccattgttggtgtaggtacaggttccaccgccgcacactttattgacgcgctcggtacaatgaaaggccagattgaaggggccgtttccagttcagatgcttccactgaaaaactgaaaagcctcggcattcacgtttttgatctcaacgaagtcgacagccttggcatctacgttgatggcgcagatgaaatcaacggccacatgcaaatgatcaaaggcggcggcgcggcgctgacccgtgaaaaaatcattgcttcggttgcagaaaaatttatctgtattgcagacgcttccaagcaggttgatattctgggtaaattcccgctgccagtagaagttatcccgatggcacgtagtgcagtggcgcgtcagctggtgaaactgggcggtcgtccggaataccgtcagggcgtggtgaccgataatggcaacgtgatcctcgacgtccacggcatggaaatccttgacccgatagcgatggaaaacgccataaatgcgattcctggcgtggtgactgttggcttgtttgctaaccgtggcgcggacgttgcgctgattggcacacctgacggtgtcaaaaccattgtgaaatga

SEQ ID NO: 2109 - DNA, 660 bp, Enterobacter cloacae
atgacgcaggatgaactgaaaaaagcagtaggatgggccgctctccagtacgtgcagccgggtaccattgttggtgtcggtacgggatcaaccgcggcacactttatcgatgcgctgggcacgatgaaggggcaaatcgagggcgcggtttccagctctgatgcttccacggaaaagctgaaaagcctcggcattaccgttttcgatctcaacgaagtggatcgtctggggatttacgttgatggtgcggatgaaatcaacggccacatgcagatgatcaaaggcggcggcgcggcgctgacgcgcgagaagatcatcgcctccgttgcggacaagttcatctgcatcgcggatgcctccaagcaggtcgacattctgggtaatttcccactgccggtcgaagtgatcccaatggcgcgtagcgcggttgcccgtcagctggtgaagctgggcggtcgtccggaataccgtcagggcgtagtcaccgataacggtaacgtgatcctcgacgttcacggtctggaaattcttgacgcgattgcgctggaaaatgccatcaacgctatcccaggcgtagtgaccgtagggctattcgccaaccgtggcgcggatgtggcgctgatcggcaccgctgacggcgtgaaaaccatcgtaaaatga

SEQ ID NO: 2110 - DNA, 663 bp, Vibrio vulnificus
atgagcatgactcaagatgaaatgaaaaaagccgctggttgggcagcgctcaagtatgtggaaaaaggcagcattgttggcgtaggaacgggctcaacggttaatcacttcatcgatgctcttggaaccatgagtgaagagatcaaaggtgcggtatccagttctgttgcatcaacagaaaaacttgaagcgctaggcattaaaattttcgactgcaatgaagtcgcctctttagacatttacgttgatggcgcggacgaaatcaacgccgatcgtgaaatgatcaaaggcggtggcgcggcgctcactcgcgagaagatcgttgcagcgattgcggacaagtttatctgtatcgttgatggcacaaaggctgtcgatgttcttgggactttccctcttcctgttgaagtcatcccaatggctcgctcatacgttgcgcgtcaattggttaaacttggtggcgatccttgttaccgcgaaggggtgattactgacaacggtaacgtcatccttgatgtttacggtatgaagatcaccaatccaaaacagctggaagatcagatcaacgctattccaggcgtagtgactgtcggtctttttgctcatcgcggtgctgacgtggtcatcaccggcactccagaaggtgccaaaattgaggaataa

SEQ ID NO: 2111 - DNA, 684 bp, Thermus thermophilus
atggagcgccccctggagagctacaagaaggaggcggcccacgccgccatcgcctacgtccaggacgggatggtggtgggcctgggcacgggctccacggcccgctacgccgtcctcgagctcgcccggcgccttagggagggggagctgaagggcgtggtgggggtgcccacctcgagggccaccgaggagctcgccaagcgggaggggatccccctcgtggaccttccccctgagggggtggacctggccatagacggggcggacgagatcgccccgggccttgccctcatcaagggcatgggcggggccctcctccgggagaagatcgtggagcgcgtggccaaggagttcatcgtcatcgccgaccacaccaagaaggtgcccgtcctcggccggggcccggtgccggtggagatcgtccccttcggctaccgggcgaccctcaaggccatcgccgacctcgggggggagcccgagctccgcatggacggggacgagttctacttcaccgacggcggccacctcatcgccgactgccgcttcggccccatcggggaccccttgggcctgcaccgggccctcttggagatccccggggtggtggagacggggctcttcgtggggatggccacccgggccctggtggcggggccttttggggtggaggagcttctgccgtag

SEQ ID NO: 2112 - DNA, 810 bp, Chlamydomonas reinhardtii
atgatgctcaaggccagtcccgctgctcgcgctgctgctcgccctgctgctcgcaacgtgcgcatgatggccgcgccggtctcaacccagctgagccaggatgagctgaagaagcaggctgcctggaaggctgttgagtacgttaagagcggcatggtggttggcctgggcacgggctcgaccgctgcgttcgcggtggaccggatcggccagctgctgaaggagggcaagctgcagaacatcgtcggtgtgcccacctcgatccgcacctacgagcaggctctgtctctgggcattcctctggccactctggatgagcagcccaagctggacgtcgccatcgatggtgccgacgaggtggaccccaacctggacgtggtgaagggccgcggtggcgctcttctgcgcgaaaagatggtggagatggcctcggctaagtttgtttgcatcgtggacgactccaagctggtcgagggcctgggcggctccaagctggccatgccggtggagattgtgcagttctgccacaagtacaccctgcagcgcctggctaacctgcccgaggtgaagggctgcgaggctaagctgcgcatgaacggcgacaagccctacgtgaccgacaacagcaactacatcgtggacctgtacttccagacccctatcaaggattcccaggccgcctccaaggccatcctgggcctggacggtgtcgttgaccacggcctgttcctggacatggtggacgtgtgcatcatcgccggcgccaccggcgtcaccgtgcaggagcgccccaaccccaagaagcactaa

SEQ ID NO: 2113 - DNA, 870 bp, Spinacia oleracea
atggcttccgccgctttctctctcctcccctccacctcctccaccacctttaaccgccatgccaccaccaaactcctcaacctcaaattcctccacaaccaccgtaacaaacccttcttcaccaccacaatcaaatctctctcttctccctccccaacaccagtcttaactcaagacgatctcaagaaactcgccgccgaaaaagccgtcgactccgtcaaatccggcatggttctcggtctcggaaccggaagtactgccgcatttgctgtctcgcgaatcggcgagcttctctctgccggaaaactgaccaacatcgttggaattcctacctcgaagcggaccgcagagcaggcggcgtctcttggaattccgctctccgttctcgatgatcatcctcgaattgacctcgccattgatggcgccgatgaggttgatcctgatcttaatctggttaaggggcgcggtggggcgctcttgagagaaaagatggttgaagctgctagtgataaatttattgttgttgttgatgatactaagcttgttgatggtttgggtggtagtcgtcttgctatgcctgttgaagttgttcaattttgctggaaatataatctcaagagattacaggagatctttaaggagctgggttgtgaggcaaaattgagaatggaaggggatagcagtccttatgtgactgacaactcgaattacatcgtggatttatacttcccgacctcgattaaggatgctgaagctgcagggagagaaatttcggccttggaaggcgtagtagaacatgggttgttcttgggtatggctagcgaagtcatcattgctgggaaaactggagttagtgtgaaaaccaagtga

SEQ ID NO: 2114 - DNA, 798 bp, Arabidopsis thaliana
atggcgcttgcgtatgatcctctcttcattacatcggacaaatctttgtccgcctttgatgttgcctcttcaccgcctcagcccatgaatttaacacaagacgagctcaaacgtatcgccgcttacaaagccgtggaattcgtcgagtccggcatggttctcggtctcggaaccggctccaccgccaaacacgccgtcgaccgaatcggcgagcttctccgtcaaggcaaactcgagaacatcgttggtataccaacgtctaagaagacgcaggagcaggctctgtctctcggcatccctctctctgatctcgacgcacaccctgtcatcgatctctccatcgacggcgcagacgaggtcgacccttttctcaacctggtaaaaggcagaggagggtctctgcttcgagagaagatgatcgaaggagcttctaagaagtttgtggtgattgttgacgactccaagatggtgaagcatattggtggaagcaagcttgctcttccggtggagatagtgcccttttgctggaagttcacggcggagaagctccggagtctgctggaaggatacgggtgtgaagcgaatcttcggttgggagagaaagggaaggcctttgtgacagacaatgggaattacatagtggatatgcatgtggaagaggatatgggagatttgggagcagtgagtgatgcgattctgaggctaccgggagtagtggaacatgggatgtttctggatatggcttctactgttatcattgcaggtgagcttggtgttaagatcaagaacaaacactga

SEQ ID NO: 2115 - DNA, 804 bp, Arabidopsis thaliana
atgggttctgcattcgatccccttgtcacggccactgaggatctcgccgccgtcaactcggcgccgccactctcaaacctcacgcaagaagaactcaagaaaatcgccgcttataaagccgtcgaattcgtcgaatctggaatggttatcggtctcggcactggctccaccgcgaaacacgccgtggctcgtatcagcgagcttctccgagaaggaaaactcaaggatataatcggaatccctacttcaaccacaacgcatgagcaagcggtgtctctagggataccattatccgatctagattcgcatccggtggtggatctatcaatcgatggcgccgacgaagtcgatccggctcttaatctggtgaaaggacgcggcggatcgttattgagagagaagatgattgaaggagcatctaagaagttcgttgtgattgttgatgaatcgaagcttgtcaagtatatcggaggaagcggactcgctgttccggtggaggttgttccgttctgctgcgatttcacaagggggaaactggaagagctatttagagattcgggatgtgttgcgaagctgaggatgaaaatcggatctaacggcgaagaggcggcgccggctgtgacggataataggaattatgtggtggatttgtatttggagagagatattggagatttagaggtggcgagtgaggcgatattgaggtttcctggagtagtggagcatgggatgtttctgggaatggcgactacgttgatcgtcgccggcaaatttggtgttaccgtcaaggataggtttggataa

SEQ ID NO: 2116 - DNA, 711 bp, Plasmodium falciparum
atggacagtttaaaaaagatagttgcttataaagcagtagacgaatatgtacaatcgaatatgactataggcctgggaacaggttctacggttttctatgtgcttgaacgtattgataatttattaaaaagtggaaaattaaaagatgttgtatgtatacccacaagtatcgacacagaattgaaggcgagaaaactgggtatacccttgacgacattagaaaaacattcaaatattgatattaccatagatggaactgatgaaatagatttaaatttaaatttaataaaaggaagggggggagccttagttcgtgagaagcttgtcgcttctagttcgtcccttttcataataattggtgatgagtccaaattatgcacaaatggattgggcatgacaggggctgttcctatagaaatccttacatttggatatgaaaaaatcatagagaatttgttaaaaatatatacactcaaaggatgtacatataaaataagaaagagaaacggggagatatttattactgacaataaaaattatattgtagattttttttttactgagcctatacaagatttattagaaacatgtacaagaattaaaatgactacaggagttgttgatcatggtatttttgttaacatgacgaatgtggctttaataagtaaacacgatggaacagtattaacattaaacaaaaaatatgaataa

SEQ ID NO: 2117 - DNA, 690 bp, Pyrococcus horikoshii
atgaacgttgaagagatgaaaaagattgcagctaaagaggctttgaaattcattgaagatgacatggttatagggttagggacaggatcaacaacggcatacttcattaaactgttgggagagaaattaaagaggggagaaatatcggatatagtaggggttcctacatcttaccaggcaaagctacttgcgatagagcatgatattccaatagcttctttagatcaagttgatgccatagatgttgccgttgatggtgctgatgaggtggatcctaatttaaacttaattaaaggtaggggagcagcgttaacaatggaaaagatcattgaatatagggctggtacatttattgtcctggttgatgaaaggaagctcgtcgattacctctgtcaaaagatgccggttccaattgaggtaattccgcaggcgtggaaggcaataatagaagagctttctatctttaatgcaaaagctgaactaagaatgggggtcaataaagacggacccgtaatcacggataatgggaacttcataatagatgcgaagttccctaggatagatgatcccctggacatggagatagaactgaacacaattccgggggtaattgaaaacgggatatttgcagacatagcggatatagttatagttggaacgagagagggcgtcaagaaacttgaaaggtaa

SEQ ID NO: 2118 - DNA, 681 bp, Methanocaldococcus jannaschii DSM 2661
gtgtcaaatgaagatttaaaattaaaagtagctaaggaagcagtgaagttagttaaagatggaatggttattggattaggaaccggttcaacagcagctttattcatcagagaacttggaaatagaattagagaagaggagctaacagtcttcggaattccaacatcatttgaagctaaaatgctggctatgcagtatgaaattccattagttacattagatgagtacgatgttgatattgcctttgatggagctgatgaagttgaggaaacaactctctttttaataaaaggaggtggaggctgccatactcaagaaaaaatagttgattacaacgcaaatgaatttgttgttttagttgatgaaagtaaattagttaaaaaattaggggaaaagttcccaatccctgtggaagttattccttcagcttatagggttgtaataagagctttatcagaaatgggaggagaggcagtaattagattaggagacagaaaaagaggacctgttataacagacaacggaaatatgattattgatgtatttatgaacatagatgacgctatagaacttgagaaagaaattaataacattcctggagtagttgaaaatggtatctttacaaaggtagataaggttttagttggaactaaaaaaggagtaaaaacacttaaaaaataa

SEQ ID NO: 2119 - DNA, 690 bp, Fibrobacter succinogenes
atggcatcgatggacgaactcaagaaggctgcaggcgttcgcgccgcagacatgatcaaggacggaatgattgtcggtctcggcactggcagcacggcagctcacatggtgaaccgcctcgctgaacgcatcaagaccgaaggcatccacgtgacgggcgtttcgaccagctggagcacgacgctccaatgccgtagcctcggcatcccgctcaaggaaatgggcgaagtcagccacctcgacatggtgattgacggtgcagacgaaatcgacccgaaccgcaacctcatcaagggacgtggagcagcacacctcctcgaaaagattgtagcctccatgacggacaactatgtgattattgcagactccggcaaggctgtgcagcagctcggcaccaagttcgccgtccctctcgaaatcatcccgggcgctatcgccgtcgtcacagaacgcgtgaaaaagctcggtggcgaagtcaaggttcgcatgggcgctcctggcaaggacggtccggtgattagcgacagcggtaacctcatcgccgacgcgaagttcgcccccatcgcagacccggacaagctagcccgtgatctggaacacatcgtgggtatcgtcggacacggcctgttcatcaacatggcaacgaaagtcatcctcgctgacgaagccaagggcctgattgaattttag

SEQ ID NO: 2120 - DNA, 819 bp, Homo sapiens
atgcagcgccccgggcccttcagcaccctctacgggcgggtcttggccccgctgcccgggagggccgggggcgcggcctccggcggaggagggaacagctgggacctcccgggttcccacgtgcggctgccggggcgtgcacagtctgggacccgtggcggtgctggcaacacaagcaccagctgcggggactccaacagcatctgcccggccccctccacgatgtccaaggccgaggaggccaagaagctggcgggccgcgcggctgtggagaaccacgtgagggcccgccagctcatcctgcagtatggcttgaccctcagtgatctggatcgacacccagagatcgaccttgccatcgatggtgctgatgaagtagatgctgatctcaatctcatcaagggtggcggaggctgcctgacccaggagaagattgtggctggctatgctagtcgcttcatcgtgatcgctgatttcaggaaagattcgaagaatctcggggatcagtggcacaagggaatccccatcgaggtcatcccaatggcctatgtcccagtgagccgagctgtgagccagaagtttgggggcgtggttgaacttcgaatggctgtcaacaaggctggtcctgtggtgacagataatgggaattttatcttggactggaagtttgaccgggtacacaaatggagtgaagtgaatacagctatcaaaatgatcccaggtgtggtggacacaggcctattcatcaacatggctgagagagtctactttgggatgcaggatggctcagtgaacatgagggagaagcctttctgttga

SEQ ID NO: 2121 - DNA, 756 bp, Caenorhabditis elegans
atggtcacctccaccggccctgaagcagaactggctcctattgagcaggcgaagaaacgagctgcgtttgcctgcggtgaaaaatatgtgcaaagtggttgccgtcttggtgttggatccggaagcactgtcaagtatttggtagaatatcttaaacaaggatttcagaatggaagtctcaaggatatcatctgtgttccaaccagttttttgacaaaacaatggctgattgagtctggtctccctgtctccgatttggattcacatccagaactggatgtgtgtattgatggagctgatgaagttgacggacagttcacgtgcatcaaaggcggaggtggatgtctggctcaagaaaaaattgttcaaaccgctgcaaaaaacttttacgtgatcgctgattatttaaaagattccaaacacttgggtgatcgctatccgaatgtcccaattgaggttctacctcttgctgctcaaccacttctacgttcgattccacgcgctgaaggtggaagctgtcaacttcgacaagctgtcaaaaagtgcggaccaattgtgacagacaatggaaacttcattattgattggcagttcgagaaaaacgtatccggaagagattggttcgcgattcagcaacgattggccaatacaccaggaattgttgaaaccggattattcatcggttgcgtcgacgcagtattcttcgcgtactctgacggatctgtcaaggaaattgtcaattccaagaagcactga

SEQ ID NO: 2122 - DNA, 777 bp, Saccharomyces cerevisiae
atggctgccggtgtcccaaaaattgatgcgttagaatctttgggcaatcctttggaggatgccaagagagctgcagcatacagagcagttgatgaaaatttaaaatttgatgatcacaaaattattggaattggtagtggtagcacagtggtttatgttgccgaaagaattggacaatatttgcatgaccctaaattttatgaagtagcgtctaaattcatttgcattccaacaggattccaatcaagaaacttgattttggataacaagttgcaattaggctccattgaacagtatcctcgcattgatatagcgtttgacggtgctgatgaagtggatgagaatttacaattaattaaaggtggtggtgcttgtctatttcaagaaaaattggttagtactagtgctaaaaccttcattgtcgttgctgattcaagaaaaaagtcaccaaaacatttaggtaagaactggaggcaaggtgttcccattgaaattgtaccttcctcatacgtgagggtcaagaatgatctattagaacaattgcatgctgaaaaagttgacatcagacaaggaggttctgctaaagcaggtcctgttgtaactgacaataataacttcattatcgatgcggatttcggtgaaatttccgatccaagaaaattgcatagagaaatcaaactgttagtgggcgtggtggaaacaggtttattcatcgacaacgcttcaaaagcctacttcggtaattctgacggtagtgttgaagttaccgaaaagtga

SEQ ID NO: 2123 - DNA, 714 bp, Chromohalobacter salexigens DSM 3043
atgggcaccgcacttcgctttactcgccaagacggacacgacatgacccaggacgaactcaagcgcgcggtggccgccgccgccatcgaggaaatcacgcccttgctggggcgcgacaccatcatcggcgtgggcaccgggtccaccgccaacttcttcgtggacctcctcgccgagcacaagcatgacttcctcggcgcggtggcaagctcggaagccacggccaagcgcctgcgcgatcacggcatcgacgtttacgagctcaatcacgtgggcacggtgccggtctatgtcgacggcgccgacgagatcgatgcgcacttcaacatgatcaagggcggcggtgcggcgctgacgcgggagaagatcgtcgcggcctgcgcggaacgtttcgtgtgcattgccgacgcttccaagcgcgtcgacgtgctcggcggctttccgctgcccatcgaggtgatccccatggcgcgttcctacgtggcgcgggagatggtcaagctgggcatcacgccggtctaccgcgacggcgtggtcaccgacaacggcaaccagatcctcgacggttacgaatgcctgttcgaggaccccagggccatggagcagcgcctcaacaacatcgtcggcgtggtgaccaacgggctcttcgctcagcgcggtgcggatgtgctgctgctgggaacggagcatggcgtcgagcgccacacgccctga

SEQ ID NO: 2124 - DNA, 783 bp, Citreicella sp. SE45
atgaccggagagctttcgccgatcgacaaggccaagttcgtcgcagccaagcgcgccgccgaattcgtcgaggacgggatgcgggtcgggctcggcaccggctccaccgccgcctggctcgtccgctgccttggcgagaaggtgcgcgaggaggggctgaggttccgcggcgttccgacctcgacccgcacggcagagctggcccgcgaggttggcatcgaggtgatcacgctggaagaggcgcgctggctcgacctcaccatcgacggcgccgacgaattcgacggcgagctgagcctgatcaagggcggcggcggcgcgctgctgcaggaaaagatcgtggccaccgcctcggaccagatggtcgtcatcgccgacgccgccaaggaggtcgggacgctgggcgccttcccgctgccggtcgaggtcattcccttcggctggaccgcgtcgcaggcgctcatcgaagaggcgctggtctcgatggacgtgatgggccgccagatcacgctgcggatggacggcgacgccgcctaccgcacggacgagagcaacttcatcctggacctgcacctgacgcgcatcggcaacccgcgccagctggcgctgatcctgaaccagatcccgggcgtggtcgagaacggactcttcatcgacatctgcgaccaggtggtgatcggctacggcgacggccgggtcgaggtgcgcgacatcaacgcgggcaccacctcggaggagcagatcgcgctcgccgaaaacgacaacctgttccgcgacatctga

SEQ ID NO: 2125 - DNA, 783 bp, Roseovarius sp. HTCC2601
atgagcggagagctttcgcccatcgacaaggccaagttcgtggcggccaaacgtgccgcggaattcgttcagagcggcatgcgcgtcgggctcggcaccggctccactgccgcctggctggtgcgctgcctcggcgagaaggtgcgcgaggaggggctgcgcttccgcggcgtgccgacctcgacccgcaccgccgagctcgcccgcgaggtgggtatcgaggtgatctcgctcgacgaggccggctggctcgacctgaccatcgacggcgccgacgagttcgacagcgaactcaacctgatcaagggcggcggcggcgcgctgctgcaggaaaagatcgtcgccaccgcctcggacgagatgatcgtcatcgccgatgccgcaaagcacgtggaaacccttggcgctttcccgctgccggtcgaggtcatcccgttcggctggaccgcgagccaggcgctgctcgaagaggcgctggtgaccatggacgtgctgggccgcaagaccacgctgcggatgaacggtgagcgcccctacatcaccgacgagggcaactacattctcgacctgcacctgtcgcgcatcggcaatgcccggcagctggcgatgctggtcaaccagatccccggcgtggtcgagaacggcctgttcatcgacatctgcgaccgtgtgatcatcggctacggggacggccgggtcgaaacccgcgacatcaatgccggtaccgtctcggaagagcgcgtcgagtttgtcgaggacgacaacctcttccgcgacatctga

SEQ ID NO: 2126 - DNA, 783 bp, Sagittula stellata
atgtccggagagctgtcgcccatcgacaaggccaagttcgtcgccgccaaacgcgcggcggaattcgtggaatcgggcatgcgtgtcggtctggggaccggctccaccgccgcatggctggtgcgctgcctcggagaactggtgcgcgaggaagggctgcggttcaaaggcgtgccgacatcgacccgcaccgcggaactggcgcgcgacgtggggatcgaggtgatctcgctcgacgaggcgaagtggctcgacctgacgatcgacggcgccgatgaattcgacgaggagctgtcgctgatcaagggcgggggcggcgcgcttctgcaggagaagatcgtggccaccgcctctgaccagatggtggtgatcgccgatgcggcgaaggaagtcggccaccttggcgccttccccctgccggtcgaagttatccccttcggctggcagacctccctggcgctgatcgaggagatgctgatctccatggacgtgatgggccgcaaggcgacgctccggatgaacggcgaccggccgtatatcaccgatgaggcgaaccacatcctcgacctgcacctgacccggatcggcaacccgcggcagctgtcgatggtgttgaaccagatccccggcgtcgtggagaacgggctgttcatcgacatctgcgacaaggtggtgatcggtcacggcgacggacgtgtcgaggtgcgcgacatcaacgaaggcaccgtgaccgaaacccagctcgatttcgtcgaggacgacaacctcttccgcgacatctga

SEQ ID NO: 2127 - DNA, 789 bp, Roseobacter sp. MED193
atgaccggagaactgtcccccatcgacaaagccaaatttgtcgctgccaagcaggcatcgggattggtggaggatggtatgcgggttggattggggacgggctcaaccgctgcctggctggtgcgctgtctcggagagatggtgcgcgaggaggggttgaagttcactgctgttcctacctcgacccggaccgcagaactggcccgcgaagtgggtattcccgtcacctcgctcgatgaggcaaaatggttggatctgaccattgacggggccgatgaatttgatcgcgacctcaatctgatcaagggcggtggcggtgctttgttacaagaaaaaatcgtggcgacggcttctgatcaaatggtagtgatcgctgatgcgggcaaagaggtcgaaaacctcggcgcttttcccttgccggtagagatcattcccttcggctggcagaccagccaggctctgatcgaagaaacccttgtttccatggacgtattggggcggtctgccaccttgcggatgaacggagatcgggcctttatgaccgatgaggggaaccatattctcgacctgcatctgaaccggattggcaatgcacgtcagctggcgctggtgattaaccagatcccaggtgtggttgaaaacggcttgttcatagatatctgtgacaccgtcatcatcggctacggggatggcaatgtagaagtgcgagatatcaacgaaggcacggtagagcgcgaaaaactggattttgtcgaaagtgacaatctgttttccgatctctccgactaa

SEQ ID NO: 2128 - DNA, 789 bp, Roseobacter sp. SK209-2-6
atgagcggagaactctcaccgattgacaaagccaaattcgttgctgccaagcaggcggcggggctggttgagagtggcatgcgggttgggctgggaactggctccaccgcagcatggctggtgcgctgcctgggggagatggtgcgcgaggaagggctgcgcttcacggcaatccccacctccacccgaaccgctgaactggcccgtgagttgggtatcaaagtgacctctctggatgaggccaaatggctggatctgaccatcgatggggcggatgagtttgataaggatctaaacctcatcaaggggggtggcggcgcgcttttgcaggaaaaaattgtcgcgaccgcctctgaccaaatggtagtgattgcggatgctggcaaagaggtcgagtgcctcggagcctttccactgcccttggaagtcattccctttggctggcaaacctcgcaggcgcttttggaagaaagccttatttccatggatgttttgggtcgcaacgccacattgcggatgaacggagatgcgccctttgtgacggatgagggcaactatattcttgatctgcaccttaaacggatcggcaatgcgcgccagctctctttggtggtcaatcagatcccgggtgtggttgagaacgggttgttcatcgatatctgtgacacagtgatcatcggttacggcgatggcaatgtcgaaacacgggacatcaacgaaggcacgatagagcgggaaaaactcgattttgtcgaaagcgacaatctgtttaccgatctttctgactaa

SEQ ID NO: 2129 - DNA, 789 bp, Phaeobacter gallaeciensis 2.10
atgaccggagaattatcccccatcgacaaggccaaatttgttgccgccaaacgtgcggcggagatggttgaggatggcatgcgcgtcgggctgggcacaggctccacagccgcctggctggtgcgctgtctgggcgacatggttcaaaacgacggtctgcgcatcaagggcgtgccgacctccacccgcacggcggagctggcccgggatgtggggatcgagatcctgacactggatgaggcgaaatggctggatctgaccattgacggggcggatgaatttgaccgcgatctgaacctgatcaagggtggtggcggggcgttgctgcaggagaagattgtcgccacagcctcggaccggatggtggtgattgccgacaaggccaaggaggtcgagagccttggcgcctttcccctgccggtggaggtgatcccctttggctggcagaccacgcaagcgctgctggaggagactttggtggcgatggaggtcatggggcgcaaaaccaccctgcggatgaacggggatgcggcgctggtgacggatgagggcaatcatattctggatctgcatctcaaccgtatcggcaatgtccggcaaatggcgctggtgctgaaccagatccccggcgtggttgagaacgggctgttcatcgacatctgtgacaccgtggtggtgggctacggcgatggcaaggttgaggtgcgcgacatcaacgagggcacggtggagaccgaccggctggattttgtcgagagtgaaaacctgttcacggatctgagtgactga

SEQ ID NO: 2130 - DNA, 789 bp, Phaeobacter gallaeciensis BS107
atgaccggagaattatcccccatcgacaaggccaaatttgttgccgccaaacgtgcggcggagatggttgaggatggcatgcgcgtggggctgggcacaggctccacagccgcctggctggtgcgctgtctgggcgacatggttcaaaacgacggtctgcgcatcaagggcgtgccgacctccacccgcaccgcggagctggcccgggatgtggggatcgagaccctgacactggatgaggcgaaatggctggatctgaccattgacggggcggatgaatttgaccgcgatctgaacctgatcaagggtggtggcggggcgttgctgcaggagaagattgtcgccacagcctcggatcggatggtggtgattgccgacaaggccaaggaggtcgagagccttggcgcctttcccctgccggtcgaggtgatcccctttggctggcagaccacgcaggcgctgctggaggagactttggtggcgatggaggtcatggggcgcaaaaccaccctgcggatgaacggggatgcggcgctggtgacggatgagggcaatcatattctggatctgcatctcaaccgtatcggcaatgtccggcaaatggcgctggtgctgaaccagatccccggcgtggttgagaacgggttgttcatcgacatctgtgacaccgtggtggtgggctacggcgatggcaaggttgaggtgcgcgacatcaacgagggcacggtggagaccgaccggcttgattttgtcgagagtgaaaacctgttcacggatctgagtgactga

SEQ ID NO: 2131 - DNA, 789 bp, Ruegeria sp. R11
atgaccggagagctgtcgcccatcgacaaggccaaatttgtcgctgccaaacgtgcggcggaaatggttgaggatggtatgcgggttggcctggggaccggatcaacggccgcctggctggtgcggtgcctgggggagatggtgcgcagcgaaggtctgcgtatcaagggggtgccgacctcgacccggacggcagagctggcgcgcgaggtcgggattgatatcatctctctggatgaagccaaatggctggatctgaccattgatggtgctgacgaatttgacggggatctgaacctcatcaagggtggtggcggtgcgttgttgcaggaaaagattgtcgccaccgcctcggaccggatggtggtcattgccgacaaggccaaggaagtcgaaacccttggggcgtttccgctgccggtcgaggtgatcccctttggctggcagaccacgcaggcgctggtggaagagacgctggttgcgatgaatgtgatggggcgcaagaccacgctgcgcatgaatggcgatgccgcctttgtgacggatgagggcaaccacatccttgatctgcacctcaatcgcatcggcaacgcccgccaattggcgctggtgatgaaccagatccccggcgtggtcgaaaatggcctgttcatcgatatctgcgataccgttgtggtgggctatggtgatggcaaggtcgaagtgcgcgacatcaacgagggcacgattgaaactgaccggctggagttcatggaaagcgacaatctgtttgcagatcttggcgactga

SEQ ID NO: 2132 - DNA, 789 bp, Ruegeria sp. TM1040
atgagcggcgatctatcccccatcgacaaggcgaaattcgtggctgccaaacgcgcggcagagctggtggaggacggcatgcgtgtcggactgggcaccgggtccaccgccgcgtggctggtgcggtgtcttggcgaaatggtgcgcgaggacgggctcaagatcaccggcgtgccgacctctgcccgtaccgccgagctggcgcgcgaggtcgggattgagctgatcaccctggatgaggcgcgctggctcgacctcacgattgacggtgcggatgaattcgacagcgaactcaatctcatcaagggcgggggaggcgcgctcttgcaggaaaagatcgtcgcgacggcctccgatcagatggtggtgatcgccgacaaggccaaggaagtggagacgctgggggccttcccgctgcccatcgaggtaatcccctttggctggcagacctcgcaggcgctggtggaagagacgctgatctcgatggatgtaatggggcgcagctcgacgttgcggatgaatggtgccagcccctatgtgaccgacgagggcaatcacatccttgatctgcatctcaaccggatcggcaatccgcgccagctggcgttggtgctgaaccagatccccggcgtggttgagaacgggctgttcatcgacatctgcgacacggtggtgatcggctatggcgatggcaaggtcgaggtgcgcgacatcaacgagggcactatcgagacggaccggatcgattttgtcgagaccgacaatctctttgcggatttgaacgactga

SEQ ID NO: 2133 - DNA, 789 bp, Silicibacter sp. TrichCH4B
atgagcggcgagctatcccccatcgataaagccaaatttgtggcagccaaacgcgcggctgagctggttgaggacggcatgcgcgtggggctcggcaccgggtcaaccgccgcatggctggtgcgctgtctgggtgagatggtgcgcgaggatgggttgaagatcaccggcgtgcccacctctgcccgcacggcggaactggcgcgcgaagtggggattgaggtgattaccctcgacgaggcgcgttggctggatctgaccatcgacggtgcggatgagttcgacggcgatctgaacctcatcaaaggcggcggcggcgcgctgttgcaggaaaagatcgttgcgactgcgtccgatcagatggtggtgattgccgataaggccaaggaggtcgaaatgctcggggcgtttccgttgcccatcgaggtgatcccctttggctggcagacctcgcaggccctggtcgaggagacgttgatctcgatggatgtgatggggcgcagctcgacgcttcggatgaatggggccagcccctatgtaaccgatgagggcaatcatatcctggatttgcacctcaaccgcattggcaatccgcggcaattggcgctggttctcaaccagataccgggagttgttgagaatgggttgtttatcgacatctgcgacacggtggtgatcggctatggtgacggcaaggtcgaggtgcgcgacatcaatgaaggcaccatcgagaccgaccggattgattttgtcgagacggacaatctgtttgcggatttgggggagtaa

SEQ ID NO: 2134 - DNA, 789 bp, Ruegeria pomeroyi DSS-3
atgaccggagaactctcgcccatcgacaaggcgaaattcgttgccgccaaacgggcggccgatctggtcgaggacgggatgcgcgtgggtctgggcaccggctcgaccgccgcctggctggtgcgctgcctgggcgacatggtgcgcaaggaagggttgaagatgcgcggcgtgccgacctcgacccggaccgcgcaactggcgcgagaggtggggatcgaggtgatcacgctggatgaggcgcgttggctggatatcaccatcgacggggcagacgagttcgacggcgacctgaacctgatcaagggcggcggcggtgcgctgctgcaggaaaagatcgtggcgactgcctctgaccagatggtggtgatcgccgatctgggcaaggaggtcagccggctgggtgcttttcccctgccggttgaggtgatcccgttcggctggcagaccacccaggcgctgctggaggagacgctgatctcgatggatgtgctggggcggacggcgaccttgcggatgaatggcgacacgccgtttgtcaccgacgagggcaatcatatcctcgaccttcacctgcaacggatcggcaatgcccggcagttggcgctggtgctgaaccagatccccggcgtggtggaaaatggcctgttcatagatatctgtgataccgttgtggtgggccatggcgacgggcgggtggaaatccgcgatatcaaccagggcacggtcgaacatgaccggctcgattttgtcgaaagcgacaacctgtttaccgatctggcggattga

SEQ ID NO: 2135 - DNA, 789 bp, Rhodobacterales bacterium Y4I
atgaccggagaactgtcgcccatcgacaaggcgaaattcgtagctgccaagcgggccgccgaaatggtggaggacgggatgcgggtcggcctcggcaccggctccaccgcggcctggctggtgcgctgcctgggcgagatggtggagaaggacgggttgaagatcaccgccgtgccgacctcgtcgcgcaccgccgcgctggcccgcgatgtgggcatcaacgtggtgtcgctggatgaggccaagtggctggacatgaccatcgacggcgccgatgagttcgatgccgacctgaacctgatcaagggcggcggcggcgcgcatctgcaggagaagatcgtcgccacggcctcggaccagatggtggtgattgcggacgccagcaaatcggtcgagaccctgggcgccttcccgctgccggtggaggtgctgcgcttcggctggcagagcagccaggcgctgatcgaggaaaccctggtgtcgatggacgtgatgggccgcagcaccaccctgcggatgaacggcgatgtgccgtttgtgaccgacgagggcaattatatcctggacctgcatctgcaccgcatcggcaacgcccgccagctggcgctggtgctgaaccagatccccggcgtgatcgagaacgggctgttcatcgacatctgcgacaccgtggtgatcggctatggcgacggccgggtcgaggtgcgcgacatcaacgaaggcactgtcgagaaggacaagctggagtttgtcgacaccgacaacctgttcaccgacctgcacgattga

SEQ ID NO: 2136 - DNA, 789 bp, Roseobacter sp. GAI101
atgtccggagaattatcacccattgataaggccaagtttgtcgctgccaaacgggcagcgcaatttgtcgaagacggcatgcgtgtcggacttggcaccggctcaaccgccgcgtggctggtacgctgtcttggcgaaatggtgcgcgacgacggtctgcgcatcaagggcgtgccgacatcgacacgcacggcgcagctggcacgcgaggtcgggatcgaagtcatcagcctggacgaggcgaagtggctggatctgaccatcgacggtgccgatgaatttgacggtgaactgaacctgatcaagggcggcggcggtgccttgttgcaagaaaagatcgtggcgaccgcctccgatcaaatggtggtgatcgccgatatcggcaaagaggtcgaaacgctcggggccttcccgctgccgatcgaagtgatcccctttggctggcagaccacgcaggcgctggtcgaagaaacgctgatctcgatggatgtgctggggcgcacgtcgaccctgcggatgaacggtgacattcccttcatcaccgacgaaggcaattacatcatggatttgcacctgaaccggattggcaatgcgcgccagttgtcgctggtgatgaaccagatgcccggcgttgttgaaaacgggctgttcattgatatctgtgatgcagtggtaatcggcttcggcgatggccgcgtcgaagtgcgcgacatcaatgcggggacggttgaccgtgataggcttgatttcgtcgagacagacaatctgttcacggacctgagcgactaa

SEQ ID NO: 2137 - DNA, 789 bp, Sulfitobacter sp. EE-36
atgaccggagaattgtcacccatcgataaggccaaatttgtcgccgccaaacgcgctgcacaatttgtagaagacggaatgcgcgtcggattgggcaccggctctaccgccgcgtggctggtgcgctgcttgggcgagatggtgcgcgacgacggcttgcggatcaaaggcgtgcccacatcgacccgtaccgcgcagctggcgcgcgaagtggggatcgaggtgatcagccttgatgaagccaagtggctggacctgaccatcgatggcgcggacgagttcgacggagagctgaacctgatcaagggcggcggcggtgccttgctgcaagaaaagatcgtggccaccgcctccgatcaaatggtcgtgattgccgacatcggtaaagaggtcgaaacactgggcgcatttccccttccggtagaggttattccctttggctggcagaccacacaagcgcttgtcgaagagactttggtgtcgatggacgtgctggggcgcaattccacgctgcgtatgaacggcgacatccccttcgtgacggacgaggggaactacatccttgacctgcatctcaagcggatcggcaacacccgccagatggccttggtcatgaaccagatgccgggcgtagttgaaaacgggctattcattgatatctgtgatgccgtggtgatcggctatggcgatggccgcgtcgaagtgcgcgacatcaacgaaggcactgttgatcgcgataagatggagtttgtcgagacggataacctgttctccgacctgagcgattaa

SEQ ID NO: 2138 - DNA, 789 bp, Oceanibulbus indolifex HEL-45
atgtccggagaactatcacccatcgacaaggccaaattcgtggccgcgaagcgggcgtgtgactttgtggaagacgggatgcgtgtcgggcttggaacaggctccaccgccgcgtggctggtgcgctgtctgggcgagatggtgcgcgacgatgggctgcggatcaagggcgtgccgacgtcttcgcggaccgcgcaattggcgcgggatgtggggattgaggtgatctcgcttgatgaggcgaaatggctcgacctgacgattgacggcgcggatgaatttgacggcgatctgaacctgatcaaaggcggcggcggtgcgttgctgcaagaaaagatcgttgcgaccgcgagcgaccagatggtggtgatcgccgatatcggcaaagaggtgcagcatcttggtgcctttcccttgccgattgaagtgattccctttggctggcaaaccacgcaggcgctggtcgaagaaacgctgatctcgatggatgtgttgggccgcaactcgaccctgcggatgaacggcgaagtgcccttcatcaccgacgaggggaactacatccttgatctgcggctgaaccgtatcggcaacgcgcggcaactggcgctggtgctcaaccaaatgcctggtgtggtggagaacggcctgttcatcgacatttgtgacgcggttgtgatcggctacggggatggcagggtcgaggtgcgagacataaatgaaggcactgtggcgaccgatcggttggaatttgtcgagactgacaacctgttttccgacctgagcgactga

SEQ ID NO: 2139 - DNA, 789 bp, Oceanicola batsensis HTCC2597
atgtccggagagctgtcgccaatcgacaaggcaaaattcgttgccgccaagcggtccgtcgactttgtcgaggacgggatgcgcgtcggcctcggcaccgggtcgaccgccgcctggatggtccgctgtctcggcgaactggtgcgcgaggacgggctgaggatcaagggcgtgccgacgtccacccgcacggcgcagctggcgcgggaggtgggcatcgaggtgatctcgctcgacgaggcgaagtggctcgacctgacgatcgacggcgcggacgagttcgacagcagcctgaacctgatcaagggcggtggcggcgcgctgctgcaggaaaagatcgtcgcgaccgccagcgaccagatgatcgtgatcgcggatatcggcaagcaggtcgatgcgctcggcgccttcccgctgccgatcgaggtcatccccttcggctggcagacgacccaggcgctggtcgaggagacgctgatctcgatggacgttctgggccgcaactcgaccctgcggatgaacggtcagcgtcccttcgtgacggacgagggcaactacatcctcgatctgcacctcaaccgcatcggcgatgcccgccagctcgccatggtgctgaaccagatgccgggggtggtcgagaacgggctcttcatcgacatctgcgactgcgtcatcgtgggcttcggcgacggccgggtcgaggtgcgcgacatcaatgccggcacggtcgaggagagccggctcgatttcctcgaggacgacaacctgttctcggacctcagcgactga

SEQ ID NO: 2140 - DNA, 789 bp, Thalassiobium sp. R2A62
atgactggagaattgtcccccatcgacaaggctaaatttgtagccgcaaaaaaggcctgtgattatgtcgaatccggcatgcgcgttgggctgggatcgggatcaactgccgcatggctggtcaaatgtctgggtgaattggttcgtgaagacggattaaagattaaaggcgtgccaaccagcacccgcacagcagcgctggcccgcgaagtcgggatcgaggtcatttcgctggacgaggcaaaatggctggatgtgacaatcgatggagcggatgaatatgacgcgaatctcaacctgatcaaaggtggcggtggctcgttgttgcaggaaaaaatcgtagcaacagccagcgaccaaatggttgtgattgcggatattggcaaacaagtagaaacgctcggtgcgttcccacttccaatcgaagtgatcccatttggctggcaaacgaccaaggctttggtcgaagaaagtctgatcagtatggacgtcttggggcgcaatagtaccctacgactgaacggtgacacgccattcgtgacggacgaaggcaactttatcctcgatctccatctgaaccgcattgcgaacggccgccagcttagcctcgtgctgaaccaaatgcctggtgtcgtcgaaaacgggttgttcatcgacatctgtgacgcagttgtgatcggctatggggatggcaaggtcgaggtgcgcgacataaatgcaggcactgtagaagaaacacggttggattttgtcgagaacgacaatctctttatggacctaacagactaa

SEQ ID NO: 2141 - DNA, 807 bp, Roseovarius sp. 217
atgctgggagtcgctgccatgaccggagaattgtcgccgatcgacaaggccaagtttgtcgccgccaagcggtcggtggatttcgtcgaagacgggatgcgcgtgggtcttggcaccggatcgaccgccgcctggatggtgcgctgtttgggcgagatggtgcgcgagggcgggttgcgcattcgcggcgtaccgacatcgacgcgcacagcggaattggcgcgggaagtcggcattgaggtgatcagtctggatgaggccaagtggctggatctcacgattgacggggcggacgagttcgacagcaatctcaacctgatcaaaggtggcggcggtgcgctcttgcaggaaaagatcgtagcgacagcctcggatcagatgatcgtgattgccgatgtcggcaaggaagtggagacgctgggcgcgtttccccttccggttgaggtgatcccgtttggctggcagaccacaaaatcgctggtcgaggaattgctgatcaatatggatgtgctcggacgcaacacctcgctgcggatgaatggcgcgcggccgtttatcaccgatgagggcaattatatcctcgatctgcatctgggccggattggtgctgcgcatcaactgtcgatggcgctcaaccagatgccgggggtggtggagaacgggctgttccttgatatttgtgatgtggtcattctgggctatggcgatgggcgggtcgagacacgcgacatcaacgagggcacggtcgaggaagatcggctcgatttcgtcgagaccgacaatctctttcgtgatctgacggactga

SEQ ID NO: 2142 - DNA, 789 bp, Roseovarius sp. TM1035
atgaccggagaattgtcgccgattgacaaggccaaattcgttgccgccaagcggtcggtggatttcgtcgaggacgggatgcgcgtgggccttggcaccggatcaaccgccgcgtggatggtccgctgtctgggagagttggtgcgcgagggcggcttgcgcatacggggcgtgccgacatcgacgcgcacggcggaactggcgcgtgaggtggggatcgaggttatcagcctggatgaggcgaaatggctcgaccttacaattgacggggccgatgaatttgacagcaatctcaatctgatcaagggcggcggcggcgcgctcttgcaagaaaagatcgtggcgacagcctctgaccagatgatcgtgatcgccgatgtcggcaaggaggtcgagacgctgggcgccttccccctgccggtcgaggtgatcccctttggctggcagacgacgaaatcgctggtcgaggaactcttgatcaatatggatgtgctggggcgcgatgccacgctgcggatgaatggcgcgcggcccttcatcaccgatgagggcaattatattctcgatctgcatctggggcggattggggccgcgcatcaactctcgatggcgctcaatcagatgccgggggtggttgaaaacgggcttttcctcgatatctgcgatgtggtcattcttggctatggcgatggccgtgtggaaacccgcgacatcaacgaaggcaccgtggaggaagaccggctcgactttgtcgagaccgacaatctctttcgtgatctgacggattga

SEQ ID NO: 2143 - DNA, 789 bp, Roseobacter sp. AzwK-3b
atgaccggagaattgtcgcccatcgacaaggccaagttcgtcgccgccaaacgttccgtggactatgtcgaggacgggatgcgcgtcgggctgggcacaggatcgaccgccgcctggatggtccgctgtctgggcgagctcgtgcgcgaggacgggctgaagatcaagggcgtgcccacatcgacccgcaccgccgatcttgcccgcgaggtcggcatcgaagtcatcagcctcgacgaggcgcgctggctggacctgaccatcgacggcgccgatgaattcgacgccagcctcaacctgatcaagggcggcggcggcgcgctcttgcaggaaaagatcgtggccaccgccagcgaccagatgatcgtgatcgccgatgtcggcaaggaggtcgagaccctcggcgccttccccctcccgatcgaggtgatccccttcggctgggaaaccaccaagtcgctggtcgaagagatgctgatctcgatggatgtgctaggccgcgacgcgaccctgcggatgaatggcgaccggcctttcgtcaccgatgaggggaattacattctcgatctgcatctgggccggatcggcaagcccaatcagcttgccatggtgctcaaccagatgcccggcgtggtggaaaacgggctgttcatcgacatctgtgatatcgtgatcgtgggctatggcgatggccgggtggaaacccgcgacatcaacgaaggcacggtggccgaggatcgtctggattttcttgaatccgacaatctgttttccgatctgcaggactga

SEQ ID NO: 2144 - DNA, 789 bp, Roseovarius nubinhibens ISM
atgtcaggggaattgtcgcccatcgatcaggccaaattcgtcgccgcgaagaaggcggtggaatatgtcgaggacggcatgcgcgtcgggctcggcactggcagcacggcggcctggatggtgcgatgccttggcgaaatggtgcgcgaggacgggctgcgcatcaagggcgtgccgacctcgacccggaccgccgcgctggcgcaggagttgggcatcgacgtggtcagtctcgacgaggccaaatggctcgacctgacgattgacggggcggatgagttcgatggcgagctgaacctgatcaagggcggcggcggcgcgctcttgcaagaaaagatcgtggccaccgccagcgaccagatgatcgtgatcgccgatgtcggcaaggaggtcgaaagcctcgggcatttcccgctgcccatcgaagtgatcccctttggctggcagacgacccgggcgctggtcgaagaaatgctggtctcgatggatgtgctgggccgcgacgtgacgctgcggatgagcggcgaccggccctatgtgaccgatgagggcaatcacattctcgacctgcatctcggccggatcggcaacccgcgacaattgtcgatggtgctcaatcaagtgccgggggtcgttgaaaacgggctattcattgatatctgtgacattgtctgcgtgggctatggcgatggccgcgtggaagtgcgggacatcaatgacggcacggtgcgccaggaccggctcgatttcgtggaaagcgacaatctgttctcggacctgtcggactga

SEQ ID NO: 2145 - DNA, 789 bp, Octadecabacter antarcticus 238
atgtcgttcgaactgtccccaatcgacaaagccaaattcgtcgccgccaaacaagcgacccaatatgtgcaagatgggatgaaagtcggccttggaaccggatcaaccgccgcgtggctggttaagtgtttgggcgagatggttgaaaaagaaggattgaaaatcaagggtgtaccgacatcaacacgcaccgcagaactggcgcgcgatgtcgggattgaggtcatttcactggacgaagccaagtggttggatctgacaattgacggcaccgatgaatacgatggtaacctgaatttgatcaaaggtggcggtggggcgctgttgcaagaaaagattgtagccaccgcaagtgatcaaatgatcgtcatcgcagatgcgtctaagcatgtggaaacattgggacattttccgctaccgattgaagttattccgttcggctggcagaccacgaagaccttggtggaggaaacgctgatcggcttggacgtgctggggcgtcaggtgtcgctgcggatgaacggcgatgcgccctattacaccgatgagggcaatcatatccttgatttgcacctgaaccggattggaaatgcacggcaattttctcttgttatcaatcagataccgggtgttgtggaaaacggactgttcattgatatctgtgatattgtcgtcatcggctacggcgatggccgcgttgaggtgcgcgatatcaacgccggatcagtcgaggaaagccgcatcgatttcgttgaggcggacaacctgtttgcggatctcaacgactaa

SEQ ID NO: 2146 - DNA, 789 bp, Octadecabacter antarcticus 307
atgtcgttcgaactgtcccccatcgacaaagccaaatttgtcgccgccaaacaagcgacccaatatgtgcaagacggtatgaaagttggccttggaacagggtccaccgccgcgtggttggttaagtgtctgggcgagatggttgaaaaagatggtttgaaaatcaagggtgtaccgacatctacacggaccgcagaactggcacgtgacgttggtattgatgttatttcactggacgaagccaagtggttggacctgacaattgatggcacggatgaatacgacggcaatctgaatttgatcaaaggcggcggcggggcgttgttgcaagaaaagattgtggccactgcaagcgatcagatgattgtgatcgcagatgcgtccaagcaggtagaaacactgggacattttcctctcccgattgaggtgattccgttcggctggcagaccacgaagaccttggttgaagaaacgctgatcagcatggatgtgctgggacgccaagtgtcgctgcgcatgaacggtgatgcgccctattacaccgatgagggcaatcacatccttgatctgcacctgaacaggattggaaattcgcggcaattttcgcttgttatcaaccagataccgggcgtagtcgaaaacggattgttcatcgatatctgtgacattgtcgtcatcggctacggtgatggccgcgtcaaagtgcgcgatatcaatgccggatcagttgaggaaagccgcatcgaattcgtcgagactgataacctgtttgccgatctcaacgactag

SEQ ID NO: 2147 - DNA, 789 bp, Oceanicola granulosus HTCC2516
atgtccgccgatctgtcgcccatcgacaaggccaagttcgccgccgcccggcgcgccaccgactacgtcgaggacgggatgcgcgtcggcctcgggaccggctcgacggcggcgtggctggtgaagtgcctcggcgagatggtgcgcgaggacgggctgcgcctgaccggcgtgccgacctcgagccgcaccgcagcgctggcgcgcgaggtggggatcaaggtggtctcgctcgacgaggccaggtggctggacctgaccatcgacggggccgacgagtacgattccaacctcaacctcataaagggcggcggcggcgcgctgctgcaggagaagatcgtcgccaccgcctccgaccagatggtggtgatcgccgacatctccaagcaggtggacacgctcggggcgttcccgctgcccgtcgaggtgatccccttcggctggcagacgacgaaggtgctgatcgaggagacgctgatcggcctcgacgtgctcggccgcgacacctcgctgcggctcaacggcgagcggccctacgtcaccgacgagggcaactacatcctcgacctccacctcaaccggatcggcaatgcccgccagctgtcgctggtgctcaaccagattcccggggtggtggagaacggcctgttcatcgacgtctgcgacgcggtggtgatcggctacggcgacggccgggtcgaggtgcgcgacatcaacgagggcaccgtcgaggagagccgcatcgacttcctcgagacggagaacctgttcaccgacctggccgactga

SEQ ID NO: 2148 - DNA, 789 bp, Roseobacter litoralis
atgtcttcagaactctcgccgatcgacaaggcaaaatttgtctgcgccaaacgggccgcacaattcgtagaaaatggtatgcgggtggggctgggcaccgggtcaacggcggcctggcttgtgcgctgtctgggggagcgggtgcgcgacgaagggctgcatattacaggggttccgacatctacgcgcactgcggaactggcccgtgaggtcggtattgatgtgatcacactcgatgcggccaagcggctggatctgacgattgatggtgcggatgaattcgatggcgcgtttaatctgatcaaaggcggtggcggtgccttgctgcatgaaaaggtcgtggcgacgtcttctgatcgcatgatcgtgattgccgatgtgggcaaagaggttgagacgctgggcgccttcccgctgccgatcgaggtgatcccctttggattgcaaacgacccatgcgctggttgatgaaaccctcgtctccatggacgttctggggcgcgacagcagcctgcggatggatggcgacaaacctttcgtgacggacgaaggcaaccacatcattgatctgcatctcaagcggatcggcgatgcgcggcaacttgcgatgacgctcaatcagctgccgggtgtggttgagaacggtctgttcattgatatctgcgacacggtcgttctgggttttggggacggaaaggtcgaggtgcgcgacatcaatgatggaacggttgcaagcgaacgcatggtttttgccgaaagtgacaatctgttcagcgatctgagcgattga

SEQ ID NO: 2149 - DNA, 789 bp, Roseobacter denitrificans
atgtcttccgaactctcgccgatcgacaaggcaaaattcgtctgtgccaaacgggccgcacaacttgttgaaagtggcatgcgggttggcttgggcaccggatcaacagcggcctggctcgtgcgctgtctggggcaaagagtgcgcaacgaggggctgcagatcacgggggttcccacatcgacacgtaccgccgaattggcccgtgaggttggaatcgacatcatcacactggatgcggccaagcggctggatctgacgattgacggtgcggatgaatttgacggtgcgttcaacctgatcaaaggcggtggcggggctttattgcatgaaaaggtggtagcggcctcgtctgatcgcatggtcgtgattgccgatgtgggcaaggaggtcgagacgctgggcgccttcccgctgccaatcgaagtcatccccttcggattgcagacgacccatgcgctggttgatgaaacccttgtgtcgatggacgttctggggcgcgacagcagcctgcgcatggatggcgacaaacctttcgtcacggatgaaggcaaccacatcattgatctgcacctcaaacggattggcgatgcgcggcagctggcgctgacgctcaatcaggtgccgggtgtggttgagaacggtctgttcattgatatctgtgacacggttgtgctgggttttggggacggaaaagtcgaagtgcgcgacatcaatgacggcaccattgccagcgaacgcatgatttttgcagaaaccgacaatctgttcagcgatctgagcgattga

SEQ ID NO: 2150 - DNA, 786 bp, Silicibacter lacuscaerulensis
atgacccagaaactgtcaccgatcgacactgccaagcgcgtcgccgcctatcgggcggccgagatggtcgaggacggaatgcgcgtggggctgggcaccgggtcgaccgcggcctggctcgtgcgccgactgggcgagcgtgtgaagaacgagggcctgaagatcaggggcgttccaacctcgaccgcaacggcgcagctggcgcgcgaggtggggatcgaggtggtctcgctggatcaggccgggtggctggacctgaccatcgacggggccgacgaattcgacggcgagttgaacctgatcaagggcggtggcgctgccttgctgcaggaaaagatcgtggccacggccagcgacctgatggttgtgatcgccgatgccggcaaagaggtcgagacgctgggcgcctttcccctgccgatcgaggtgattcccttcggctggcagaccacgcggactctggtcgaggaattgctggattcgatggatgttctgggcacgtcggccacgttgcggatgaacggcgaggccccgaccgtcaccgacgagggcaaccacatcctggacctgcacctgcagcgtatcggcaacccgcggcaactggcgttggccctgaaccagatccccggcgtcgtggaaaacgggttgttcatcgacatctgcgacaaggtggtgatcgggttcggtgatggccgggtcgaactgcgcgacatcaacgaaggtacgatccagctggaccggctgggcgagggcgacgacaacctgttctcggacctggccgactga

SEQ ID NO: 2151 - DNA, 783 bp, Rhodobacterales bacterium HTCC2654
atgtcatccaacctctcgcccatcgacaccgccaagttcgtcgccgccaagcgtgcggtggatttcgtcgaggacgggatgcgcgtggggctgggcaccgggtcgacggcggcctggatggtgcgctgtctgggcgaacgcgtgcgtgaggaggggctccggatcgccggtgtcccgacctcgacccggaccgcggaactggcgcgccaggtcggtatccgtgtgatctcgctggacgaggcgcgctggctcgacctcaccatcgacggcgcggacgaattcgacatggacctgaacctcatcaagggcgggggcggcgcgcatcttcaggaaaagatcgtggcgacggcctcggatcagatgatcgtcatcaccgatccgtcgaaacaggtcgaacacctcggctcgttcccgctgccggtcgaagtgattccgttcggatggcagacctcgaaagccctgatcgaggaaacgctcgcctcgctcgaggttctgggacagaccagcgcgctcaggatgaacggcgaggcccccttcgtcaccgacgaaggcaaccacatcatcgacctctacctgcaacgcatcggcaatccgcgccagctttccatggtgctgaaccagatcccgggcgtggtcgagaacgggctgttcatcgacatctgcgacaaggtcgtcatcgggcatcaggacgggcgcgtcgaagtcatcgacataaacgaaggcacgcatgacgagggcctcgtcgaattcgctgaaaccgagaacctgttctccgacatctga

SEQ ID NO: 2152 - DNA, 789 bp, Rhodobacterales bacterium HTCC2150
atgaacaaagcactttcccccgttgatgccgctaaacttgccgctgcccaaagggctgtagagtatgttcaagacggtatgcgtattggtcttggaactggctcaactgccgcttggttggtcaaggtattaggcgaaatggtccgcgacgaaggcctaaaggtcatgggtgttccaacatctacaagaacggccgaattagcgcgcgccgaaaatattcctgttgtgacattggatgaggctaagtggttggatctcaccattgacggtgccgatgaatttgatggcgagttgaacctgattaaaggtggcggcggggccttgttgcaagaaaagattgttgcgactgcttctgatcagatgattgtgatcgctgacgccagcaaacgcgtagatacgcttggcgctttccccttgccgattgaggtcattccttttggttggcaggccagtaagacgttggttgaagaagcgctgatcagccttgatgtgatgggccgagacagcagcctgcgcatgaaccgcgataaaccgtttttgacggacgaaggaaatttcattcttgatctcaaccttcgtcgtattggcaacgcccgacagttggctttggttttgaaccaaattcctggggtggttgaaaatggattgttcattgatatctgtgacgttgtgatcgttggccatggcaacagcaaggtcgaggtttacgatatcaacaatggcaccatggaagaagaaaccatggggcaagaagttaacaagaacttgtttcaggacgatcttgattaa

SEQ ID NO: 2153 - DNA, 789 bp, Jannaschia sp. CCS1
atgacggcagagctttcccccatcgaccgagccaaatacgtcgccgcgcgccgtgcagtggaatatgtggaagatggaatgcgtgtggggttgggcacgggatccacggccgcatggatggtgcgctgcctgggtgagttggtccgcgatgaggggatgcagatcacgggcgttgcgacctcaacccgcacggcggatctcgcgcgcgatgtcggcgtgacggtcaagacgctggatgatgtgcgctggctggacctgacgattgacggaacggacgaatacgacccgaatctgaacctgatcaagggcggcggcggcgcgcttctgcatgaaaaggttgtcgccacggcgtctgatcagatggtcgtgatcgctgacccgaccaagcaagtggacactttgggcgcgttcccgttgccggtggaggtcattcccttcggctggcaaacgaccaaggcgctgatcgaagagatgttgtcgaaccttgatgtgcttggccgctcggcgtcgctgcgtctgtcgggggcggaaccgtttcgcacggatgaagggaacctgatcctggacctgcatctgcggcgtatcgcgcaaccggcgcagttgagcctggtgctcaaccaaatcccgggcgtggtggaaaacgggctgttcctggacatctgcgatgtgttggtcattggcaatgccgacggcaccgtggaagtgcgcgatatcaacaacggcacaatcgagcatgagcgggtggatgtggccgaaacggataatctgttcgttgaggtcaaggaataa

SEQ ID NO: 2154 - DNA, 783 bp, Dinoroseobacter shibae DFL 12
atgtccggagaaatgtcgcccatcgaccgcgccaagtacgtcgccgcgaagcgcgcggtgggctttgtcgaggacgggatgcgggtcgggctcgggaccgggtccacggcggcctggatggtgcgccacctggccgagaccgtcgaccaggagggaatggacatcacctgcgtggccacctccacccgcacggcggagctggcgcgggatctcaagctgcacgtcacgacgctggacgaggtgaagtggctcgatctgaccatcgacggggcggatgagtttgacccgaccctgaacctgatcaagggcggtggcggggcgctcttgcaggaaaagatcgtcgcaacggcatccgatcgcatgatcgtgatcacggatgcgtccaaggcggtcgctacgcttggggccttcccgctgccggtggaggtgattcgcttcggctgggaaacgacgcggacattgatcgaggaaaccctcgtcaacgtggatgtgggtgggcgcgaggctatcctgcggatggaaaacggcatgccttacgtcaccgacgagggcaatttcatcgtcgatctgcacctggagcggatcggcaacccccggcaagtctcgctggtgctcaaccagttgccaggggtggtggagaacgggcttttcctcgacatctgtgacgtggtggtcatcggcaagagcgacgggtcggtggaactgcgcgatatcaacgagggctcggtgcaccaagagcaggttgaagtcaccgcgaccggcaacgtattctccgacctgtaa

SEQ ID NO: 2155 - DNA, 789 bp, Roseobacter sp. CCS2
atgtccagtgaaatgtccccggtcgaaaaggcaaaattcgttgccgccaagcaagcaacggaatttgtcgaaagcggtatgaaagtgggcctcggcacggggtcaacggccgaatggctggtgcaatgtcttggtgaaatggtccgtgaagaggggcttaagatcaaaggcgtgccgacatccaaacgcacagggcttctggcaaaaaaggtcggcattgatgtgatcacgctggaagaggcgaaatggcttgatgtgaccattgatggcacggatgaatatgacagtgacctgaccctgattaaaggcggcggcggcgcgcatctgcgcgaaaaagtggtcgccaccgccagcgagcgcatgatcgtgatcgctgacgccagcaaaaaggtcgaaacgctgggggcgttccctcttccgattgaggtgatcccttttggattgccggtcacccaagggctgatcgaagaaacgctgatcggcatggatgtgctggggcgcgaggttacacagcggatgaagggcgatgcgccctttgtgacggacgaaggcaattttatccttgatctgcacctcaagcgcatcggtaatccgcgccagctgagtcttgtgatcaatcagatcccgggtgtggttgaaaacgggttgtttatcgacatttgcgatgtggtcattgtcggccatggtgatgggcgggtcacaacgcgggatatcaccaataacactgcgaatgtcgtgcgcttcgatgtgcttgatgatgataatatcttttctgacgttgcagattga

SEQ ID NO: 2156 - DNA, 789 bp, Loktanella vestfoldensis SKA53
atgaccatcgacttgttccccatggatacggccaaattcgttgccgccaaacaggcgacacattatgtgcaatcgggcatgaaggtgggtctggggaccggctctaccgcagcatggctggtgcaatgtctcggcgagatggtgcgcgatcacggattgcagatcaagggcgtgccgacatccaaccgcactgccgaattggcgcgcgctgcggggatcgagatcattaccctggatcaggccaaatggctcgacctgacgatcgacgggaccgatgaatatgacgccaatctgaacctgatcaaaggcggcggtggcgcgcatctgcgcgaaaagatcgtggcgaccgccagcgaccggatgatcgtgattgccgatgcctccaagacggtggcgacgctgggggcctttcccttgccggtcgaggtgctgcccttcgggatgcagatcacgcgcggtttgatcgaggagctgctggtcggtgtcgatgtgctgggccgtgacgtgatccagcggatgcagggcgatgcgccctatgtcacggatgaaggcaatttcatccttgatctgcatctcaaaagcatcggcaatccgcgccaactggcgatgatgctgaaccagatccccggtgtggtggaaaacggtttgtttatcgacatttgtgatgtcgtgatcgtgggccacggcactggcaaggttgaaatccgtgacatcaccaacgacataaatgatgttgtgcaattcgatctgcaggacgatgacaatctgttcgcagaccttgcgaaataa

SEQ ID NO: 2157 - DNA, 789 bp, Rhodobacter sphaeroides
atgcctgcagaactatccccgatcgacaccgccaaattcgccgccgcacgccgcgcggtggatctcgtgcaggacggcatgaagctgggcctcggcaccggctcgactgccgcctggatggtgcgctgcctggccgagcgcgtgcgcgaggaggggctgcgggttcagggcgtgccgacctccacccgcacggccgagctcgcccgcgctctgggcatccaggtggtgacgctggacgaggcgaagtggctcgacctgaccatcgacggggcggacgaattcgacgccgacttcaacctcatcaagggcggaggggccgctctgctgcaggagaagatcgtggcgaccgcctcggaccggatggtggtgatcgccgatgccgccaaggaagtggcgcatctgggcgcctttccgctgccggtcgaggtcatccccttcggctggcagagcacgaagatgctgatcgaggagacgctcgagggcatggatgtgctgggccgcgaggtgacgctgcgcctttccggcgacgcaccgcttctgaccgacgagaagaactacatcctcgatctgcatctcaagcgtatcggcgagccgcgtcagctcggcctggcgctgaaccagatcgcgggcgtggtggaaaacggcctcttcatcgacatctgcgatacggtcgtggtcggccatggcgacggacgggtgagcctgcgcgacctgcagtcggggcaggccgaggaaggctgcatcgacatggaccgcgcccgcaacatcttcgccgatctgggagactga

SEQ ID NO: 2158 - DNA, 789 bp, Rhodobacter sphaeroides
atgcctgcagaactatccccgatcgacaccgccaaattcgccgccgcacgccgcgcggtggatctcgtgcaggacggcatgaagctgggcctcggcaccggctcgaccgccgcctggatggtgcgctgcctggccgagcgcgtgcgcgaggaggggctgcgggttcagggcgtcccgacctcgacccgcacggccgagctcgcccgcgctctgggcatccaggtggtgacgctggacgaggcgaagtggctcgatctcaccatcgacggggcggacgaattcgacgccgacttcaacctcatcaagggcggaggggccgctctgctgcaggagaagatcgtggcgaccgcctcggaccggatggtggtgatcgccgatgccgccaaggaagtggcgcatctgggtgcctttccgctgccggtcgaggtcatccccttcggctggcagagcacgaagatgctgatcgaggagacgctcgagggaatggatgtgctgggccgcgaggtgacgctgcgcctctccggcgatgcgccgcttctgaccgacgagaagaactacatcctcgatctgcatctcaagcgcatcggcgagccgcgtaagctcggcctggcgctgaaccagatcgcgggcgtggtcgagaacggcctcttcatcgacatctgcgatacggtcgtggtcggccatggcgacgggcgggtgagcctgcgcgatctgcagtcggggcaggccgaggaagggtttatcgacatggaccgcgcccgcaacatcttcgccgatctgggagactga

SEQ ID NO: 2159 - DNA, 789 bp, Rhodobacter sphaeroides
atgcctgcagaactatccccgatcgacaccgccaaattcgccgccgcacgccgcgcggtggatctcgtgcaggacggcatgaagctgggcctcggcaccggctcgaccgccgcctggatggtgcgctgcctggccgagcgcgtgcgcgaggaggggctgcgggttcagggcgtcccgacctcgacccgcacggccgagctcgcccgcgctctgggcatccaggtggtgacgctggacgaggcgaagtggctcgacctgaccatcgacggggcggacgaattcgacgccgacttcaatctcatcaagggcggaggggccgctctgctgcaggagaagatcgtggcgaccgcctcggaccggatggtggtgatcgccgatgccgccaaggaagtggcgcatctgggcgcctttccgctgccggtcgaggtcatccccttcggctggcagagcacgaagatgctgatcgaggaaacgctcgagggcatggatgtgctgggccgcgaggtgacgctgcgcctctccggcgatgcgccgcttctgaccgacgagaagaactacatcctcgatctgcatctcaagcgcatcggcgagccgcgtccgctcgcgctggcgctgaaccagatcgcgggcgtcgtggaaaacggcctcttcatcgacatctgcgatacggtcgtggtcggccatggcgacgggcgggtgagcctgcgcgacctgcagtcggggcaggccgaggaaggatccatcgacatggaccgcgcccgcaacatcttcgccgatctgggagactga

SEQ ID NO: 2160 - DNA, 789 bp, Rhodobacter sp. SW2
atgcccgccgagctttcgcccatcgacaaggccaaattcgtggccgccaaacgcgccgtcgaattcgtcgaaaccggcatgaagctggggcttggcaccggctcgaccgcggcctggatggtgcgctgcctggccgaacgcatccgcgaggaaggcttgcgggtcaccggggtgccgacctccagccgcacggcggaactggcgcggtccttgggcgtgccgatcatgtcgctggacgaggcgaagtggctggatctcaccatcgacggcgccgacgagatcgaccccaacctgaacctgatcaagggtggcggggcggcactgttgcaggaaaagatcgtggccacggcctcggaccagatgatcgtgatcgccgatgccgccaaggaagtcggctgccttggcgccttccccttgccggtcgaggtgatcccgttcggctggcagaccaccaaggcgctgctggaggaaaccctggtcagcatggacgtgctgaaccgcgactgcactttgcggatgaacggcgaccggccgctgctgaccgacgaggccaattacatcgtcgatctgcatctgaagcgcatcggcaacccgcggcaactggcgctggtgttgaaccagatccccggcgtggtggagaacgggctgttcatcgacatctgcgacatcgtggtgatcggcaatggcgatggtcgcgtcacggtgcgcgacatcaacgccggttccagttccgacgagcgggtggaatttgccgcctccgacaacatcttcgccgatctcggggactga

SEQ ID NO: 2161 - DNA, 753 bp, Rhodobacter sphaeroides
atgcctgcagaacgttcccccattgacaccgccaagttcgccgccgctcgccgtgcggtggatttcgtgcaggacggcatgaagctgggcctcggaaccggctcgaccgcggcgtggatggtgcgctgcctggccgagcgtgtccgcgaagagggactgcgggtgcagggcgtgccgacctcgtcccggacggccgagcttgcgcgcgagctggggatcccggtcgtgaccctcgatgaggcgcggtggctcgacctcaccatcgacggggccgacgagttcgacagtgagttcaacctgatcaagggcggcggcgccgcgctgctgcaggaaaagatcgtggcgacggcctcggaccggatgatcgtgatcgccgacgcggccaaggaggtggcgcagcttggcgccttcccgctgccggtcgaggtgatccccttcggctggcagagcaccaggatgctgatcgaggaggcgctgatcgggctcgatgtccttggccgcgaggtgacgctgcgtcggtcgggcgaggcgccgctgctcacggacgagaagaactacatcctcgacctgcacctgacgcgcatcggccatccgcgccagctcgccctcacgctgaaccagatcgcgggcgtggtggagaacgggcttttcattgacatctgcgacacggtggtggtggggcatggcgacggccgggtgacggtgcgtgatctcggcgcctcgcgcaacatcttcgccgatcttggagagtga

SEQ ID NO: 2162 - DNA, 789 bp, Rhodobacterales bacterium HTCC2255
atgacacttgatttgagcccatctgaaattgggaagtttacatctgcttatcgagcgttagattttgtcgaatctgatatgaaattgggtctaggcacgggttcaacggctgcctggttggtaaaacttttagcatatgaaataaataacaagggtttaaatatttctgcatgtgctacatcttcggagacaaccaagctagcagagagtttaggaattaaaatctctaatttagacgaattgggccaattagatctagcgattgatggtgctgatgaatttgatcaaaatttgaatttaataaaaggtggtggtgcagctcttttgcaagaaaagattgttgaaacagctgctaataaattggtggtaattactgatgcatcaaaacaagtcgatgacctgggaacatttgacttgcctgtcgaagttgtgaaatttggatggaaaactacaaagcgactcatagaaaatgttttaattgaccaagatgtcgattgccggattgtcactagaagaaataatcacacaccagttattacagatgaaaatcattatattttagatttaaaattaaacagaattggaaatcctaatgcactttcagatgcattattaaatattgctggagtcgttgaaacaggcctttttttaggaatgacacattctattataatgggtaatgaaaatgggttggctcgagtgaaatcgactggttcgttagattgggtagatacatcttatgacatacaaagcctgtctcaatttataaaaaatattaatgacatttga

SEQ ID NO: 2163 - DNA, 726 bp, Paracoccus denitrificans
atgaccgaccccgccatcgccgacctttccaaggatgccgccgcccgtgccgccgtggcgctggtcgaaccggggatgcggctgggcctgggcactggctcgaccgccgcgatcttcgtgcgccgcctcgcacagcgggtcagcgaggaggggttcgcgctgcgttgcgccgcgacctcgaaggcgacggccgagcttgcgacctcgctggggctgggggtcgaggaactggacgagatcggctggctggacctgaccatcgacggcgccgacgaggttgacccggacctgaacctgatcaagggcggcggtgcggcgcatctgcgcgaaaagatcgtcgccacggcctcggagcgcatggtggtcatcgccgaccagggcaaggtcgtggaccggctgggccagttccacctgccggtcgaggtgattcccttcggctggcaggcgacgcgcaagctgatccagcgcgcgctggaccggctggacctgacccagcgcccgatcctgctgcgcaagcgcggcgatgcgccgctgcgcaccgacgagggcaacctgatcctggacctcgcgctcgaggccatcccggatgccgaggcgctggcggccgagctgtcttcgatcgccggggtggttgaacatgggctgttcctgaatatctgcgaacttgcgatcatcggctgcccggacggctcggtggtcgagttgcggcgcgaggacatggcatga

SEQ ID NO: 2164 - DNA, 720 bp, unknown
  uncultured Rosebacter sp.
atgtttgccgatttatcccccgccgatcaggcaaaatacgtcgcggccaaacgcgctgttgaattggtcgaagatggtatgaaactcgggctcggaaccggttcaacggcggcttggatggtgcggtgtttggctcagcgggtgaaagccgaagggctgcgcattcaaggtgtgcccacctcgacccgcacagccgacttggcccgtgagctgggtttggaagttgtgactctggatcaggctgggcatttggacatcaccattgatggtacggatgaattcgattccgctttgaacctcatcaaaggcggtggcggggcgcttttgcaagaaaagatcgtcgcctccgcctcggatcggatgattgtgattgcagattttgataagcatgtgcctcagctcggtaaattccctttgccggtggaggttttgggatttggtttggcctcgtcgcgcgatcatattgcccgcctcttggccgatcacggattggccgggtgcgatatcaccacgcgcaagcagggcgatgccccctttgtgacggacgaggggaatttcattctcgatttgcatcttgcgcaaatacccgatgcgccggctttggccattgcccttaatcaagtgccgggcgtggttgaaaatggcttatttatagatatttgtgatcgagtcattcttggcgccagtgatgggcgcattgaagagcacgttcggccttaa

SEQ ID NO: 2165 - DNA, 753 bp, Yersinia pestis
ttggcgaccccacctttatgtagtcatgatcaggagtcacgaatgagcaatcaacaaaatgacgccaagagggctgccgcccgtcgggtgattcaggatttcgtgttcgatggcatgacgttggggctgggttccgggaccacctcgcatttctttgtgcgcgaactgggccagcatgttgccaagggcttgcagttaacctgcaccacaacttctcgtgcgacgagcgaggtggcgcgtgacgtgggcattgagctctcggatccgaatgagatgaatgagattgatctgaccatcgacggcccagatgagattgaccggcggttcaatatgatcaagggcggtggagcctgccttctgtgggagaaaattatcgcccatgcctcgaagcggatgatttgtatttgtgatgagacaaaaatcgtcaattgcttggggcaatttccgctgccagtcgaaatcgtcccctttgcctggaaacagaccgaacgcagggtcgagcgggtactcgcggaacagggtctccatcatgtgccgattattcggcgtatggggggcgggcacccggtgatcactgacagtggaaactttattctggattgccattgcggggcgattatcacggcccctgaaccgctggaaatagagcttaatcgcattccgggggtggttgaaaacggtcttttcacccgtgaggctaccggtatggtggtgggctattttgacggttcctcctacgttcaactgcgataa

SEQ ID NO: 2166 - DNA, 711 bp, Yersinia pseudotuberculosis
atgagcaatcaacaaaatgacgccaagagggctgccgcccgtcgggtgattcaggatttcgtgttcgatggcatgacgttggggctgggttccgggaccacctcgcatttctttgtgcgcgaactgggccagcatgttgccaagggcttgcagttaacctgcaccacaacttctcgtgcgacgagcgaggtggcgcgtgacgtgggcattgagctctcggatccgaatgagatgaatgagattgatctgaccatcgacggcccagatgagattgaccggcggttcaatatgatcaagggcggtggagcctgccttctgtgggagaaaattatcgcccatgcctcgaagcggatgatttgtatttgtgatgagacaaaaatcgtcaattgcttggggcaatttccgctgccagtcgaaatcgtcccctttgcctggaaacagaccgaacgcagggtcgagcgggtactcgcggaacagggtctccatcatgtgccgattattcggcgtatggggggcgggcacccggtgatcactgacagtgggaactttattctggattgccattgcggggcgattatcacggcccctgaaccgctggaaatagagcttaaccgcattccgggggtggttgaaaacggtcttttcacccgtgaggctaccggtatggtggtgggctattttgacggttcctcctacgttcaactgcgataa

SEQ ID NO: 2167 - DNA, 711 bp, Yersinia pestis
atgagcaatcaacaaaatgacgccaagagggctgccgcccgtcgggtgattcaggatttcgtgttcgatggcatgacgttggggctgggttccgggaccacctcgcatttctttgtgcgcgaactgggccagcatgttgccaagggcttgcagttaacctgcaccacaacttctcgtgcgacgagcgaggtggcgcgtgacgtgggcattgagctctcggatccgaatgagatgaatgagattgatctgaccatcgacggcccagatgagattgaccggcggttcaatatgatcaagggcggtggagcctgccttctgtgggagaaaattatcgcccatgcctcgaagcggatgatttgtatttgtgatgagacaaaaatcgtcaattgcttggggcaatttccgctgccagtcgaaatcgtcccctttgcctggaaacagaccgaacgcagggtcgagcgggtactcgcggaacagggtctccatcatgtgccgattattcggcgtatggggggcgggcacccggtgatcactgacagtggaaactttattctggattgccattgcggggcgattatcacggcccctgaaccgctggaaatagagcttaatcgcattccggggggggttgaaaacggtcttttcacccgtgaggctaccggtatggtggtgggctattttgacggttcctcctacgttcaactgcgataa

SEQ ID NO: 2168 - DNA, 711 bp, Yersinia pseudotuberculosis
atgagcaatcaacaaaatgacgccaaaagggctgccgcccgtcgggtgattcaggatttcgtgttcgatggcatgacgttggggctgggttccggtaccacctcgcatttctttgtgcgcgaactgggccagcatgttgcaaagggcttgcagttaacctgcaccacaacctctcgttcgacgagcgaggtggcgcgtgatgtgggcattgagctctcggatccgaatgagatgaatgagattgatctgaccatcgacggcccagatgagattgaccggcggttcaatatgatcaagggcggtggagcctgccttctgtgggagaaaattatcgcccatgcctcgaagcggatgatttgtatttgtgatgagacaaaaatcgtcaattgcttggggcaatttccgctgccagtcgaaatcgtcccctttgcctggaaacagaccgaacgcagggtcgagcgggtactcgcggaacagggtctccatcatgtgccgattattcggcgtatggggggcgggcacccggtgatcactgacagtggaaactttattctggattgccattgcggggcgattatcacggcccctgaaccgctggaaatagagcttaatcgcattccgggggtggttgaaaatggtcttttcacccgtgaggctaccggtatggtggtgggctattttgacggttcctcctacgttcaactgcgataa

SEQ ID NO: 2169 - DNA, 711 bp, Yersinia pseudotuberculosis
atgagcaatcaacaaaatgacgccaagagggctgccgcccgtcgggtgattcaggatttcgtgttcgatggcatgacgttggggctgggttccgggaccacctcgcatttttttgtgcgcgaactgggccagcatgttgccaagggcttgcagttaacctgtaccacaacttctcgtgcgacgagcgaggtggcgcgtgacgtgggcattgagctctcggatccgaatgagatgaatgagattgatctgaccatcgacggcccagatgagattgaccggcggttcaatatgatcaagggcggtggagcctgccttctgtgggagaaaattatcgcccatgcctcgaagcggatgatttgtatttgtgatgagacaaaaatcgtcaattgcttgggacaatttccgctgccagtcgaaatcgtcccctttgcctggaaacagaccgaacgcagggtcgagcgggtactcgcggaacagggtctccatcatgtgccgattattcggcgtatggggggcgggcacccggtgatcactgacagtgggaactttattctggattgccattgcggggcgattatcacggcccctgaaccgctggaaatagagcttaaccgcattccgggggtggttgaaaacggtcttttcacctgtgaggctaccggtatggtggtgggctattttgacggttcctcctacgttcaactgcgataa

SEQ ID NO: 2170 - DNA, 759 bp, Rhodococcus jostii RHA1
atgtacacgaccgaaaccccccaggacgcggcgaaatacgccgtcggccgggccgcggtggagcgctacgcgcacgacggcgcccaactcggactcggctccggaacgacgtccgcgtggttcgtgcgcgccctcggcgagaaggtcgccgacggcctcgacgtcgtcggtgtccccacctccaccgcaacccgcgacctggccctgtcggtcggtatcaccctcgtcgatctcaacgacctcgaccgcccactcgatgtgacgctggacggacccgacgaggtcgaccacgacggcgacatgatcaagggtggcggcgcctgcctgctgtgggagcgcatggtcgccgaggcctcgtcgaagatggtgtgcatcgcagacgacaccaaactggtcgagcaactcggctccttcccacttccgatcgaggtcatcccgttcgggtggaaggcgactcggcgatcgatctccgcgctgctgaccgacctcggttacaccgatgtcaagatcattcagcgacaccggaacgggcagcctgtcgtcaccgacagcggcaacttcatcctcgacgcccacatggtcgcgatcaccgacaaagccctgctcgacacgaacctcaactggatcgccggcgtcgtggagaacgggctgttcaccggaatcgcccacgaaatcctcatcgcttccccggacggggcggcgaaactcatcgaactgccgcaccggaatgccgccaggatcccggagtggcgcaaatga

SEQ ID NO: 2171 - DNA, 759 bp, Rhodococcus opacus
atgtacacgaccgaaactccgcaggacgcagcgaaatacgctgtcggccgggccgcggtggagcgctacgcgcacgacggcgcccaactcgggctcgggtccggaacgacgtccgcgtggttcgtgcgtgccctcggcgagaaggtcgccgagggtctcgacatcgtcggtgttccgacctctaccgcaacccgcgacctggccctgtcggtcggcatcaccctcatcgatctcaacgacctcgaccgcccgctcgacgtgacactggacggacccgacgaggtagaccacgacggtgacatgatcaagggcggcggcgcctgcctgctgtgggaacggatggtcgccgaggcctcgttgaagatggtgtgcatcgcagacgacaccaaactggtcgagcggctcggctccttcccactcccgatcgaggtcatcccgttcggctggaaagcaactcggcggtcgatctccgcactgttccgggacctcggctacaccgatatcgacatcgtccagcggcagcgggacggccagcccgtggtcaccgacagcggcaacttcatcctcgacgcccacatggtcgcgatcaccgacaaggcgctgctcgatacgaacctcaactggatcgccggcgtcgtcgagaacggactgttcaccggcatcgcccacgagatcctcatcgcctccccggacggggcggcgaaactcatcgaactgccgcaccgcagggcggccaggatcccgcagtggcgcaaatga

SEQ ID NO: 2172 - DNA, 684 bp, Brevundimonas subvibrioides ATCC 15264
atgagcgatcaccagaaacagatcgccggcgaggccgcggccctgcgggtcgaggcgggcatggtggtggggctgggcaccgggtcgaccgcgggctggttcgtgaaggcgctcgcggcgcggagcctgaccgggctgcgctgcgtgccgacgtcagagaagaccgccgacctggcccgcgaactgggcctgccgctgacgacgctggaggatgtctcgcgcatcgaccttaccgtcgacggtgccgacgaggtcggcccggggctggccctgatcaagggcggcggggcggccctgctgcgcgagaagctggtgtgggaggcgtcggaccgctgcatcgtcatcgccgatgcggcgaaggtggtgccggtgctgggggccttccccctgccgatcgaggtcgtcgccttcggccacaaggccacggcgaaccggatcatggatgtgctgaccgaccacgacatcaccatgcccgcccggctgcgccaggcggatcggggcgtggtccgcacggacggcggcaacgtcatctacgacgcgaaatgcgtcgccatccacgacccggttcgcctggccgacgacctgaagctgatcaccggcgtggtcgagcacggcctgttcctcgatctggccgacgaggcgatcatcgggcgggacgacggggtcgaggtgctggtgccctag

SEQ ID NO: 2173 - DNA, 684 bp, Brevundimonas sp. BAL3
atgagcgatctacagaagaagaacgccggcgaggccgctgcggcccatgtcgaggccggcatgatcgtcggcctgggcaccggctcgaccgccgcctggttcgtcaaggccctggcggcgcgcggcctttctgggctgcgctgcgtcccgacctcggagaagaccgccgatctggcgcgcgaactgggcctgaccctgtcgacgctggaggacacgccgcgcatcgatctgaccgtcgacggcgccgacgaggtcggtcccggcctggccctgatcaagggcgggggcgcggccctgctgcgcgagaaactggtgtgggaggcgtccagccgctgtatcgtcatcgccgacgccgccaaggtggtgccggtgctgggaaccttccccctgccgatcgaggtcgtcgccttcggtcacaagaccacggccaaccgcatcgccgacgtcctgatcgaccatgacatcaactcgccggcccgcgtgcgccaggcggatcgcggcctggtccgcaccgacggcggcaatctgatctatgacgccggctgcaaggccatccatgatccggtccgtctggccgatgatctgaaactgatcacgggcgtggtcgaacacggcctgtttctggacctggccgacctggcgatcatcggcacggacagcggggtcgaaaccctgacgccctga

SEQ ID NO: 2174 - DNA, 687 bp, Caulobacter segnis ATCC 21756
atgagcagcgccgacgatcagaagcgcgcctcgggcgaggccgccgcgcaactcgttgagaacggcatggtggtgggcctgggcacgggctcgacggccgcctggttcgtcaaggcgctggccgcgcgcaagctgaccaacatcaagggcgtgccgacctcggacgccaccgccgcgctggcgcgggagctgggcatcccgctggtcgcgctggacgacgtcaagacgatcgacctgaccgtggacggcgccgacgagatcgggccgggcctctccctgatcaagggcggcggcgcggctctgctacgcgagaagctggtctgggaggcctcgacccggtgcgtggcgatcgccgacgccgccaagcgcgtcccggccctgggcaagttcccgctgccgatcgaggtcgtgcgcttcggccacgtccacaccggccatcgcctggccgacatcgccgccgaattcgacctgccgccgccgcgtctgcgcacggccgaacggggcgttgtcgtcacggacggcggcaacctgatctacgacatggcctcgggccgcatcgacgagccggccgccctggcgacggcgctgaagagcgtcacgggcgtggtcgatcatggcctgttcctcgacctcgccgacgaagccttggtcggcacggacgacggcgtggtgcgcctggttccctga

SEQ ID NO: 2175 - DNA, 684 bp, Caulobacter crescentus
atgagcgccgacgaccagaagcgcatttcgggcgaagccgccgccgagcttgtcgagaacggcatggtggtcggcctgggcaccggctccacggccgcctggttcgtcaaggcgctggccgcgcgcggcctgaaagacattcgcggcgtgccgacctcggacgccaccgccgccctggcccgcgagctgggcatccccttggcggcgctggacgatgtgaagaccgtcgacctgaccgtggacggcgccgacgagatcggtccgggcctgtcgctgatcaagggcggcggcgcggcgctactgcgcgagaagctggtctgggaagcgtcgacccgctgtgtcgtcatcgctgacgcggccaagcgcgtgccggccttgggcaagttcccgctgcccatcgaggtggtgcgcttcggtcacgtccacaccggctatcgtctcgccgacatcgccgccgagttcgacctgccgcccccgcgcctgcgtacggccgagcgtggcatggtggtcaccgacggcggcaacctgatctacgacatggcctcgggcaagatcgaggatcccacggcgctggctgcggcgctgaagagcgtgaccggcgttgtcgaccacggcctgttccttgacctcgccgatgaggccctggtgggcacggacgagggcgtggtgcgcctgcagccctga

SEQ ID NO: 2176 - DNA, 681 bp, Caulobacter sp. K31
atgagcgcggacgatcagaagcggatttcgggcgaggccgcggccgagctcgtggaggccggcatggtcgtgggcctgggcaccggctcgacggcggcctggttcgtcaaggccctggcggcgcgcaagctggacatccggggcgtgccgacctcggaagccaccgccaacctggcccgcgagctgggcatcgccctgacggcgctggacgacgtcaagagcatcgacctgaccgtcgatggcgccgacgagatcggtccgggcctcagcctgatcaagggcggcggcgcggccctgctgcgcgagaagctggtctgggaggcgtccaagcgctgcgtggtcatcgccgacgccgccaagcacgtgaagaccctgggcaagttcccgctgcccatcgaggtcgtgcgcttcggccacgtccataccggccagcggttggccgacatcgccgccgagttcgacctcttgccgccgcgcctgcgcatggccgatcgcggcgtcgtggtcaccgacggcggtaatgtgatctacgacatgccctcgggcgtgatcgccgaaccggccgccctggccgccgccctgaagaccgtgaccggcgtggtcgaccacggcctgttcctcgacctggccgacgaagccctgctgggaaccgaccagggggtggtcaagctggttccctag

SEQ ID NO: 2177 - DNA, 687 bp, Phenylobacterium zucineum HLK1
atgagcgacgccgaggcgcagaagaaggccgcgggcgaagccgccgcggcgctggtcgagagcggcatggtggtgggcctgggcaccggttccaccgccgcctggttcgtcagggcgctggccgcccgcaagctggacatcgtcggggtcccgacctcgcaggccaccggcgagctggcggccagcctcggcatccgcatcgccgagctcggcgagacctcgcagatcgacctgaccgtggacggcgccgacgagatcggccccgggctgtcgctcatcaagggcggcggggcggccctgctgcgcgagaagctggtgtgggaggcgtcaaagcgctgcgtcgtcatcgccgacgccgccaagcaggtcccgacccttggcaagtaccccctgccgatcgaggtggtgaccttcggccaccagacgacggccctgcggatctgcgacgccctggccgaatgcgacgtcggcgtcgcgccgcgcctgcgcgtcagggacggccagccggtgcgaaccgacgagggaaacctcatctatgacgcagcctgcgggcggatcgaggagccggcggcgctggccgcggcgctgaagagcgtcaccggcgtggtggaccacggcctcttcctcgacctcgccgaccgggctttgatcggcggccccggcggcgtcacgacgctggagccctag

SEQ ID NO: 2178 - DNA, 693 bp, Asticcacaulis excentricus CB 48
atgtccgccgatacgcagaaacaggccgccggtctagcggctatcgaccatatcgagagcggcatgaaggtagggcttggcaccggctccaccgccgcctggttcgtcaaggccgtggccgacgcggtgcgagacggactgaagctgacgctcgtttctacctcgaaccagacgacgcatttggcgcagtcgttggggctggaaatcaaggatatcaacgatgtgggcaagctggacgtctgcgtcgatggcgcggacgaaattggttccgggttggctctgatcaagggcggcggcggggcgttgctgcgcgaaaagttgatctgggagatggctgatcgctgtatcgttatcgccgatgcggccaagcacgtggccacgctgggggcctttgccctgccgatcgaggtcgagcccttcgcctataagggcacgatcaaccgcatctgcgacgtgctgagtgagttcgacatcgccaaattgccggttttgcggaaaaaaggcggcgagtcctttgtgaccgacggcgggaatcttatctttgacgtgccgtgcggggcgatccttgatccttccggtctggccagcgcactgaaagccaccacgggggtcgttgatcatggcctgttcctcgatctggccgacgttgcgctgatcggcactgatagcggcgtcgatatcctccatccgtaa

SEQ ID NO: 2179 - DNA, 711 bp, Hyphomonas neptunium ATCC 15444
ttgccggacatggctagcgacaccgaaaagcagaatgcggccgccgccgcgatggactttgttgaagagggcatgacgattggcctcggcaccggctcaacggcgaaattcttcgtcgagatgctggccgacgagatcgctgatggcctgatcgtgcggtgcatcgaaaccagcaaccagacgcgcgaactggcgcgcagcctcggtgtgccgctgatcccgttcgagcaggtggaccgtatccatctcaccgttgatggcgccgatgaagtcggccccggcggcgtgctgatcaagggcggcggcgccgcgctgctgcgcgaaaagatcatcgccaacgcctccgatcatatggtcgtgattgccgacagctcgaaggaagtgccccatctcggcgcgtttccgctgccggtcgaagtcacgccgttcggctacacgattacggccaagaaggtgcatgacgcgctggtcgcctccggcgtggagcgcccgcgtatcgagctgcgcaaggccgccggcagcactgatcttctggtcacggatggcggaaatcatattctggactgccattgcggccgcattccagaccccgccaagacaggtgcctatctctccggtgtgcccggcgttgtcgagcatggcctgttcatcggcatcgcccgcacggtgatcatcggcgaggaaaatggcgcccatatcattgaatactga

SEQ ID NO: 2180 - DNA, 702 bp, Maricaulis maris MCS10
atgacggccctgcgccagaagacgctcgcggcggccgctgcgctcgactatatcgaaagcggcatgacgctggggctcggctccggctcgacggcagagatttttctccgcctgctgggcgagaagatcaaggacggtctggacgtgcgcggtgtgccgacctcccagcgcaccgcccagattgccgccgagaatggcgtgccgctgatcgatgtcgaccatgtcaacaatatcgccatcaccattgatggcgccgacgaggtcgacggccggttccagctgatcaagggcggcggcgcctgcctgttgcgcgagaagatcatcgcccatgcgtccgatctgatgatcgtcatggtcgatgagagcaagctggttgcgaccctgggcaagttcccgcttcccgttgaggtcgaccgcttcggcttttcactgactgccagccaggtctatgaggctttgcgcagggcggggatcaaatcgccggacgtccagttgcgccgcaagggcgacgggctggagccattggtcaccgatggcggaaattacattcttgattgcgcctgcgaggcgatcccggatgccggtgctgttgacagggcgctgaaggccatccccggtgtggtcgagcacggcctgttcatcaatctcgctcgtgttgtcatcgtcggcgaggacggtgaagcgcgggtgatggagctttag

SEQ ID NO: 2181 - DNA, 708 bp, Oceanicaulis alexandrii HTCC2633
atgagcgcagtcgagcagaagacacgcgccgccgaggcggctctggagttcgtcgaggacggcatgacgctgggcctgggctcgggctccacggcggacatctttgtccgtcttctgggcgcggcgctcgaaagcggatcgctgaagaacgtcaagggcgtgcccacttcggagaataccgccagggtcgcgcgggaagccggcgtaccgcttctggaagtggatcaggccgacaagatcgacgtcaccattgatggcgccgacgaggtcgatggccgtttccggctgatcaagggcggaggcggttgcctgctgcgagagaagatcatcgcccacgcgtctgacctcatggtcgtggtggtcgatgaaaccaagctggtggaaaccctgggcgccttcgccctgccggtcgaggtggatccgttcggtttcaccatcaccgccaagaaggtctatgacgcgctcactgcctctggcgtggtgcgcccggacgtgaagctgcgctgccgcggcgacggcaatgatccctatctgaccgatggcggcaattacattctcgattgcgcctgcaccgcgcttgaagaccccgagcaggtcgctgcgcgcctgaacgccatccccggcgtggtcgaacatggccttttcatcaacctcgcccgcgccgtgatcgtcggcgaggaagacggcgcgcgggtgctggagctttag

SEQ ID NO: 2182 - DNA, 702 bp, Hirschia baltica
atgtcagatattgctaaacgtaatgccgcaatcgaagctctcaaactcgtcgaagatggaatgacgcttggccttggaactggctctacagcagcatttttcgttgaagagcttggtaagaaggtgcaattgggactggatgttatctgtgtatctacttctgaagttacagaagctcaggcgcgttcgttgaatatcccgatggctgatttagatacagcaccaacaatacatcttactatagatggggcagatgagtttgatcctgaacttcgccttataaaaggtggcggtgctgctttgttacgtgaaaaaattattgccgactcttctgacatgatggttgtgatcactgatgcttccaaacaagtggctcagttgggtgcctttccacttcctgtagaagttaatccatttggtatggcgctcacaaaagcgcgtattgaagagacattagaaattctaggaatgtacggtattcacgtcaatgtacgtttaaatgagggggggggacctttacttaccgatggcggtcaccacattctggatctacattgtaaggctattccagacccagatatgctaggtgccgtgttggatcaaattccaggcgttgttgagcacggattatttctggatattgctgacgcggtgatcattggaacagaaactggcgcagaaacgatagctagagaagaataa

SEQ ID NO: 2183 - DNA, 726 bp, Methylocella silvestris BL2
atgaccaccctaagccccgatgaggccaaacgcgccgcggccgccgaggcgatcaagctcgtcaggcccggcatgaagcttggccttggcacgggatccacggcgcggcatttcgtcgatcttctcggcggcctcgtcgccgcggggctcgatgtcctctgcgtgccgacctcggaggagacgcgggcccaggcggcggcgctcggcgtcgcgctgacgacgatcgacgccgagcccgagctcgacctcaccgtcgacggcgccgacgagttcgatgacagtctgcggctggtcaagggcggcggcggcgcattgctcagggaaaaaatcgtcgccacggcctcgaagacgatggtcgtgatcgccgacgtctccaaacatgtggagatcatgggcaaattcccgctgccggtcgaggtgacccggtttggcctcgaggcgacgcggcggctgatccgcgccagggcggaggaggcgggctgcgccggcgagatcgtgctgcgcgacaagggccccggtcagcctttcatcaccgacaatggcaatttcatcctcgactgccatttcggcgcgctgccgcgtcctgagcaattggcgcaggatctcagtgcgatcccgggcgtcgtcgagcacggcctcttcatcggccttgctaaagcggtgatctgcgccggcccgggcggaatcgagatcttcggccggctcgaagcacaggcgccgccctga

SEQ ID NO: 2184 - DNA, 711 bp, Beijerinckia indica
atggcccttcttaatcccgacgaagccaagcgtcttgccgccgccaaggccttggaactggtgaaacccggcatgcgtctcggtcttggcaccggcaccacggcggcgcatttcgtggatctgcttggcgccaaggtcgccgagggccttgatgtgctctgtgtcccgacatcggagcgcacgcgcacccaggcggacacttacaagattcccttgtcgacgctcgatgcgacccctgagctcgacctgacaattgatggggcggatgaatttgatccgcaattacgcctcattaaaggaggtggcggcgcgcatctgcgggagaaaatggtcgccgcagcctcgaaacgcatggtggtcattactgatgcctccaaggcggttcagacgctcggcaaatttcccttgccgatcgagatcaatgtgtttggcgccgaggcgacgcgactcatgatcattcgcgcggctgcggcctgcggttgccagggggacgtcaaactgcgccgcattccgagcggcggtccctatgtgaccgacaatggccattatattgtcgatgcttcgtttggtgcgattcctgatcccgaaaagctctctacggcgctgctcgagattcctggggtcatcgaacatgggctttttatcggtctcgccaaggcggttatttgcgcggggtcggaaggcatcgagatttttggccaactcgattga

SEQ ID NO: 2185 - DNA, 726 bp, Hyphomicrobium denitrificans
atgagcagcgacgattggaagcgtcaggcggcggaacaagccttgagctacgttgaagacggcatgaagctcggcctcggtacggggtcgacggccgccaagttcgtcgatcttctcggcgaaaaagtgaaaggcggcctgaaagtcgtctgcgttccgacctccgaggcgacacgcgcgcaggcggcggctttgggaattcctctcgccaccctcgacgagcatccagccctcgatctgacggtcgacggcgccgacgagatggacgaggagatgcgtctgatcaaaggtggcggcggcgccctgttgcgcgaaaagatcgtcgcggtcgcgtccgaccgggtcgtgatcattgccgacagctcgaagcgcgtcgatgttttggggcgctttccgctgccgatcgaagtcgtgccgtttggcctcgcatcgacgcaacgcctgatctttcagatggccaccgacgccggttgcgatggcgaaatcaaactgcgcctgggcgcgggcggtgcccccttcgtgacagacaatggcaaccatattctcgattgctcgttcggcgcgattgacgatccggaggcgctggacgacgctctgaagctcgttccgggcgtcgtggagacgggactgtttctcggcatcgccgacgtgggaattgttgccggaccgatgggcgtcgaagttctttcggcgatcgatgctgatttcgacgaggagaattcataa

SEQ ID NO: 2186 - DNA, 708 bp, Methylobacterium sp. 4-46
gtgagcgccgccctcaagcgcgcggccgccgccagggcgctcgacctcgtcgcggacgggatgcgcctcggcctcggcaccggctccaccgcggccgaattcgtcgagctgctgggcgcgcgggtgcgggccgggctctcggtcgtcggggtgccgacctcggaggccacgcaccgggccgcgcaggcggcgggcatccccctcaccaccctcgacgagacccccgaactcgacctgaccatcgacggcgccgacgagatcgacggggcgcgccgcctcatcaagggcggcggcggcgcgctgctgcgcgagaagatcgtggcggcggcgagccggcgcatggtcgtgatcgcggatgcgggcaagcgggtcgagacgctcgggcgcttcccgctgccggtcgaggtggtccccttcggcctcgccgccacgcggcgcgccgtggagggcgccctcggccgcgccggctgcgcgggcgaggtcgcgctgcgccgggccgcggacggcgcgcccttcgtcaccgacggcgcccacctgatcctcgacgcgcatctcggccgcatcccggatcccgaggccctggccgccgcgctcgcggccgtccccggcgtggtcgagcacggcctgttcctcggcctgtgcagcggcgccatcctggccgccgatgaggcgggcgaggtgcgcctcctgaccctcggcaccctctga

SEQ ID NO: 2187 - DNA, 708 bp, Methylobacterium nodulans ORS 2060
gtgagcgccgacctcaagcgcgccgccgccgcccgtgccgtcgacctcgtccaggacggcatgcggctcgggatcggcaccggctcgaccgcggcccagttcgtggagctgctcggcgcacgggtgcggagcggcctctccgtggtcggcgtgccgacctccgaggcgacgcaccgcgccgccgccgccgccggcatcccgctgacgacgctcgacgagacgccggagctcgacctcaccgtcgacggcgccgacgagatcgacggatcgctccgtctcatcaagggcggcggcggtgcgctcctgcgcgagaagatcgtggcggcggccagtcgccggatggtcgtgatcgccgacggcagcaagcaggtcgccacgctcggccggtttccgttgccgatcgaggtggtgcccttcggcctcggcgcgacgcgccgcgcgatcgcggccgcgctgacgcggacgggctgcgcgggcgagctcactctgcgcaccggccgcgactttgcgccgttccggaccgacggcgcccacctgattctcgatgcgcatctcggtcgcatcccggacccggacgccctcgcggcggcgcttgcggcggtgcccggcgtggtcgagcacgggctgttcctcggcctgtgcaccggcgccatcctggccgccgaggaggccggcgccatccgtctcctcaccctcggcgcggtctag

SEQ ID NO: 2188 - DNA, 711 bp, Methylobacterium extorquens
gtgagcgcgccggatctgaagcgggccgcggccgagcgcgcgatccccctggtcgaggacgggatgcgcctcggcatcggcacgggcagcacggccgcggccttcatcaagctgctgggcgagcgcgtgcgcgccgggctcaaagtgaccggcgtgccgacctcggaggcgacccgcatcgcctgcgagcgcgagggcatcccgctcgccaccctcgaagacctgcccgaactcgatctcaccatcgacggggccgacgaggtcgatggaagcctgcgcctcatcaagggcggcggtgccgccctgctgcgcgagaagatcgtcgcggtcgcgagccgccgcatggtcgtgattgccgacgcctccaagcacgtcgagaccctgggcgcctttccgctgccggtggaagtgaacctgttcggcatcggcgccaccacccgcgccgtcgaggcggcggtggcgcgggccggctgcacgggcgagaccgtgcgccgccacgacgcctccggtgcccccctcctcaccgatggcggccacgccatcctcgatctgcggctcggccgcattcccgatccggaggctttgtccgccgggctctgggcggtgcccggcgtggtcgagcacggcctgtttctcggcatcgccgacgcggccatcctcgccgcggccgaaggcgatgcggccgtcgtcagcgttctcggccgcctctaa

SEQ ID NO: 2189 - DNA, 711 bp, Methylobacterium extorquens
gtgagcgcgccggatctgaagcgggcggcggccgagcgcgcgatccccctggtcgaggacgggatgcgcctcggcatcggcacgggcagcacggccgcggccttcatcaagctgctgggtgagcgcgtgcgcgcggggctgaaagtgaccggcgtgccgacctcggaggcgacccgcatcgcctgcgagcgcgagggcatcccgctcgccaccctcgaagacctgcccgaactcgatctcaccatcgacggggccgacgaggtcgatggaagcctgcgcctcatcaagggcggcggtgccgcgctgctgcgcgagaagatcgtcgcggtcgcaagccaccgcatggtcgtgattgccgacgcctccaaacacgtcgagaccctgggcgcctttccgctgccggtggaagtgaacctgttcggcatcggcgccaccacccgcgccgtcgaggcggcggtggcgcgggccggctgcacgggcgagatcgtgcgccgccacgacgcctccggtgcccccctcctcaccgatggcggccacgccatcctcgatctgcggctcggccgtattcccgatccggaggctttgtccgccgggctctgggcggtgcccggcgtggtcgagcacggcctgtttctcggcatcgccgacgcggccatcctcgccgcggccgacggcgatgcggccgtcgtcagcgttctcggccgcctctaa

SEQ ID NO: 2190 - DNA, 711 bp, Methylobacterium chloromethanicum CM4
gtgagcgcgccggatctgaagcgggccgcggccgagcgcgcgatccccctggtcgaggacgggatgcgcctcggtatcggcacgggcagcacggccgcggccttcatcaagctgctgggcgagcgcgtgcgtgcggggctgaaagtgactggcgtgccgacctcggaggcgacccgcatcgcctgcgagcgcgagggcatcccgctcgccaccctcgaagacctgcccgaactcgatctcaccatcgacggggccgacgaggtcgatggaagcttgcgcctcatcaagggcggcggtgccgcgctgctgcgcgagaagatcgtcgcggtcgcgagccgccgcatggtcgtgattgccgacgcctccaagcacgtcgagaccctgggtgccttcccgctgccggtggaggtgaacctgttcggcatcggcgccaccacccgcgccgtcgaggcggcggtggcgcgggccggctgcacgggcgagatcgtgcgccgccacgaggcgtccggtgcccccctcctcaccgatggcggccacgccatcctcgatctgcggctcggccgtattcccgatccggaggctttgtccgccgggctctgggcggtgcccggcgtggtcgagcacggcctgttcctcggcatcgccgatgcggccatcctcgccgcggccgaaggcgatacggccgtcgttagcgttctcggccgcctctaa

SEQ ID NO: 2191 - DNA, 711 bp, Methylobacterium extorquens
gtgagcgcgccggatctgaagcgggcggcggccgagcgcgcgatccccctggtcgaggacgggatacgactcggcatcggcacgggcagcacggccgcggccttcatcaagctgctgggtgagcgcgtgcgcgcggggctgaaagtgactggcgtgccgacctcggaggcgacccgcatcgcctgcgagcgcgagggtatcccgctcgccaccctcgaagacctgcccgaactcgatctcaccatcgatggggccgacgaggtcgatggaagcttgcgcctcatcaagggaggcggtgccgccctgctgcgcgagaagatcgtcgcggtcgcgagccgccgcatggtcgtgattgccgacgcctcaaagcacgtcgagaccctgggtgcctttccgctgccggtggaggtgaacctgttcggcatcggcgccaccacccgcgccgtcgaggcggcggtggcgcgggccggctgcacgggcgagatcgcgcgccgccacgacgcctctggtgtccccctcctcaccgatggcggccatgccatcctcgatctgcggctcggccgcattcccgatccggaggctttgtccgctgggctctgggcggtgcccggcgtggtcgagcacggcctgtttctcggcatcgccgacgcggccatcctcgccgcggccgagggcgatgcggccgtcgtcagtgttctcggccgcctctaa

SEQ ID NO: 2192 - DNA, 711 bp, Methylobacterium populi BJ001
gtgagcgcgccggatctgaagcgggcggcggccgagcgcgcgatccccctggtcgaggacgggatgcgcctcggcatcggcacgggcagcactgcggcggccttcatcgccttgctgggcgagcgcgtgcgcgcgggactcaccgtgaccggcgtgccgacttcggaggcgacccgaatcgcctgcgagcgcgagggcatcccgctggcgacgctggaagagctgcccgaactcgacctcaccatcgatggcgccgacgaggtcgacggcaacttgcggctcatcaagggcggcggcgctgcgctgcttcgcgagaagatcgtcgcggcggcgagccgccgcatggtggtgatcgccgacgcctccaagcgggtcgagacgctcggtgccttcccgctgccggtcgaggtcaacctgttcggcatcggcgccaccacccgcgccgtcgaggcggcggtggcggcggccggctgcatcggcgagatcgtgcgccggctcgacaaggcgggccagcccgtcctcaccgatgggggccacgccctcctcgacctgcggctcggccgcatccccgatccggaggcgctgtccgcccggctctgggcggtgcccggcgtggtcgagcacggcctgttcctcggcatcgccgacgcggccatcctggccgctgccgagggcgatcaggccgtggtcagcgttctcggccgcctctga

SEQ ID NO: 2193 - DNA, 714 bp, Methylobacterium radiotolerans
gtgagcgggccggacctgcggcgggccgcggccgcccgcgccctcgacctcgtcgagccgggcatgcggctcggcctcggcacgggctccacggcggcggccttcgtggcgctcctcggcgagcgcgtccgtgccggcctcgacatcgtcggcgtaccgacctccgaggccacgcgcgcgcaggccgagagcctgggcatccgcctcgcgaccctggacgagcagcccgagctcgacctgaccatcgacggcgccgacgaggtcgacgaccggctccgcctgatcaagggcggcggcgcggcgctcctgcgcgagaagatcgtcgcctgcgcgagccgccgcatggtggtgatcgccgacgcggccaagcacgtggcgcggctcggcgccttcccgctcccggtcgaggtcaatcccttcggcctcaaggccacgcaccgcgccgtcgaggcggcggtcgcgggggccggctgctccggtgacgtccggctgcgcgcccaggccgatggcaagcccctggtcacggacgggggccattacatcctcgacgcgcgcctcggtgcgattcccgatccggaggccctcggcgccgccctctgggccgtgccgggcgtcgtcgagcacggcctgttcctcggcatcgccgacgccgcgatcctggcggcggcgcgggacgggcaggccgaggtcaccgttctcggcagcctcacctga

SEQ ID NO: 2194 - DNA, 699 bp, Rhodopseudomonas palustris
atgaacaaggaagatctgaagcggcaggccgccgcgcgcgcgctggacgaggttcgcgacgggatgaagatcggtctcggcaccggctcgaccgccaagcatttcgtcgagctgctgggcgaaaaggtccgtgccggtctcgacgtcatcggcgtgccgacctccgaggtgacccgggccgacgccgagcgctgcggcatccggctgaccacgctcgacgagatcgaccggctcgacctgacggtcgatggcgccgatgagatcgatccgcggctcgaactgatcaagggcggcggcggcgcgctgctgcgcgagaagatcgtcgccgccgcatccgatcgcatgatcgtgatcgccgacgaaaccaaatgggtcgactgcctcggccattttccgctgccggtcgaagtgatcccgttcgggctggccgcgacccggcgcgcgatcgaacaggcctgcgccgaggtcggcgcatccggtcgattgcagcttcgcgaaggcaaggacggccatgctttcgtcaccgatggtggccactggatcatcgacgcccacctcgggcggataccggatgcgcctcgcctggcccagctgttgtcggcgattccgggcgtagtcgagcatgggttgttcatcgggatcgccagcacggtcgtgctcgcggggaccgacggaattcgaactgtcgaacgggcgtag

SEQ ID NO: 2195 - DNA, 699 bp, Rhodopseudomonas palustris
atggacaaggaagatttgaagagacaggccgcagcgcgggcgttggaagaggttcgcagcggtatgaagctcggcctcggcaccggctcgaccgccaggcatttcgttgaactgctgggggaaaaggtccgcggcggactcgatgtcatcggcgtgcccacctccgaggtgacccgcgccgacgctgagcgctgtggtattcggctgaccaccctcgacgaaatcgaccggctcgacctgacggtggacggcgccgacgaggtcgatacccgcctcgaattgatcaagggcggcggcggcgccctgttgcgcgagaagatcgtcgcggccgcatccgatcgcatgatcgtgattgccgatgaatcgaaatgggtcgactgtctcggcaagtttccgcttccggtcgaggtgatcccgttcggactcgcggcgacccggcgcgcgattgaaaaggccttcacgcaagtcggggcggcagggcaattaaagcttcgcgatggcgaggccggccatgcttttgtcaccgatggtggccactggatcgtcgacgcccatctcgggcggataccggatgctcctcgcctggccaagttgttgtccgagattccgggcgtagtcgagcatgggttgtttatcgggatcgccagcacggtggtgctcgcggggaccgaaggaattcgaactgtcgaacgggcgtag

SEQ ID NO: 2196 - DNA, 699 bp, Rhodopseudomonas palustris
atggacaaggaagagttgaagcggcgggctgcggcgcgggcgctggaagaggtgcggggcggcatgaagctcggcctcgggaccggctcgacggccaagcatttcgttgaactacttggcgaaagggtgcggctcgggctcgaaatcatcggcgtgccgacgtcggaagtgacgcgcgcggatgccgagcgttgcggtatccggctgacgagcctcgacgagatcgaccgactcgacatcaccatcgacggtgccgacgaggtcgaccaccatctcgacctgatcaagggcggcggcggggcgctgctgcgcgagaagatcgtcgccgcggcttcggatcgcatgatcgtgatcgcggacgaatccaagctggtcgacactcttggccgcttcccgctgccgatcgaggtgatcccgttcggcctcggcgccacccgccgggcgctgcagaatgccttcacggccgccggctgcgacggcgaattaaagctccggcccggcaaagacggccatgctttcgtcaccgatggtggccactggatcctcgacgcccagctcgggcggatacccgatgctcctcgtctggcccagttgctgtccgtgattccgggcgtagtcgagcatgggttgtttgtcgggatggcgagcaccgtcgtgctggcaggggccgacggaattcgaaccatcgaacgcgcgtga

SEQ ID NO: 2197 - DNA, 726 bp, Rhodopseudomonas palustris
atgagctcggatgaattgaagagacaggccgccgcggtggcactggagcaggtccgcgacggcatgaagctggggctcgggaccggatcgaccgccaagcatttcgtggaactgctgggagcgaaggtgcagggcggtctgcaggtggtgggcgtccccacctcggaagtcacccgcgccgatgccgagcgctgcggaattccgctggcgacgctcgatgaggtcgaccatctcgacctcacggtggacggcgccgacgaaatcgatccggcgctcaatctcgtcaagggcggcggcggcgcgctgctgcgcgagaagatcgtcgccgcggcgtcaggacgcatgatcgtgatcgccgacgacagcaagctggtcgagacgctcggccgattcccgctgccgatcgaagtgatcccgttcggattggccgcgaccaggcgagcgatcgaacaggcgctcgccgtctgcggcatcgacggcgaactgaagctgcgcaacggcaaggatggccatgctttcgtcaccgacggcggccactggatcgtggacgcccatctgggacggattcccgatgctcctcgcttggccggattgttgagcgtgatccccgggatcgtcgaacatggcttgttcatcggtctcgcaagctcggtcgttctcgccagtccacacggaattcgcatcatcgagcggcccgcgtgccgcgattctggagaatcgaaatga

SEQ ID NO: 2198 - DNA, 726 bp, Bradyrhizobium japonicum
gtgaacatggaccagttgaagcggcaggctgcggcgcgcgccctcgaggaggtgcgtgacggcatgcaactcgggctcggcaccggctcgaccgccaagcatttcgtcgagctgctcggcgagcgcgtcgcggccggactcaaggtgatcggcgtgccgacctccgaggcgacgcgcctcgatgcgacgcgctgcggcgtgccgctgaccacgctcgacgagatcgatcatctcgacatcaccgttgacggcgccgacgagatcgatcccgagctcaacctgatcaagggcggtggcggcgcgctgctgcgcgagaagatcgtggcggccgcatcggatcgcatgatcgtgattgccgacgacaccaaatgggtgccgacgctcggccgctttccgctgccgatcgaggtcatcccgttcgggctcggggcgacgcgccgggcgatcgagacggcatttgcgcagtgcggcgtttccgggcaaatggcggtccgcaaggccaagggtggggacaaggatggccacgttttcgtcaccgatggcggccactggatcctcgatgcccagctcggacggatcgtggatccgcccagcctcgccaaggcgttgagcgccatccccggcgtggtcgagcatgggttgttcatcggcttggccagctcggctgttctggcgggtggcgagggaattcgcgtgattgaacggcgaaagccgaaaggagactag

SEQ ID NO: 2199 - DNA, 711 bp, Oligotropha carboxidovorans
atgtcgaaagaagagctgaagcgggctgctgcggcacgtgcgctcgagtatgtcagcgatgggatgcaacttggtctcggcacgggctcgacggccaagcatttcgtggaattgctgggcgaacgcgtgcgtgcgggcttgcgcgtcgtcggtgtgccgacttccgaggggacgcgcgccgatgcggagcgctgcggcgtgccgctcaccacgctcgatgacgtcgaccatctcgatctgaccgtcgacggcgctgatgaaatcgcgccctcgctcgacgtgatcaaaggtggtggcggggcgctgctgcgcgagaagatcgtcgctgccgcctcgacgcggatggtcgtgatctccgacgatagcaaatgggtcgagacgctcgggcgattcccgctgccggtggaggtgatcccgtttggccttggcgccacgcgccgggcgctcgccacggccttcgccgaggcgggtgtcacgggtgaaataacgctccggcaggggccggatggccatgcttttgtcaccgatggcggccactggattttggacgctcatctgggacgcatcccggagccgccgcgcctggccgcgcttctcagtgcgatccccggggtggtggagcacggattgttcatcggccttgcgaagacggcgattctcgctggctcgcaggggattcgtatcgttgatcggccgcgaggccgggtttga

SEQ ID NO: 2200 - DNA, 699 bp, Rhodopseudomonas palustris
atgagctcggatgaattgaagaggcaggcggccgcggctgcgctcgagcacgttcgcgacggcatgaagctcggcctcggcaccggttcgaccgccaaacacttcgtcgagctgctcggcgaacgggtgcgcggcggtctgaacgtggtgggcgtgccgacctccgaggtcacgcgcgccgacgcgctgcgttgcggcatcgccctgaccacgctggacgaggtcgaccggctcgacctcacggtggacggcgccgacgaaatcaatgccgcgctcaacctgatcaagggcggcggcggcgccttgctacgcgagaagatcgtcgctgcggcctccgaccgcatgatcgtgatcgccgacgaaagcaaactggtcgccaatctcggccgctttccgctgcccattgaagtcaattccttcggtctggccgcgacgctgcgcgcgatcgaagaggcctgcgccgaatgtggcgttttcggaccgctttcgttgcgaaaaggcagcgacggccatgctttcgtcaccgatgggggccactggatcgtggacgcccaattggggcggatccccgatgctcccagcctggcggaccagctcaacgcgatcccgggcgttgtcgagaacgggttgtttattggtctggcaagcatggcggtgctggcgggccccaacggaatccgcatcattgaacggccgtga

SEQ ID NO: 2201 - DNA, 693 bp, Bradyrhizobium sp. ORS278
atggatgcattgaagcggcaggcggcggcgcgtgcgctggaagaagtcgagagcggcatgaagctcggcctcggcaccggctcgaccgccaagcatttcgtcgatctgctgggcgagaaggtgcgcgccggcctcaaggtggtgggcgttccgacctccgaggcgacgcgggcgcaggccgaagcttgcggcgtgccgctcaccacgctcgacgagatcgaccgtctcgatatcaccatcgacggcgccgacgagatcaatccggcgctcgacctgatcaagggcggcggcggcgcgctgttgcgcgagaagatcgtcgccagcgcctcgaatcgcatgatcgtgatcgccgacgacagcaaatgggtcgcgcggctcggccgcttcccgctgccgatcgaggtggtcccgttcgggatcgcggccacgcagcgcgagatcgccgacgccttcaccaaggctggcgtggctgggccgatgagcttgcgcaagtccgcagatggccacgttttcgtcaccgatggtggccactggattgtcgacgttcgcctgggggagatcgaggatcccccgcgcctggcgagctttttgagcgcaattccgggcgtggtcgagcacgggctgttcatcggcctcggcagcacggcgatcctggcaggcgcacagggaattcgcgttatccagcggccttga

SEQ ID NO: 2202 - DNA, 693 bp, Bradyrhizobium sp. BTAi1
atggatgcattgaagcggcaggcggcggcgcacgcgctgcgcgaggtcgaaagcggcatgaagctcgggctcggcaccggttcgaccgccaagcatttcgtcgacctgctcggcgagaaggtccgcgccggcctcaaggtcgtgggcgtgccgacgtcggaggcgacgcgggcacaggcggaggcctgcggcgtgccgctgaccacgctcgacgagatcgaccatcttgacctgactgtggatggcgccgacgagatcaatccggcgctcgatctgatcaagggcgggggaggggcgctgctgcgcgagaagatcgtcgccagcgcttcagatcgcatgatcgtgatcgccgacgagagcaaatgggtggcccggctcggccgcttcccgttgccgatcgaggtgatcccgttcgggctggccgcgacccggcatgccattgctgccgccttcgcgaaggcgggcgtgtccggacagatggacctgcgcaagtcggcagatggccacgttttcgtcaccgatggcggccactggattgtcgacgtccgccttggggagatcgaggatcccccgcgcctggcgggtcttttgagcgcaattccgggcgtggtcgagcacgggctgttcatcggcctcggcagcacggcgatcctggcgggcgcacagggaattcgcgttatccagcggccttga

SEQ ID NO: 2203 - DNA, 699 bp, Nitrobacter sp. Nb-311A
atgacgttggatgcattgaaaagacaggctgcggcgcgggcccttgaatatgtcgaggacggcatgagactggggctcggaaccggatctaccgccaagcactttgtcgagcttttgggcgagcgtgtgcgcggcggattgaaagttgtgggcgtgccgacatcggaagtcacgcgggccgacgcggagcggtgcggtattcctctgaccaccctggatgacctcgacaggctcgatctgacggttgatggcgccgacgaaattgacgccgatctaaatctgatcaaggggggtggcggggcgcttctgcgcgagaaaatcgtggctgcgggatcggagcgcatgatcgtgatcgcggacgagacaaagtgggtggccgggctcggccgttttcccctgccgatcgaagtcattcctttcgggctcgccgcaacgcgacgcgcgattacggaggtgtttgcaaaagccggcgtttctggtgaactggtcattagaaagcggtcagatggccatgcttttgtcaccgatggcggccactggatttttgatgcccatcttgggcagatacccgatgcatcctatctggccggactgttgaatcccatacccggcgtcgtcgagcatggccttttcattggtctcgccggggtagcgatgctggcgggtgcacagggaattcgcattgtcgagcggcgttag

SEQ ID NO: 2204 - DNA, 699 bp, Nitrobacter winogradskyi
atgacgatggatgcattgaaaagacaggctgcggcgcgtgcccttgaatatgtcgaggacggcatgaggctgggtctcggaacgggatccaccgccaagcactttgtcgagcttttgggcgagcgcgtacgcgacgggttgaaggttgtcggggtgccgacatcggaagccacgcgggccgacgcggagcggtgcggcgttcccctgaccaccctggacgatctcgacaggctcgatctgacggtggatggcgcagacgaaatcgatcctgatctcaatctgaccaagggcggtggcggggcgcttctgcgcgagaaaatcgtggctgccgcgtcggaccgcatgatcgtgatcgctgacgagacaaaatgggtggcggggctcggccgctttcccctgcccatcgaagtcattccgttcgggctggccgcgacgcgacgggcgattacggaggtatttgcaaaagccggcgtttcaggtgaactggccgtcagaaagcgaccggatggccatgcttttgtcaccgatggcggccactggattttcgatgcccatcttgggcagatacctgatgcaagctatctggccggactgttgaatccgatacctggcgtcgtcgagcacggcctattcatcggcctcgcacgcgtggcgatgctggcgggcgcagagggcattcgtattgtcgagcggcggtag

SEQ ID NO: 2205 - DNA, 699 bp, Nitrobacter hamburgensis
atgacattggatgcattgaaaagacaggctgcggcgcgtgcccttgaatatgtcgaggacggcatgaggctgggtcttggaacgggatccaccgccaagcactttgtcgagcttttgggtgagcgggttcgggacgggctaaaggttgttggcgtgccgacatccgaagcaacgcgagccgacgcggagcggtgcggcattcctctgaccacgctggacgacctcgaccggctcgatctgacggtcgatggcgccgacgaaatcgatcccgatctgaatctgatcaagggtggaggcggcgcgcttctgcgcgagaagatcgtggctgcggcgtcggagcgcatgatcgtgatcgcggacgagacaaagtgggtggcggggctcggccgctttcccctgccgatcgaagtcatccccttcgggctcgcggcgacgcgacgcgccattgccgaggcgtttacgaaagccggcgcttccggtcagatggtcgtcagaaaggggccggacggccttgctttcgtcaccgatggcggccactggattttcgatgcccacctcgggcaaatacccgatgcatcccatctggccgggctgttgaatccgatacctggcgtcgtcgagcacggcctgttcattggcctcgcgcgtgtggcgatgttggcgggcgcacagggaattcgcgttgttgagcggcggtag

SEQ ID NO: 2206 - DNA, 879 bp, Azorhizobium caulinodans
ttgcctccttgtcgcaggttcggccgcaccttcaagggcggcgtttgcgggacggcacgggtggccggtgcgccgctttgcctgttcaagccaggcggcagagggacgcgaagatgcgccagccgcttgaggttcgcgccgttcgcggctaggcaaccggcgaaccgctggagcacagacatggccgacgccgaagagctgaaacgcgccgccgccgccaaggcgctcgaatacgtgaccgacggcatgcgcctcggcctcggcacgggctccaccgccaagcatttcgtggcgctgctcgccgagcgggtcgccgccggcctcaaggtgacgggcgtgccgacctccgagcagaccaaggcgcaggcgctttccctcggcgtgccgctggcgacgctggatgaactgccggagctcgatctgtgcatcgacggtgccgacgagatcggcccggagctcgctctcatcaagggtggtggcggcgctctgctgcgcgagaagatcgtcgccagcgccgcccgcgagatgatcgtcattgccgacgagaccaagactgtcgcgaccctcggccgctttcccctgcccatcgaggtcgtgaccttcggcgtcgaggccatcaagctgcggctgaagggcgccatcgcgacggccggatgcgatggcgagctgaagctgcgccacaaggcggatggcaagcccttcatcaccgatcagggcaatgtgatcgtcgacgcgcatctcggccgcatccccgatccgcgtgcactcgcccgtgcgctggaagaggtggccggcgtcgtggagcatggcctgttcctcggcctcgcccgccgcgcggtgctcgccggcgccaatggcatttcggtcatcacgccctga

SEQ ID NO: 2207 - DNA, 762 bp, Xanthobacter autotrophicus
atgccccacgccgcgccggttggccgcgcgaggggcaccggaacggaaactcccatggtgcacgccgaagatccgaagcgccgcgcggccgctcacgccctcacctacgtgaccgacggcatgcgcctcggcctcggcaccggctccaccgcccgccatttcgtggagctgttggccgagaaggtccatgccggcctcaacattctcggcgtgcccacctcagagcagactttgtcgcaggcggtctccctcggcgttccgatcgcgacgctcgacgaggccggtccgctcgacctgtgcatcgacggggcggacgaggtcggccccggccttgccctgatcaagggcggcggcggagcgctactgcgggagaagatcgtcgccagcgccgcgcgcgagatggtggtgatcgccgactcgagcaagaaggtggcgatgctcggccgcttcccgctgcccatcgaggtggtggatttcggcgtcgcctccatcgagcgccatgtggccgatgcggtgcgcaaggccggctgcgaaggcccggtgaagctgcgccgcgacggcgatggtcatcctttcgtcaccgatcagggccacctcatcctcgacgtccatctcggccgcatcccggacccggccgcgctcgcccgcgcggtggaggaagtcgccggcgtggtcgagcacgggctgttcctcggcctcgcccgccgggtcgtgctcgcgggcgcggacggcatcaccgtgctggagcccggcagcttctga

SEQ ID NO: 2208 - DNA, 696 bp, Parvibaculum lavamentivorans DS-1
atgaatgctgacgatcagaagaaagcggcggctgtccgcgcgcttgagttcgtgaaacccggcatgaaactgggcatgggaaccggctccacggcggaacatttcgtccgcgcgctgggcgaaaaggtgaaggcgggtctcgatattgtcggcgtgccaacctcggagcgcacggccaaactcgccgccagcctcggtatccccctcaccaatctcgacgatacgccgcatctcgatattacggtcgatggcgccgacgagctcgatggcaagctccgcctcatcaagggcggcggcggcgcattgctgcgcgagaagatcgtcgccacggcgtccgaccgcatgatcgtcattgcggatgcatcgaagctcgtgaagacacttggctcattcccgctccccgtcgaggtcatccccttcggcagcgccgtgacggcccgcaagattgcggaagtcgcgagcgcccatggatgcaccggcaagatgtcccgccgcgccgacgaatatggcgagcccttcttcaccgacagcgaaaacttcatctatgactgtgccttcggctccatcccggacccggacggcctctccgcggcgctgaaccgcattccgggcgtcgtcgataatggtttgtttatcggtatcgccgctatggccattgtcggaacggacaagggtaccgatatcatcgaagcgtaa

SEQ ID NO: 2209 - DNA, 681 bp, Agrobacterium tumefaciens
atgaagatcaaggccgccgaggccgcattgtcccatgtgcaggacggcatgcggctgggtatcggcaccggttcgacggccgaggaattcgtccgtcttctggcggagaaggttgcggccggcctgaaggtcgagggcgttcccacatccgagcgtaccgcacgtctgtgcgtcgagcttggcgtgccgctgaaatccctcgatgaattgccggaactggatctgaccatcgacggcgccgacgaagttgatcatgtactacgtctcgtcaagggcggcggcggcgcgctgctgcgcgaaaagatcgtggcggcagcatccggccgcatgatcgtcatcgccgaccagagcaaggtcgtcgagacgctgggcgcctttccgcttcccatcgagatcaatcccttcggccaggtggcgacacgcatcgccattgaaaaactggcggctcggtcgggtctttcgggcgaactgacgatgcgttcttccggcgacggcgccttcatgacggatggcggacacctgatcctcgacgcatcttttggccgtattcctgatgcagaagcactggcacgcgagctgaacactatccccggtgttgttgagcacggacttttcataaatttggcatcgcttgccatcatcgcgggccctgaaggcgcccgcatgatgcaggcagtataa

SEQ ID NO: 2210 - DNA, 681 bp, Agrobacterium tumefaciens; identical to SEQ ID NO: 2209

SEQ ID NO: 2211 - DNA, 699 bp, Rhizobium etli
atggatgcccgcgaaatgaagatcaaggccgccgaggccgcactcgcccatgtcgaagacggaatgcgtctcgggatcgggacgggcagcacggcggaagaattcgtccggctgctggccgaaaaagttgcgagcggctttagggtcgaaggcgttccgacatctgaaagaacggcgcggctctgcgtcgagctcggtgtcccgctgaagtcgctcgacgagctgccggcgctcgatctgacggtggacggcgccgacgaggttgatccggcgctcagattgatcaagggcggcggcggcgcgctgctgcgcgaaaagatcgttgccgccgcttcggagcggatgatcgtcatcgccgacgagagcaagctggtcgatacgcttggcgcctacgcgctgccgattgaggtcaacccgttcggtctggtctcgacacggatggcgatcgaaaaagtcgcggcccggctcggcctttccggcgaactcagcctgcgccagtcgggtgacggagagtttaccacggatggcggccatcacattatcgatgcatcttttggccgcattcctgatgcagaggcgctttcgagcgagctgaattccatacccggcgtcgtcgaacacgggctctttatcaatatggcggcacttgcgatcattgccggtcctgcaggtgcacgcacgctgcaggcaaacagataa

SEQ ID NO: 2212 - DNA, 699 bp, Rhizobium etli
atggatgcccgcgaaatgaagatcaaggccgccgaggccgcactcgcccatgtcgaagacgggatgcgcctcgggatcgggacaggcagcacggcggaagaattcgtccggctgctggcggagaaggttgcgggcggcttcagagtcgaaggcgttccgacatccgaacggaccgcacggctctgcgtcgaactcggtgttccgctgaagtcgctcgacgagctgccggcgctcgatctgacggtcgacggcgccgacgaggtcgatccggcgctcagactgatcaagggcgggggcggcgcgctgctgcgcgaaaagatcgttgcggccgcttctgaacggatgattgtcatcgccgacgagagcaagctggtcgatacgcttggcgcctacgcgctgccgatcgaggtcaacccgttcggtctggtttcgacgcggatcgcgatcgagaaagtcgcggcccggctcggcctttccggcgaactcagcctgcgccagtcgggtgacggagagtttaccacggatggcggccatcacatcatcgatgcatcttttggccgcattcctgatgcagaggcgctttcgagcgagctgaattccatacccggcgtcgtcgaacacgggctctttatcaatatggcggcacttgcgatcattgccggtcctgcaggtgcgcgcacgctgcaggcaaacagataa

SEQ ID NO: 2213 - DNA, 699 bp, Rhizobium leguminosarum
atggatgcccgcgaaatgaagatcaaggccgccgcggccgcacttgcccatgtcgaagacggaatgcgcctcggcatcggcaccggcagcaccgcggaagaattcgttcgtctgttggcggagaaagtcgcaagcggcttcaaggtcgaaggcgttccgacgtctgaaagaacggcgcggctttgcgtcgaactcggcgtgccgcttaagtcgctcgatgaactgccggcactcgacctgacgatcgatggcgccgacgaggtcgatccggcgctgagattgatcaagggcggcggcggcgcgttgctgcgcgaaaagatcgtcgcggccgcttccgagcggatgatcgtcattgccgacgagagcaagctggtcgatacgctcggcgcctacgcgctgccgatcgaggtcaatccgttcgggctcgtctcgacacggatcgcgatcgagaaggtcgcggcccggctcggccttgcaggcgaactcagcctgcgccaatccggtgacggagagtttaccacggatggcggccatcacattatcgatgcatcttttggccgcattcctgatgcagaggcgctttcgagcgagctgaattccatacccggcgtcgtcgaacacgggctctttatcaatatggcggcacttgcaatcattgccggtcctgcgggtgcgcgcacgctgcaggcaaacagataa

SEQ ID NO: 2214 - DNA, 699 bp, Rhizobium leguminosarum
atggatgcccgcgaaatgaagatcaaggccgccgaggccgcactcgcgcatgtcgaaagcgggatgcgtctcgggatcggcaccggcagcacggcggaagaattcgttcgcctgctggcggagaaggttgctggcggcttcagggtcgaaggcgtcccgacgtccgaacgaaccgcgcggctctgcgtcgaactcggtgtgccgctgaagtcgctcgacgaactgccggcactcgatctgacgatcgatggcgccgacgaggtcgatcaggcgctcaggctgatcaagggtggcggcggtgcgctgctgcgcgaaaagatcgtcgcggccgcgtcagagcgaatgatcgtcattgccgacgagagcaagctggtcgatacgctcggtgccttcgcgctgccgatcgaggtcaatccgttcgggctcgtctcgacgcggatcgcgatcgaaaaggtcgcggcccggctcggcctctcgggtgaactcgctctgcgccagtcgggtgacggagagtttaccacggatggcggccatcacatcatcgatgcatcttttggccgcattcctgatgcagaggcgctttcgagcgagctgaattccatacccggcgtcgttgaacacgggctctttatcaatatggcggcacttgcgatcattgccggtcctgcgggtgcgcgcacgctgcaggcaaacagataa

SEQ ID NO: 2215 - DNA, 699 bp, Rhizobium etli
atggatgcccgcgaaatgaagatcaaggccgccgaggccgcactcgcccatgtcgaaagcggaatgcgtctcggcatcggcacgggcagcacggcggaagaattcgtccgcctgctggcggagaaggtcgcgggcggcttcagggtcgaaggcgttccgacgtctgaaagaacggcgcggctctgcgtcgaactcggtgttcccttgaagtcactcgatgaactgccggcactcgatctgacgatcgacggcgccgacgaggtcgatcaggcgctgaggctgatcaagggcggcggcggcgcgctgctgcgcgaaaagatcgtcgcggccgcttccgagcggatgatcgtcatcgccgacgagagcaagctggtcgacacgctcggcgccttcgcgctgccgatcgaggtcaacccgttcggtctcgtctcgacgcggatcgcgatcgagaaagttgcggcccggctcggtctttccggcgaactcggtcttcgccagtccggtgacggagagtttaccacggatggcggccatcacatcatcgatgcatcttttggccgcattcctgatgcagaggcgctttcgagcgagctgaattccatacccggcgtcgtcgaacacgggctctttatcaatatggcggcacttgcgatcattgccggtcctgcgggtgcgcgcacactgcagaaaaacagataa

SEQ ID NO: 2216 - DNA, 699 bp, Rhizobium leguminosarum
atggatgcccgcgaaatgaagatcaaggccgccgaggccgcactcgcccatgtggaaagcgggatgcgtctcgggatcggcaccggcagcacggcggaagaattcgttcgcctgctggcggagaaggtcgcgggcggcttcagggtcgaaggcgttccgacgtccgaacgaaccgcgcggctctgcgtcgaactcggcgtgccgctgaagtcgctcgacgaactgccggcactcgacctgacgatcgatggcgccgacgaggtcgatcaggcgctcaggctgatcaagggcggcggcggcgcgctgttgcgcgaaaaaatcgtcgcggccgcctccgagcgaatgatcgtcattgccgacgagagcaagctggtggaaacgctcggcgctttcgcgctgccgatcgaggtcaatccgttcgggctcgtctcgacgcggatcgcgatcgaaaaggtcgcggcccggctaggtctttccggtgaactcgatctgcgccagtcgggtgacggagagtttaccacggatggcggccatcacatcatcgatgcatcttttggccgcattcctgatgcagaggcgctttcgagcgagctgaattccatacccggcgtcgttgaacacgggctctttatcaatatggcggcacttgcgatcattgccggtcctgcgggtgcgcgcacgctgcaggcaaacagataa

SEQ ID NO: 2217 - DNA, 699 bp, Rhizobium etli
atggatgcgcgcgaaatgaagatcaaggccgccgaggccgcgctcgcccacgtcgaaagcgggatgcgtctcggcatcggaactgggagtacagcggaggaattcgtccgcctgctggcggagaaggtcgcgggcggcttccaggtcgaaggtgttccgacgtccgaacgaacggcgcggctctgtgtcgagctcggtgttccgctgaagtcgcttgacgagctgccggcactcgatctgacggttgacggcgccgacgaggtcgatccggcgctcaggctgatcaagggcggcggcggtgcgctgctgcgcgaaaagatcgtcgccgccgcttcgcagaggatgatcgtcatcgccgacgagagcaagctggtcgaaacactcggcgccttcgcgctgccgatcgaggtcaatccgttcggtctcgtctcgacgcggatcgccatcgaaaaggttgccgcccggctcggcctttccggcgaactcaacctgcgccagtccggtgacggagagtttaccacggacggcggccatcacatcatcgatgcatcttttggccgcattcctgatgcagaggcgctttcgagcgagctgaattccatacccggcgtcgttgaacacgggctctttatcaatatggcggcacttgcgatcatcgccggtcctgcgggtgcgcgcacactgcaggcgaacagataa

SEQ ID NO: 2218 - DNA, 702 bp, Agrobacterium radiobacter
atggacgcccgccaaatgaagatcgaggccgcaagggcggctctggcctatgtcgagagcggtatgcggctcggggtcggtacgggcagcacggccgaggaatttgttcggttgctcgccgagaaggttgcggctggcctcgtgatcgagggagttccgacctccgagcggacagcccggctctgcgtcgacctcggcgtgccgttgaagtcgctcgatgaacttcccgaactcgatctcaccatcgatggtgccgacgaagtggatggcgccctgcggctgatcaagggtggcggcggcgcgctgctgcgcgaaaagatcgtcgcggcctcgtcacagcggatgattgtcattgccgacgaaagcaaggttgttcagacgcttggcgcctttgcgctgccgatcgaggtgaacccgttcggcctcgtttccacgcgtatccagatcgagaagacggccgcccgcctgggcctttccggcgcgctcaacctgcgccaatcggaagacggcaacttcatgaccgacggcgggcatttcatcatcgacgcatcttttggccgtattcctgatgcagaggcgctgtcgattgcgctaaattcgattcccggtgttgtcgaacacgggctctttatcaacatggcgacacttgcgattattgccggtccctccggcgcacgcacgttgcaggcgaacaatacatag

SEQ ID NO: 2219 - DNA, 696 bp, Sinorhizobium medicae WSM419
atggacgcccgccaaatgaagatcaaggctgccgaagcggcgcttgaacatgtcgaaaacggtatgcggctcggaatcggcactggctcgactgcagaagagtttgtcagggtcctggcggagaaggtggcctccggctttcagatctccggcgtcccgacgtccgagcggacggcgcgcctctgcctcgagctcggtgtgcctctcaagtcgctcgacgaactgccggaactggacctgaccatcgacggagccgacgaagtcgacggaaaactgcgcctgatcaagggcggcggtggtgcgttgctgagggagaagattgtcgcgagcgcttcggcgcggatgatcgtcatcgccgacgaaacaaaggtcgtggacgtccttggcgccttcaagctgccgatagaggtcaatcctttcggccagctcgccacgcggctcgcaatcgagaaggttgcttcgcgtctgggtttgacgggggacatcgtcgtgcgcgcatcgggcgacggacccttcatgaccgatggcggacacctgattctcgatgcatcttttggccgtattcctgatgcagatgcgctcgcggtagagctgaatgccatcccgggggtcgttgagcacgggcttttcatagaaatggcgtcgatggcgatcattgccggtcctgagggagcgcgcacgcttaaggcgtcttga

SEQ ID NO: 2220 - DNA, 696 bp, Sinorhizobium meliloti
atggacgcccgccagatgaagatcaaggccgccgaagcggcacttgaacatgtcgaaagcggcatgcggcttggaataggcacaggctcgacggctgaagaattcgtccgattgctggccgagaaagtggcatccggctttcagatctccggcgttccgacgtccgagcggactgcgcgcctctgcctcgagctcggtgtgcctctaaagtcgctcgacgaactgccggaactggacctgacgattgacggggccgacgaggtcgacggaaagctgcgcctgatcaagggcggcggcggtgcgttgctgcgcgagaagatcgttgcgagcgcctcgacgcggatgatcgtcattgccgacgaatcgaaggtcgtggacgtgctgggcgctttcaagctgccgatcgagatcaatcctttcggccaggtcgccacgaggctcgcgatcgagaagaccgcctcgcggctgggtctggcaggggaaatcgtcgtacgatcctccggcgatggagtcttcatgaccgatggcggacacctcattctcgatgcatcttttggccgtattcctgatgcagatgcgctcgcggtggagctgaacgccatcccgggggtcgttgagcacgggcttttcatagatgtggcgtcgatggcgatcattgccggtcctgagggagcgcgcacgcttacggcgtcttga

SEQ ID NO: 2221 - DNA, 696 bp, Rhizobium sp. NGR234
atggacgcccgccagatgaagatcaaggccgcccaggcggcgctcggctatgtcgaaagtggaatgcggctcggtatcggcactgggtcgacggccgaggaattcgtccggctgctggccgaaaaggtagcctccggcttccaaatccagggtgtgccgacctccgagcggacggcgcggctttgcctcgaactcggcgtgccgctgaagtcgctcgatgaattgcccgaattggatctgaccatcgacggtgccgatgaggtcgacggcaaactgcgcctgatcaaaggcggtggcggagcgctgctgcgcgaaaagatcgtcgcaagcgcctcggaacggatgatcgtcattgccgatgaatcgaaggtggtcgacgttctcggtgccttcaagctgccgatcgaggtgaaccagttcggtctaacaacaacgcgtctggcgatcgagaaggttgccgcgcgcctcggtttgacgggcgacattggactgcgtgcctccggcgacggccccttcatgaccgatggcggacacctcatcctggatgcatcttttggccgtattcctgatgcagaggcgcttgcggctggattgaatgcaattccgggagtcgtcgagcatgggctctttctcgggatggcttcactggcgatcatcgccggtccggagggggcgcgcacgctcacggcaggctga

SEQ ID NO: 2222 - DNA, 699 bp, Agrobacterium vitis
atggacgttcgtcaaatgaagatcaaagccgcggaactggctttgtcttatgtcgaaaatgggatgcgtctcggcatcggcactggctcgaccgcagaggagttcgtgcggttgctggctgaaaaggtcgccgacggtttcaaggttcaaggcgtgccaacgtcggagcgcaccgcaaggctttgcctggaactgggcgtgccgctgatgtcgctcgatgaattgccggaactggacctaaccgtcgatggcgccgatgagcttgatcgtcacctgaccctgatcaagggcggcggcggtgcgctgctgcgcgaaaagatcgttgctgccgcctcgtcgcgggtgatcgtcattgccgacgaaacaaagctggtggagacgctcggcgcttatccgctgcccatcgagatcaatggattcggtggcattgcaacccggatctccatcgaaaaggctgccgccaaactgggcctgtcggggacgattggcctgcgcatgtctggtgacgatctgtttatgacagatggtgggcattatattctcgatgcttcttttggccgcattcctgatgcagtggccctttctcaggcattgcatgctatacccggggtggtggagcacggtctgttcatcggaatggcatcgctggccgtcgtggctggctctgatggtgcgcgggtgatcgagcctgtggcgtga

SEQ ID NO: 2223 - DNA, 702 bp, Hoeflea phototrophica DFL-43
atggatgcccggcaactcaagattcaggcggcaaaggcggctctcgaccatgtcgaggacggaatgcggcttggaatcggcactggttcaaccgcggacgagttcgtccggttgctggcggaaaaggtggccgacggcttcaaggtccatggcgtgccgacatcggagcggaccgcgcggctgtgtgtcgagcttggcgtgccgctctattcgctcgacgacatgcccgaactggatctcaccatcgacggcgctgacgagattgacggggcgctgacgctggtcaaaggcggcggcggggcgttgttgcgcgaaaagatcgttgcgtctgcctcggccagaatgatcgtcattgccgacgaatccaagctggtcgatacgcttgggcagtttccgctgcccatcgaagtggccaagttcggcatggtggcgacccactatgccgtggaacggctggcgtcacggctgggcctgagcggtacgatcgagcagcgcgccgacaaggatgggccctatctcaccgatggtgaccattttatcctcgacgcatcttttggccgcattccggatgcagaagccatcgcaaacgggctcgctgcaattcccggcgtggtcgaacacggattgtttctcaacatggcaagcgccgcgatcatcgcctcaccaggcggcgcgcggaccttgcttgcaacagacccttaa

SEQ ID NO: 2224 - DNA, 732 bp, Mesorhizobium loti MAFF303099
atggatgcaagacagttgaaagtcgaggccgcgcgggccgcccttgcccatgtcagcgacggcatgcggctcggcatcggcaccggcacgactgccgaagagttcgtgcgactgctcgccgacaaggtcgccaccggcatgaccgtcatcggtgtgccgacgtccgagcgcaccgcggcactttgccgtgagcttggcgtgccgctgtcgacattggaggaaactcccgagctcgatcttacggtcgacggcgccgatgaggtcgatccggaactgaccttgatcaagggcggcggcggcgcactgctgcgcgaaaagatcgttgccgcagcctcgcagcgcatgatcgtcatcgccgaccgctcgaagatggtcgagacgctcggccggtttccgctgccgatcgaagtcaaccagttcggcctgcgcgccaccgagatcgccatagccaagacggctgcggatctcggcctttccggtccgattacattgaggatgacgggaggccaggcttttgttacagacggcggccattttatcctcgatgcatcttttggccgcattccggatacaagagcgctttcgaatgctctccacgccattccgggcgtggtcgagcatggtcttttcatcgggctggcgtcaacggccatcatcgccggcggcgacggcatccaaaccgtccatgccgcccgaaaaccagggagttctaccaaccatgatgttgcataa

SEQ ID NO: 2225 - DNA, 834 bp, Mesorhizobium opportunistum WSM2075
gtggacaggctgccaaaggctttgatcacggtcaaaagctttgatcccggcggcaaaaatgctacgagcccaaaacaccaggatttctgggcaataagcggcatggatgcaagacagttgaaggtcgaggccgcgcgggcggcgcttgcccatgtcacggatggcatgcggctcggtatcggcaccggcaccacggcggaagagttcgtgcggctgcttgccgacagggtcgcaaccggcatgaccgtcatcggcgtgccgacttcggaacgcacggccgcgctgtgtcgcgaacttggcgtgcctctgtcgacgctggaggaaacgccggagctcgatctcacggtcgacggcgccgacgaggtcgatccggcgctgaccttgatcaagggcggcggcggcgcgctgctgcgcgagaagatcgtcgccgcggcctcgcagcgcatgatcgtcattgccgaccggtcgaagatggtcgagacgctcggccggtttccgctgccgatcgaagtcaaccagttcggcctgcgcgccaccgagatcgcggtcgcggcagcggctgaaaagctcggtctttccggtccggttacattgaggatgacgggaggccaggcttttgttacagacggcggccattttatcctcgatgcatcttttggccgcattccggatacaagagcgctttcgaatgctctccacgccattccgggcgtggtcgagcatggtcttttcatcgggctggcgtcagcggccatcatcgccggcggcgacggtatccaaaccgtccatgccgcccgaaaaccagggagttctatcgaccatgatgttgcataa

SEQ ID NO: 2226 - DNA, 708 bp, Chelativorans sp. BNC1
gtgacggacgcaaagacgcttaagattgaagccgccagggtggcgctgggctatgtcgaagatggcatgaagcttggaatcggcacgggctcgaccgccgaggagttcgtgcggctgcttgcgacgcgcgttagctcggggatgaagatcgtcggcgttcccacctccgagcgcacggctgccctttgccgcgagctgtcggttcccctttcgacgctggatgagacgccggaacttgatctgacggtggacggcgcggacgaagtggggccggacctcacgctgatcaagggcggcggcggtgcgctgcttcgcgagaaaatcgttgccgcggcttcacgccggatgatcgtgattgccgatgagagcaaggtcgttgatgtgcttggcacctttccgctgcccatcgaggtgaatccctttggccttcgcgccaccaggatcgccattgaggccgccgccgcgcgcctcggtcttgccggcgagatgaggacacgtatggccggccaggagccgttcgtaacggacggtggacatttcataatcgatgcatcttttggccgtattcaagcgccaagagcactggcggaggcgctgaatgcaattcccggtgttgtggaacacggtctcttcatcggactggctggcgcggcgattattgcaggcaggaacggtgtcaggacgctcgacgccggcagccgaatctag

SEQ ID NO: 2227 - DNA, 774 bp, Ochrobactrum intermedium LMG 3301
ttgttgcgccgcgcccgcatgctagaggcgaaccggatgacaatgagaatccgctgggatttcggggaacttggtatggatgaagctcgcaagttaaaaattgcagccgccgcagaagcactcacacacgtcaaggacggaatgcgtctgggaatcggtaccggttcaactgccgaggagtttgtgcgactgcttgctgaaaaggtaagtggcggcttcaagatcattggcgtacccacttccgaacgtaccgccaagctttgtgaggaactcggagttccgcttacaacgcttgacgaaacgccccatctcgatctcacggttgacggtgcggacgaagtcgataccaatctctcgctcatcaagggcggaggtggggcgcttcttcgtgaaaagatcgttgctgctgcctctgatgcaatgatcgtcattgccgacagctccaaggtggtcgagacgctcggacgttttcctctgccagtggaagtcaaccgcttcggtcttggcgcgaccttccgcgctatcgaggaagcagctgcaaagtgtggccttgcaggcccgctggcactgcgtttaaaagatggctcacccttcgtaacagatggtgggcattatatcgtggatgcatcttttggccgcattcccgatccaaagacactatctgacgctctcttcgcaattccaggcgttgtcgagcacggacttttcatcggactcgcgcgtgcggcagtgattgccggcaacgacggcatccgcaccatgaaccggtcttga

SEQ ID NO: 2228 - DNA, 699 bp, Ochrobactrum anthropi
atggacgaagctcgcaagctgaaaatcgcagccgccgcagaagcgctcacgcacgtcaaggacggaatgcgtctggggattggtactggttcgacggccgaggaattcgtgcgcctgcttgccgacaaggtaagcaacggcttcaagatcattggagtgcctacttccgaacgcaccgcaaaactttgcaaggaactcggggttccgcttacgacgctcgatgaaacgcctcatcttgatcttaccgtggatggtgccgatgaagtcgataccaacctttcgctcatcaagggcggcggtggagcgcttcttcgtgaaaagatcgtggctgcggcatctgacgcaatgatcgttattgccgacagttcgaaggtcgtcgaaacactcgggcgttttccgctgcctgtggaagtcaatcgcttcggtcttggtgctaccatgcgcgcgattgaagaagcagctgcgaagtgtggtcttgcaggcccgctggcactgcgtttaaaagatggctcacccttcgtaacagatggtgggcattatatcgtggatgcatcttttggccgcattcccgatccaaagacactatctgacgctctcttcgcaattccaggcgttgtcgagcacggacttttcatcggactggcgcgtgcggcagtggttgccggcaacgacggcatccgcaccatgaaccggtcttga

SEQ ID NO: 2229 - DNA, 699 bp, Brucella suis
atggatgaagcacgcaagctcaagattgcggcggcagccgaagcgctgacttatgtaaaagacggaatgcggttgggcatcggcaccggctcgacggcggaagaatttgtgcgtctgctggctgaaaaggtgaagggtggctttcgcgtcattggtgttccgacttcggagcgcacagcaaaactgtgtgaggaactgggcgttgcgctcaccacactcgaagaaacgccgcatctggacctgacaattgacggtgcggatgaagttgacggcgaactcagccttatcaagggcggaggcggcgcgctgcttcgcgagaagattgttgctgcggcttccgattccatgatcgtgattgccgaccagtctaaagttgtggaaacgctggggcgttttcccctgccgattgaagtcaaccgcttcggccttggcgcgacaatccgggcgattgaggcggcggctgtaaagtgtggtcttgcagggccgctgaacctgcggttaaaagacggttcacctttcctcaccgacggtgggcactacatcgtggatgcatcttttggccgcattcccgatccaaagacattatctgacgctctcttcgccataccgggcgtagtcgagcatggacttttcatcggactggcgcgtgcggcgattatcgccggcaccgacggtatccgcaccatgaacaggtcttga

SEQ ID NO: 2230 - DNA, 699 bp, Brucella ovis
atggatgaagcacgcaagctcaagattgcggcggcagccgaagcgctgacttatgtaaaagacggaatgcggttgggcatcggcaccggctcgacggcggaagaatttgtgcgtctgctggctgaaaaggtgaagggtggctttcgcgtcattggtgttccgacttcggagcgcacagcaaaactgtgtgaggaactgggcgttgcgctcaccacactcgaagaaacgccgcatctggacctgacaattgacggtgcggatgaagttgacggcgaactcagccttatcaagggcggaggcggcgcgctgcttcgcgagaagattgttgctgcggcttccgattccatgatcgtgattgccgaccagtctaaagttgtggaaacgctggggcgttttcccctgccgattgaagtcaaccgcttcggcctcggcgcgacaatccgggcgattgaggcggcggctgtaaagtgtggtcttgcagggccgctgaacctgcggttaaaagacggttcacctttcctcaccgacggtgggcactacatcgtggatgcatcttttggccgcattcccgatccaaagacattatctgacgctctcttcgccataccgggcgtagtcgagcatggacttttcatcggactggcgcgtgcgacgattatcgccggcaccgacggtatccgcaccatgaaccggtcttga

SEQ ID NO: 2231 - DNA, 699 bp, Brucella abortus
atggatgaagcacgcaagctcaagattgcggcggcagccgaagcgctgacttatgtaaaagacggaatgcggttgggcatcggcaccggctcgacggcggaagaatttgtgcgtctgctggctgaaaaggtgaagggtggctttcgcgtcattggtgttccgacttcggagcgcacagcaaaactgtgtgaggaactgggcgttgcgctcaccacactcgaagaaacgccgcatctggacctgacaattgacggtgcggatgaagttgacggcgaactcagccttatcaagggcggaggcggcgcgctgcttcgcgagaagattgttgctgcggcttccgattccatgatcgtgattgccgaccagtctaaagttgtggaaacgctggggcgttttcccctgccgattgaagtcaaccgcttcggccttggcgcgacaatccgggcgattgaggcggcggctgtaaagtgtggtcttgcagggccgctgaacctgcggttaaaagacggttcacctttcctcaccgacggtgggcactacatcgtggatgcatcttttggccgcattcccgatccaaagacattatctgacgctctcttcgccataccgggcgtagtcgagcatggacttttcatcgaactggcgcgtgcggcgattatcgccggcaccgacggtatccgcaccatgaaccggtcttga

SEQ ID NO: 2232 - DNA, 735 bp, Brucella ceti str. Cudo
ttgagaatccgcgggggaagaaacgggaattctggaatggatgaagcacgcaagctcaagattgcggcggcagccgaagcgctgacttatgtaaaagacggaatgcggttgggcatcggcaccggctcgacggcggaagaatttgtgcgtctgctggctgaaaaggtgaagggtggctttcgcgtcattggtgttccgacttcggagcgcacagcaaaactgtgtgaggaactgggcgttgcgctcaccacactcgaagaaacgccgcatctggacctgacaattgacggtgcggatgaagttgacggcgaactcagccttatcaagggcggaggcggcgcgctgcttcgcgagaagattgttgctgcggcttccgattccatgatcgtgattgccgaccagtctaaagttgtggaaacgctggggcgttttcccctgccgattgaagtcaaccgcttcggccttggcgcgacaatccgggcgattgaggcggcggctgtaaagtgtggtcttgcagggccgctgaacctgcggttaaaagacggttcacctttcctcaccgacggtgggcactacatcgtggatgcatcttttggccgcattcccgatccaaagacattatctgacgctctcttcgccataccgggcgtagtcgagcatggacttttcatcggactggcgcgtgcggcgattatcgccggcaccgacggtatccgcaccatgaaccggtcttga

SEQ ID NO: 2233 - DNA, 735 bp, Brucella melitensis
ttgagaatccgcgggggaagaaacgggaattctggaatggatgaagcacgcaagctcaagattgcggcggcagccgaagcgctgacttatgtaaaagacggaatgcggttgggcatcggcaccggctcgacggcggaagaatttgtgcgtctgctggctgaaaaggtgaagggtggctttcgcgtcattggtgttccgacttcggagcgcacagcaaaactgtgtgaggaactgggcgttgcgctcaccacactcgaagaaacgccgcatctggacctgacaattgacggtgcggatgaagttgacggcgaactcagccttatcaaaggcggaggcggcgcgctgcttcgcgagaagattgttgctgcggcttccgattccatgatcgtgattgccgaccagtctaaagttgtggaaacgctggggcgttttcccctgccgattgaagtcaaccgcttcggccttggcgcgacaatccgggcgattgaggcggcggctgtaaagtgtggtcttgcagggccgctgaacctgcggttaaaagacggttcacctttcctcaccgacggtgggcactacatcgtggatgcatcttttggccgcattcccgatccaaagacattatctgacgctctcttcgccataccgggcgtagtcgagcatggacttttcatcgaactggcgcgtgcggcgattatcgccggcaccgacggtatccgcaccatgaaccggtcttga

SEQ ID NO: 2234 - DNA, 696 bp, Aurantimonas manganoxydans SI85-9A1
atgacggattcggcgacactgaagaccatggccggcgaggccgcactggcccatgtcgaggacggcatgcgcctcggcatcggcaccggctcgaccgccgaagccttcgtgcgggtgctggccgagcgggttcgcgatggcatgaagatcgtcggcgtgacgacctccaaccgcaccgagactttgtgcgccgaactcggcgtgccgaccgagacgctggagaccgtgcccgagctcgatctcaccatcgacggcgccgacgaggtcgacggttcgctgcggctgatcaagggcggtggcggcgcgcttctgcgcgagaagatcgtcgcggccgcgtccgagcgcttcctggtgatcgccgacgcctccaagaaggtcgagacgctgggcgcctttccgctgccgatcgagatcaacggcttcggcatgattgccacctatctggccatccgcaaggcggcggccgggctggggctggaaggcgacatgatcctgcggcgcagcggcgacgagcccttcatcaccgacaacggccacctgattctcgacgcatcttttggccgcattggcgatccagaagccctctcgcaggcattgttcgcggtgcccggcgtggtcgagcacgggctgttcctcggcatggcgaacaccgtgatcctggccggggacgacgggctggaaacgctcgaagcctga

SEQ ID NO: 2235 - DNA, 696 bp, Fulvimarina pelagi HTCC2506
atgtcggacgccaagtccttgaagagaaaagccgctgaagccgccttcgcggaactcgatgagggcttgaacatcgggatcggcaccggatcgacggcggaggagttcgttcgggttcttgccgaacatgtggaagctgatttcgagatgaccggcgtcacgacgtccgagcgcaccgagacgctctgccgcgaactcggcgtgccgacgaagactctcgacgagatcccgatcctcgacgtgaccgtggacggcgcggacgaaatcgatggcgatctacggctgatcaaaggcggcgggggcgcgcttctgcgcgagaagatcgtggcattctcctccgcgaagatgatcgtgatcgcggacgcttcgaagaaggtcgaaacgctaggcgcgtttccgttgccgatcgaggtcaacggttttgggctgatgtcaaccttcatggcaatccgccgcgtcgcggagacgcttgatcttactggcgacatcgtcctgcgaaaaaacggggatcagccgtttatcaccgatggtgggcacctgatcctcgacgcatcttttggccgcattccggacccagaagccctcagcgccgcgcttcggtccattccggggatcgtcgagcacggccttttcatcaagctcgccagcgtcgcgatcttagccagcgaggatggtatcgagaggctcgaggcttga

SEQ ID NO: 2236 - DNA, 705 bp, Bartonella grahamii
atggatgttcagcagttaaaaaaaatggcagctattaaagcgcttgaatttattgaagatgatatgcggcttggtattggatctggttcgacagtcaatgaatttattcgtcttcttggtgagcgtgtttcggatggtttgcgagtgactggtgttgctacttcacgatattctgaacaactctgtcgtaagtttggagtgcctgttagcactttagaacaaatacctgaactggatcttgatattgacggagcagatgaaattggtcctgagatgatgctcataaaaggtggagggggagcattgttgtatgaaaaaattgtagcatcggcatcccgtgcaatgcttgtcattgctgatgaaacaaaggtggtaaaacgacttggtgcttttgcactaccaattgaagttaatccatttggtatccatacaacacgcagagccatcgaaaaagtcgctgatgacttagggctttctggagaaattgtattgcgaatgaatggaaaaaatccttttgaaacagatggggggcattttattcttgatgcattttggggctgcattttgcaaccaaaaccattatcggacgcacttcttgccattcctggtgttgttgagcatggcctttttttgggattggcttcacgtgcaattgtagctatggttgatggtcaaacaaaaattttagaatcttttgatttttag

SEQ ID NO: 2237 - DNA, 705 bp, Bartonella tribocorum CIP 105476
atggatgttcagcagttaaaaaaaagagccgctgttaaagcacttgaatttattgaagatgatatgctgcttggtatcggatctggttcaactgttaatgaatttattcgtcttcttggtgagcgtgttgcggatggtctgcgggtgactggtgttgctacttcgcgatattctgaacaactttgtcataaatttggagtgcctgttagcactttagaacaaatacctgaactggatcttgatattgatggagcagatgaaattggtcctgagatgatgctcattaaagggggagggggagctttgttatatgaaaaaattgtcgcatcagcatctcgtgcaatgcttatcattgctgatgaaacaaagatggtcaaaaaacttggtgcttttgcactcccgattgaggtgaatccatttggtgttcatacaacacgcaaagccatcgaaaaagttgctgatgatttaggactttctggggaaattgtattgcgaatgaatggaaaaaatccttttaaaacagatgggggtcattttattcttgatgcgttttgggggtgcatcttgcagcccaaattattatcggatgcacttcttgtcattcctggcgttgttgagcatggcctttttttggggatggcttcacgtgcaattgttgctatggcggatggtcaaataaaagttttagaaccgtttgatttttag

SEQ ID NO: 2238 - DNA, 705 bp, Bartonella henselae
atgaatgttcagcaattaaaaaaaatggcggctttaaaagcacttgaatttgttgaagatgatatgcggcttggtatcggatctggttcgacagtaaatgagtttatccctcttcttggtgagcgtgttgcgaatggtctgcgcgtgacttgtgttgcaacctcgcagtattctgaacaactctgtcataaatttggcgtgcctatcagcaccttagaaaaaatacctgaactagaccttgatattgatggggcggatgaaattggtccagagatgactcttattaaaggagggggtggagcattgttgcatgaaaaaattgtagcatcggcttctcgtgcaatgtttgtcatcgcggatgaaacaaaaatggtaaaaacgcttggtgcttttgcattgccgattgaagttaatccgtttggtatacatgctacacgcatcgccattgaaaaagcagctgataatttaggactttcgggggaaattacattacgaatgaatggcgacgatccttttaaaacagatggtggtcatttcatttttgatgcattttggggacgcattttacagccaaaattattatcggaggcacttcttgcaattcctggtgttgttgagcatggtctttttttgggattggcttcacgtgcaattgtagcgatggcggatagtcagataaaagttttagaaccgtttgatttttag

SEQ ID NO: 2239 - DNA, 705 bp, Bartonella quintana
atgaatgttcagcagttaaaaaaaagggcagctgctaaagcacttgagtttgttcaagatgatatgcggcttggtataggaactggttctacagcaaatgaatttattcgccttcttggggagcgtgttgcagatggtttgcgcgtgactggtgttgctacctcacagtattctgagcaactctgtcggaaatttggggtgcctgttactactttggaacaaatgcctgaacttgaccttgatattgatggggcagatgagatcggcccagagatgactctcattaaaggggggggaggagccttatggcgtgaaaaaattgtagcggcggcatctcgggcgatgcttgtcatcgcagatgaaacaaaggtggtaaagacgcttggtgcttttgcattgccaattgaagtcaatccgtttggtatgcctgctacacgcagactcattgaaaaagtagctgatgatttagggctttcaggggaaattatattacgaatgaatggagagaatccttttaaaacagatggtggtcacttcatttttgatgcattttgggggtgcattttacagccaagattattatcggaggcactccttgcaattcctggtgttgtcgagcatggtcttttttggggattggcttcgcgtgcaattgtagcgatggcagatggtcaaataaaagttttagaatcgtctgatttttaa

SEQ ID NO: 2240 - DNA, 702 bp, Bartonella bacilliformis
atgaatgcccaagaattgaaaaaggtggcggctgctaaagcacttgagtttgttcaagatggtatgcgtctcggtatagggtcgggttctacagctaatgaatttattcgccttcttggtgaacgtgttgcaaatggtttgcatgttatcggcgttgctacttcacattattccgaacaattatgtcgtcaagttggggtacctgtcactactttagaacaaattcctgagcttgatcttgatattgatggggcagatgagattggtcctaatatgaccttaattaaagggggtggtggggcgttgctacgtgaaaaaattgttgctgcagcatctcatgaaatgcttattattgctgacgaaacaaaagtagtcaaaacacttggtgcttttgcactaccaattgcagtcaatcagtttggtctgagtgttacacgcagtgctatcgaaaaaatggctaaaggtttaggtctttcaggaaaagtgacgttaagaatgaatggggataatccttttaagacggatgatggccattttatttttgatgcatcttgggggcatattgttcaaccaaaacttttatcaaatgcactatttgagatccctggtgttattgaacacggactttttgtgggattagcgtcgcgttcaattatagcgatggcagatggtcaaataaaaattttagagaaaaaatgttga

SEQ ID NO: 2241 - DNA, 699 bp, Labrenzia alexandrii DFL-11
atgagcgataacctgaaacagcaggcagccgagcgcgcagcagaggatgtcatctccggcatgcgccttggtatcggcacaggatcgactgcagagttcttcgttcacgcccttgcaaagcgtgtcgcagacggactggacgtgatcggcgttccgacatctgagcgcacagcagagcttgccgccagtttgggaataaaactcaccaccttggaagagttgcccgagctggatctgacagtggacggtgcggatgagctggatgccaacctcgccttgatcaagggcggcggcggagctttgctgagggaaaagattgtcgcagcagcttccggcaaaatgatcgtcatcgccgatggcactaagaacgttgatacgctggggcaatttccgttgccgattgaagttgtgccgtttggtcaggaagcaacgcggcgggccatcctagcgctgttaagggaaatgggtttgcctcaaaaccttcagctgagaatggccggggagcatccttttgtcacagatggcgggcatcacatctttgacgcccatcttctgaagatcgaagaccctgaaacgcttgcacaggctctggtaaagatcccgggcgttgttgagcatggtcttttcctcaatcttgcctccaaggcttacgtggccggggaagatggggtaaagacgattacacctgcgtcgatgtag

SEQ ID NO: 2242 - DNA, 693 bp, Labrenzia aggregata IAM 12614
atgagcgaccagtacaagaaactggcggcggaacgcgctgccgacgatgttacatccggaatgcgtcttggaattgggaccggttcgactgccgagtttttcgtccacgcgcttgcccgccgggtgcaagacggtttggacgttatcggtgtgccgacgtcggagcgcactcgggaactggcctcgagcctcggcattcgcctgaccactctcgacgagttgccggaactggacctgaccgttgatggcgccgatgaactggatccccatctgtcgctcatcaagggcggcgggggcgcattgctgcgcgagaagatcgtcgcgtcggcttcggccagcatgatcgtcattgcggacggcagcaaggaagttgcgacgcttggccgctttccattgccgatcgaggtcgttcctttcggtctggaagcaacgcggcgcgcaatcctgaaggtgtttgagggccttggcctgccgcagaacctggcactgcgcggcggatcggccgagcctttcgtgacggacggcgggcacttcatcctggatgcgcagcttgaaagcatacctgaggtccggaccctgggcgaccggttggtcgccattccgggggttgtcgaacacggcctcttcattgaacttgcaacaaaagcttacgtggctggcacagatggggtaaagaccgtcttgcccatctaa

SEQ ID NO: 2243 - DNA, 690 bp, Pseudovibrio sp. JE062
atggcaatgagtttgaaggcgcaggccgcagctgcagcactcaaggaagttaagcccggcatgaagctggggataggttctggatcaacagtcaacgaaatgatccgccttctggcagatatggtcaaggatggtttcgagatcatcggtgttccagcctcctcttactctcaggcgctttgcgatgaactgggagttccactgaccacactggacgaaacaccggtgctggaccttgtaattgatggtgcggacgagatcgatccgcagctgaacctcatcaaaggtggcggtgcggcactgcttcgcgaaaaaatcatcgcggcagcatctggccgtatgcttgtcatcgcagatgagagcaaaattgttgataccctcggaaagttcccgcttcccgtggaggttatcccattcgggcttgaggctacccggcagatgatgcaaaacagcttggacgctgaggggctgcaaggcgagatgatcctgcgtatggcaggtgataagccacttgtaaccgataacggcaactacattctcgattgccacctgaaggcaatcagcgatccgaagtcactggcaaaacgcctggaagttattccgggtgtcgttgaacacgggttgtttattgatatggcggtacgggcttatgtcgccggtactgatgaaattcgtgtcttggaaccttaa

SEQ ID NO: 2244 - DNA, 687 bp, Parvularcula bermudensis HTCC2503
atgagcgatgacaagaaacagcgagcggccgcagcggccctggcgcatgtgcggccgggcatgaccctcggtcttgggacaggatccaccgccgcgcatttcgtcaaattattgggcgatcaggggtttgagggacaggcaatcccgacatccgaagagaccgctcgcctggccgaagcggtgggcatttccctgatcaccccggacgagaccaccaggatcgatctggccgtcgatggcgccgacgaggctgacccaagcggcgccctgatcaaaggcgggggcggggcgctgttgcgtgagaagatcatcgcccagcaggcgcagacattcatcgtgatcgccgatgacggcaaggatgtggtccagctcggacagtttccgctgccggtcgaagtgacggggttcgccgtcggtttgacgatccaggcaataagatcgactctcgccgccctcggctatgaggacccatcgctgaccctgaggaggggggagggcggttttttccagaccgacgggggacatttgatcgtcgatatcgccttgggccggatcgacgaggccgagccgttggatgccgcgttgaccatgatccccggggtggtcaccacgggattgttcgtcgggcttaccgacctgatgatcttcggcaccgaaagcggtgtgcgggaagcggttcccacctag

SEQ ID NO: 2245 - DNA, 675 bp, Leeuwenhoekiella blandensis MED217
atgactgctgatcaggaaaaaaaacaagctgcgctagaagccgtaaaatatattgaagacaatatggttgtaggattgggtacaggctcaactgcaaaacatatgatagaagcagtgggagcacttgttgccaaaggaatgaaccttacctgtgtaccctcatctgatgctaccgaaaaacttgccaaagaactcgggataaaaattgttgcgcttgatgagatcgaaaaaattgacgttactattgacggtgcagatgagttcgatgccaattttcaattgatcaagggtggaggaggagcattgcttcgcgaaaagatattagcttggaataccaagttcaatatcatcattgcagatagcagtaaggatgttgaaaagctaggcgcttttaagcttcctttggaagtgattccgtttgcgacaaagcaaatcattacctttttagaggaagaaggtttaaagcctgttcagcgtatgaaaggcaatgacccctatcgtactgacgaaaataacaatattgtagatgttgatatttttgaggttgacgatttaaaagccttagaaattaaactcttgaaagttccgggaattgtagaaaccggacttttcttagatactacaagtctgatcattgtaggtaaagaagacggccctgaaattaaaaagcgataa

SEQ ID NO: 2246 - DNA, 693 bp, Desulfatibacillum alkenivorans AK-01
atgacttcgcaggacgctcttaaaaagcaagctgcagaaaaagccgtggaatacctggaatccggaatggtagtgggactgggttcgggcagcaccgccaccttcgccattcacgccatcgcccgcctcatgaaggaaggcaagctgaaggatatcgtgggcattcccagctccacccccacggaggaagtcgcccggtctttaggcatccccctggtcgggtttgaagagcatgcggtcattgacgtaaccattgacggcgcggatgaagtggacccggacctgaacttgatcaagggcgggggcggcgccttgctgcgggaaaaagtcgtggcccaggccaccaaaaagaacatcatcatcgtggacgaaagcaaaatatccgataagctgggcacgatcttcgccctgcccgtggaagtggttccctttgccacggcctccgaaacccgttttctggaatccctgggcgccaaggtgacggtccgggaaaatcaactgggtaaagcctttaaaaccgacaaccacaaccgcattctggacgccgacttcggccccatggacgacgcggtgaaaatcggcatggccctttcccaacgcgccggcgtggtggagcacggattgttcctgggaaccaccgctttggtcatcgtggcgggtgcagacggcattcgggaaatgaaagcggcttaa

SEQ ID NO: 2247 - DNA, 678 bp, Dyadobacter fermentans DSM 18053
atgaaagacctaaaaagcgaaaaagcactggccgcgaaagaagcggtcaaatacctctcgaacgggcagattgtgggcctgggctccggcagctccgcgtacattgccattgcggaaatcggggaactggtgaaaaacggcctggatattcagggagtgcctacgtctgaaaaaacgcgtgcactggccgaatcgctgaatatcccgctgctcagcattgaggaagtcggttcgatcgacattaccatcgacggtgccgatgaattcacgcccgatttgcagctcatcaagggcggcggcagttttttgctgaaagaaaaagtagtggcttcgctctcgaaggccgaaatcatcattaccgattcaactaaaaaagtggaactgctcggcaagttcaccgtgccgatcgaagtgattccctatgcacagaattacgtgctggcgcagatcggaaagctgaacggtttgggtaaaatccgcctggcggatggcaaaccgctcgttacagagcagggcaacctgctgatcgacggcgatttcgggctgatacaagaccctgctttgctggccgatcagctgatccggatcgtgggcgtggtggaacatgggctgtttatcaacatcgccaaaaaggtgatcatgggcgtcggcgacacgaccatcacgttcgaaaaatag

SEQ ID NO: 2248 - DNA, 687 bp, Sphingopyxis alaskensis RB2256
atgtccaacttcgtcgctgagaaatcgatcgcggcggtgagagcagtcgatgaggttcgcgatggcatgcttgtcgggttagggaccggaagcaccgccgcttatgccgtgaaaagcctcagcgagcgcatcaagcacggccttcgcatcaccgcggtcgccacatcccaagcgaccgaagctctagctctccgtcttgcggtgccgcttgttccctttcaacagcttagcgctgtcgacctgacgatcgacggcgccgatgaaatcgatgaccgcttccaagccatcaaagggggaggcggcgccctgcttcgcgagaaaatcaccgagtccgcatccacgcgcgtgatcatcatcgccgattccagcaagcttgttgcgcagctcggcaaattccctctgcccgtggaggtggttcctttcgccaccgagtttgttcgtgcacgcctgtccgcactcggagcccgtgttactgttcgcgaagcgggtgggacgcccttcctcacggaccagggcaattacatcctggacgcagctttggatgagataccaaggccgcgcgagatcgccgccgcgatcaccacaatcccgggcgtcctggagcatggactgttcttggatgaaatcgatacaatcatgattgcgcgcggtgacatggtggaggtgcgacaccggggtgaagcttga

SEQ ID NO: 2249 - DNA, 663 bp, Bacillus thuringiensis
atgaatttaaaacagctcgctggtgaatatgctgcttactttgtaaatgatggcatgaagattgggcttggtacaggttctactgtatattggacaatacaaaaattaggtgagcgtgtaaaagaaggattatcatttcaagctgtaccgacatcaaaggaaactgaagcattagcaaagcaactaaatatccccctaatttcgttaaacgacgtacaaagtcttgatcttacaattgatggagcggatgaaattgattcaaatttacaacttataaaaggaggcggtggcgcattacttcgcgaaaaaatcgttgcctcttcctctaaagaactacttatcattgctgatgaatcgaaactcgtaacgcatttaggtactttcccattacctgttgaaattatacctttttcatggaaacaaaccgaaaggaaaattcaatctttaggttgtcaaacaacgttacgtttaaaaaataatgaaatatttataaccgataataataatatgattgtcgattgtatatttcctaatcatatagctactccttccgatttacacaaaagattaaaaatgattactggtgtagttgaaaccggattgtttgttaatatgactagtaaggcgattattggaacaaaaaacgggatacaggaattataa

SEQ ID NO: 2250 - DNA, 663 bp, Bacillus cereus
atgaatttaaaacagctcgctggtgaatatgctgcttactttgtaaatgatggcatgaagattgggcttggtacaggttctactgtatattggacaatacaaaaattaggtgagcgtgtaaaagaaggattatcatttcaagctgtaccgacatcaaaggaaactgaagcattagcaaagcaactaaatatccccctaatttcgttaaacgacgtacaaagtcttgatcttacaattgatggagcggatgaaattgattcaaatttacaacttataaaaggaggcggtggcgcattacttcgcgaaaaaatcgttgcctcttcctctaaagaactacttatcattgctgatgaatcgaaactcgtaacgcatttaggcactttcccattacctgttgaaattatacctttttcatggaaacaaaccgaaaggaaaattcaatctttaggttgtcaaacaacgttacgtttaaaaaataatgaaatatttataaccgataataataatatgattgtcgattgtatatttcctaatcatatagctactccttccgatttacacaaaagattaaaaatgattactggtgtagttgaaaccggattgtttgttaacatgactagtaaggcgattattggaacaaaaaatgggattaaggaattataa

SEQ ID NO: 2251 - DNA, 663 bp, Bacillus thuringiensis
atgaatttaaaacagctcgctggtgaatatgctgcttactttgtaaatgatggcatgaagattgggcttggtacaggttctactgtatattggacaatacaaaaattaggtgagcgtgtaaaagatggattatcatttcaagctgtaccgacatcaaaggaaactgaagcattagcaaagcaactaaatatccccctaatttcgttaaacgacgtacaaagtcttgatcttacaattgatggagcggatgaaattgattcaaatttacaacttataaaaggaggcggtggcgcattacttcgcgaaaaaatcgttgcctcttcctctaaagaactacttatcattgctgatgaatcgaaactcgtaacgcatttaggtactttcccattacctgttgaaattatacctttttcatggaaacaaaccgaaaggaaaattcaatctttaggttgtcaaacaacgttacgtttaaaaaataatgaaatatttataaccgataataataatatgattgtcgattgtatatttcctaatcatatagctactccttccgatttacacaaaagattaaaaatgattactggtgtagttgaaaccggattgtttgttaacatgactagtaaggcgattattggaacaaaaaatgggattaaggaattataa

SEQ ID NO: 2252 - DNA, 663 bp, Bacillus cereus
atgaatttaaaacagctcgctggtgaatatgctgcttactttgtaaatgatggcatgaagattgggcttggtacaggttctactgtatattggacaatacaaaaattaggtgagcgtgtaaaagaaggattatcatttcaagctgtaccgacatcaaaggaaactgaagcattagcacatcaactaaatatccctctaatttcgttaaacgacgtacaaagtcttgatcttacaattgatggagcggatgaaattgattcaaatttacaacttataaaaggaggcggtggcgcattacttcgtgaaaaaatcgttgcctcttcctctaaagaactacttatcattgttgatgaatcgaaactcgtaacgcatttaggtactttcccattacctgttgaaattatacctttttcatggaaacaaaccgaaaggaaaattcaatctttaggttgtcaaacaacgttacgtttaaaaaataatgaaatatttataaccgataataataatatgattgtcgattgtatatttcctaatcatatagctactccttccgctttacacaaaagattaaaaatgattactggtgtagttgaaaccggattgtttgttaacatgactagtaaggcgattattggaacaaagaatgggattaaggaattataa

SEQ ID NO: 2253 - DNA, 663 bp, Bacillus thuringiensis
atgaatttaaaacagctcgctggcgaatatgccgctaactttgtaaatgatggcatgaagattgggcttggtacaggttctactgtatattggacaatacaaaaattaggtgagcgtgtaaaagaaggattatcatttcaagctgtaccgacatcaaaagaaactgaagcattagcacatcaactaaatatccccctaatttcgttaaacgacgtacaaagtcttgatcttacaattgatggagcggatgaaattgattcaaatttacaacttataaaaggcggtggcggtgcattacttcgcgaaaaaatcgttgcctcttcctctaaagaactaattatcattgctgatgaatcgaaacttgtaacacatttaggtacttttccattacctattgaaatcatccctttttcatggaaacaaaccgaaaataaaattcagtctttaggatgtcaaacaacattacgtttgaaaaataatgaaacctatataaccgataacaataacatgattatcgattgtatattccctaatcatatttctaatcctgcccatttacacactcaattaaaaatgattactggtgtagttgaaacagggttgtttataagtatgacgagtaaagtaattatcggcgctaaaaatgggataaaggaattgtaa

SEQ ID NO: 2254 - DNA, 663 bp, Bacillus cereus
atgaatttaaaacagctcgctggcgaatatgccgctaactttgtaaatgatggcatgaagattgggcttggtacaggttctactgtatattggacaatacaaaaattaggtgagcgtgtaaaagaaggattatcatttcaagctgtaccgacatcaaaggaaactgaagcattagcacatcaactaaatatccccctaatttcgttaaacgacgtacaaagtcttgatcttacaattgatggagcggatgaaattgattcaaatttacaacttataaaaggcggtggcggtgcattacttcgtgaaaaaatcgttgcctcttcctctaaagaactaattatcattgctgatgaatcgaaacttgtaacacatttaggtacttttccattacctattgaaatcatccctttttcatggaaacaaaccgaaaataaaattcagtctttaggatgtcaaacaacattacgtttgaaaaataatgaaacctatataaccgataacaataacatgattatcgattgtatattccctaatcatatttctaatcctgcccatttacacactcaattaaaaatgattactggtgtagttgaaacagggttgtttataagtatgacgagtaaagtaattatcggcgctaaaaataggataaaggaattgtaa

SEQ ID NO: 2255 - DNA, 663 bp, Bacillus cereus
atgaatttaaaacagctcgctggcgaatatgctgctaactttgtaaacgatggcatgaaaattgggcttggtacaggttctactgtatattggacaatacaaaaattaggtgagcgtgtaaaagaaggattatcatttcaagctgtaccaacatcaaaggaaactgaagcattagcacagcaactaaatatccccctaatttcgttaaacgacgtacaaagtcttgatcttacaattgatggagcggatgaaattgattcaaatttacaacttataaaaggcggtggcggtgcattacttcgtgaaaaaatcgttgcctcttcctctaaaaaactaattatcattgctgatgaatcgaaacttgtaacacatttaggtacttttccattacctattgaaatcatccctttttcatggaaacaaaccgaaaataaaattcagtctttaggatgtcaaacaacattacgtttgaaaaacaatgaaacctatataaccgataacaataacatgattatcgattgtatattccctaatcatatttctaatcctgcccatttacacactcaattaaaaatgattactggtgtagttgaaacagggttatttataagtatgacgagtaaagtaattatcggcgctaaaaatgggataaaggaattgtaa

SEQ ID NO: 2256 - DNA, 663 bp, Bacillus cereus
atgaatttaaaacagctcgctggcgaatatgctgctaactttgtaaacgatggcatgaaaattgggcttggtacaggttctactgtatattggacaatacaaaaattaggtgagcgtgtaaaagaaggattatcatttcaagctgtaccaacatcaaaggaaactgaagcattagcacagcaactaaatatccccctaatttcgttaaacgacgtacaaagtcttgatcttacaattgatggagcggatgaaattgattcaaatttacaacttataaaaggcggtggcggtgcattacttcgtgaaaaaatcgttgcctcttcctctaaaaaactaattatcattgctgatgaatcgaaacttgtaacacatttaggtacttttccattacctattgaaatcatccctttttcatggaaacaaaccgaaaataaaattcagtctttaggatgtcaaacaacattacgtttgaaaaacaatgaaacctatataaccgataacaataacctgattatcgattgtatattccctaatcatatttctaatcctgtccatttacacacccaattaaaaatgattactggtgtagttgaaacagggttatttataagtatgacgagtaaagtaattatcggcgctaaaaatgggataaaggaattgtaa

SEQ ID NO: 2257 - DNA, 663 bp, Bacillus cereus
atgaatttaaaacagctcgctggcgaatatgctgctaactttgtaaacgatggcatgaaaattgggcttggtacaggttctactgtatattggacaatacaaaaattaggtgagcgtgtaaaagaaggattatcatttcaagctgtaccaacatcaaaggaaactgaagcattagcacagcaactaaatatccccctaatttcgttaaacgacgtacaaagtcttgatcttacaattgatggagcggatgaaattgattcaaatttacaacttataaaaggcggtggcggtgcattacttcgtgaaaaaatcgttgcctcttcctctaaaaaactaattatcattgctgatgaatcgaaacttgtaacacatttaggtacttttccattacctattgaaatcatccctttttcatggaaacaaaccgaaaataaaattcagtctttaggatgtcaaacaacattacgtttgaaaaacaatgaaacctatataaccgataacaataacatgattatcgattgtatattccctaatcatatttctaatcctgtccatttacacacccaattaaaaatgattactggtgtagttgaaacagggttgtttataagtatgacgagtacagcaattattggtactaaaaatgggataaagaaattgtaa

SEQ ID NO: 2258 - DNA, 663 bp, Bacillus cereus
atgaatttaaaacagctcgctggcgaatatgctgctaactttgtaaacgatggcatgaaaattgggcttggtacaggttctactgtatattggacaatacaaaaattaggtgagcgtgtaaaagaaggattatcatttcaagctgtaccaacatcaaaggaaactgaagcattagcacagcaactaaatatccccctaatttcgttaaacgacgtacaaagtcttgatcttacaattgatggagcggatgaagttgattcaaatttacaacttataaaaggcggtggcggtgcattacttcgtgaaaaaatcgttgcctcttcctctaaaaaactaattatcattgctgatgaatcgaaacttgtaacacatttaggtacttttccattacctattgaaatcatccctttttcatggaaacaaaccgaaaataaaattcagtctttaggatgtcaaacaacattacgtttgaaaaacaatgaaacctatataaccgataacaataacctgattatcgattgtatattccctaatcatatttctaatcctgtccatttacacacccaattaaaaatgattactggtgtagttgaaacagggttgtttataagtatgacgagtacagcaattattggtactaaaaatgggataaagaaattgtaa

SEQ ID NO: 2259 - DNA, 663 bp, Bacillus thuringiensis
atgaatttaaaacagctcgctggcgaatatgctgctaactttgtaaatgatggcatgaaaattgggcttggtacaggttctactgtatattggacaatacaaaaattaggtgaacgtgtaaaagaaggattatcatttcaagctgtaccaacatcaaaggaaactgaagcattagcacagcaactaaatatccccctaatttcgttaaacgacgtacaaagccttgatcttacaattgatggagcggatgaaattgattcaaatttacaacttataaaaggcggtggtggtgcattacttcgtgaaaaaatcgttgcctcttcctctaaagaactaattatcattgctgatgaatcgaaatttgtaacacatttaggtaattttccattacctgttgaaatcatccctttttcatggaaacaaaccgaaaataaaattcagtctttagggtgtcaaacaacgttacgtttgaaaaatgatgaaacttatataaccgataacaataacctgattatcgattgtatattccctaatcatatttctaatcctgcccatttacacacccaattaaaaatgattactggtgtagttgaaacagggttgtttataagtatgacgagtacagcaattattggtactaaaaatgggataaagaaattgtaa

SEQ ID NO: 2260 - DNA, 663 bp, Bacillus cereus
atgaatttaaaacagctcgctggcgaatatgctgctaactttgtaaatgatggcatgaaaattgggcttggtacaggttctactgtatattggacaatacaaaaattaggtgaacgtgtaaaagaaggattatcatttcaagctgtaccgacatcaaaggaaactgaagcattagcacagcaactaaatatccccctaatttcgttaaacgacgtacaaagccttgatcttacaattgatggagcggatgaaattgattcaaatttacaacttataaaaggcggtggtggtgcattacttcgtgaaaaaatcgttgcctcttcctctaaagaactaattatcattgctgatgaatcgaaatttgtaacacatttaggtaattttccattacctgttgaaatcatccctttttcatggaaacaaaccgaaaataaaattcagtctttagggtgtcaaaccacattacgtttgaaaaatgatgaaacttatataaccgataacaataacatgattatcgattgtatattccctaatcatatttctaatcctgcccatttacacacccaattaaaaatgattactggtgtagttgaaacagggttgtttataagtatgacgagtacagcaattattggtactaaaaatgggataaagaaattgtaa

SEQ ID NO: 2261 - DNA, 663 bp, Bacillus cereus
atgaatttaaaacagctcgctggcgaatatgctgctaactttgtaaatgatggcatgaaaattgggcttggtacaggttctactgtatattggacaatacaaaaattaggtgaacgtgtaaaagaaggattatcatttcaagctgtaccaacatcaaaggaaactgaagcattagcacagcaactaaatatccccctaatttcgttaaacgacgtacaaagccttgatcttacaattgatggagcggatgaaattgattcaaatttacaacttataaaaggcggtggtggtgcattacttcgtgaaaaaatcgttgcctcttcctctaaagaactaattatcattgctgatgaatcgaaatttgtaacacatttaggtaattttccattacctgttgaaatcatccctttttcatggaaacaaaccgaaaataaaattcagtctttagggtgtcaaaccacattacgtttgaaaaatgataaaacttatataaccgataacaataacctgattatcgattgtatattccctaatcatatttctaatcctgcccatttacacacccaattaaaaatgattactggtgtagttgaaacagggttgtttataagtatgacgagtacagcaattattggtactaaaaatgggataaagaaattgtaa

SEQ ID NO: 2262 - DNA, 663 bp, Bacillus cereus
atgaatttaaaacagctcgctggcgaatatgccgctaactttgtaaatgatggcatgaaaattgggcttggtacaggttctactgtatattggacaatacaaaaattaggtgagcgtgtaaaagaaggattatcatttcaagctgtaccaacatcaaaggaaactgaagcattagcacatcaactaaatatccccctactttcgttaaacgacgtacaaagtcttgatcttacaattgatggagcggatgaaattgattcaaatttacaacttataaaaggcggtggcggtgcattacttcgtgaaaaaatcgttgcctcttcctctaaagaactaattatcattgctgatgaatcgaaacttgtaacacatttaggtaattttccattacctgttgaaatcatccctttttcatggaaacaaaccgaaaataaaattcagtctttagggtgtcaaacaacgttacgtttaaaaaataatgaaacctatataaccgataacaataacatgattatcgattgtatattccctaatcatatttctaatcctgcccatttacacacccaattaaaaatgattactggtgtagttgaaacagggttgtttataagtatgacgagtacagcaattattggtactaaaaatgggataaagaaattgtaa

SEQ ID NO: 2263 - DNA, 663 bp, Bacillus thuringiensis
atgaatttaaaacagctcgctggcgaatatgccgctaactttgtaaatgatggcatgaagattgggcttggtacaggttctactgtatattggacaatacaaaaattaggtgagcgtgtaaaagaaggattatcatttgaagctgtaccaacatcaaaggaaactgaagcattagcacatcaactaaatatccccctactttcgttaaacgacgtacaaagtcttgatcttacaattgatggagcggatgaaattgattcaaatttacagcttataaaaggcggtggcggtgcattacttcgtgaaaaaatcgttgcctcttcctctaaagaactaattatcattgctgatgaatcgaaacttgtaacacatttaggtaattttccattacctgttgaaatcatccctttttcatggaaacaaaccgaaaataaaattcagtctttagggtgtcaaacaacgttacgtttaaaaaataatgaaacctatataaccgataacaataacatgattatcgattgtatattccctaatcatatttctaatcctgcccatttacacacccaattaaaaatgattactggtgtagttgaaacagggttgtttataagtatgacgagtacagcaattattggcactaaaaatgggataaagaaattgtaa

SEQ ID NO: 2264 - DNA, 663 bp, Bacillus cereus
atgaatttaaaacagctcgctggcgaatatgccgctaactttgtaaatgatggcatgaaggttgggcttggtacaggttctactgtatattggacaatacaaaaattaggtgagcgtgtaaaagaaggattatcatttcaagctgtaccaacatcaaaggaaactgaagcattagcacatcaactaaatatccccctactttcgttaaacgacgtacaaagtcttgatcttacaattgatggagcggatgaaattgattcagatttacaacttataaaaggcggtggcggtgcattacttcgtgaaaaaatcgttgcctcttcctctaaaaaactaattatcattgctgatgaatcgaaacttgtaacacatttaggtaattttccattacctgttgaaatcatccctttttcatggaaacaaaccgaaaataaaattcagtctttagggtgtcaaacaacgttacgtttaaaaaataatgaaatctatataaccgataacaataacatgattatcgattgtatattccctaatcatatttctaatcctgcccatttacacacccaattaaaaatgattactggtgtagttgaaacagggttgtttataagtatgacgagtacagcaattattggtactaaaaatgggataaagaaattgtaa

SEQ ID NO: 2265 - DNA, 663 bp, Bacillus thuringiensis
atgaatttaaaacaactcgctggcgaatatgctgctaactttgtaaatgatggcatgaagattgggcttggtacaggttctactgtatattggacaatacaaaaattaggtgagcgtgtaaaagaaggattatcatttcaagctgtaccgacatcaaaggaaactgaagcattagcacagcaactaaatatccccctaatttcgttaaacgacgtacaaagtcttgatcttacaattgatggagcggatgaaattggttcaaatttacaacttataaaaggcggtggtggtgcattacttcgtgaaaaaatcgttgcctcttcctctaaagaactaattatcattgctgatgaatcgaaacttgtaacacatttaggtaattttccattacctgttgaaatcatccctttttcatggaaacaaaccgaaaataaaattcagtctttagggtgtcaaacaacattacgtttgaaaaataatgaaacctatataaccgataacaataacatgattatcgattgtatattctctaatcatatttctaatcctgcccatttacacacccaattaaaaatgattactggtgtagttgaaacaggattgtttataagtatgacgagtaaagcaattatcggcactaaaaatgggataaaggaattgtaa

SEQ ID NO: 2266 - DNA, 663 bp, Bacillus cereus
atgaatttaaaacaactcgctggcgaatatgctgctaactttgtaaatgatggcatgaagattgggcttggtacaggttctactgtatattggacaatacaaaaattaggtgagtatgtaaaagaaggattatcatttcaagctgtaccgacatcaaaggaaactgaagcattagcacagcaactaaatatccccctaatttcgttaaacgacgtacaaagtcttgatcttacaattgatggagcggatgaaatcgattcaaatttacaacttataaaaggcggtggtggtgcattacttcgtgaaaaaatcgttgcctcttcctctaaagaactaattatcattgctgatgaatcgaaacttgtaacacatttaggtaattttccattacctgttgaaatcatccctttttcatggaaacaaaccgaaaataaaattcagtctttagggtgtcaaacaacattacgtttgaaaaataatgaaacctatataaccgataacaataacatgattatcgattgtatattctctaatcatatttctaatcctgcccatttacacacccaattaaaaatgattactggtgtagttgaaacaggattgtttataagtatgacgagtaaagcaattatctgcactaaaaatgggataaaggaattgtaa

SEQ ID NO: 2267 - DNA, 663 bp, Bacillus thuringiensis
atgaatttaaaacaactcgctggcgaatatgctgctaactttgtaaatgatggcatgaagattgggcttggtacaggttctactgtatattggacaatacaaaaattaggtgagtatgtaaaagaaggattatcatttcaagctgtaccgacatcaaaggaaactgaagcattagcacagcaactaaatatccccctaattacgttaaacgacgtacaaagtcttgatcttacaattgatggagcggatgaaattgattcaaatttacaacttataaaaggcggtggtggtgcattacttcgtgaaaaaatcgttgcctcttcctctaaagaactaattatcattgctgatgaatcgaaacttgtaacacatttaggtaattttccattacctgttgaaatcatccctttttcatggaaacaaaccgaaaataaaattcagtctttagggtgtcaaacaacattacgtttgaaaaataatgaaacctatataaccgataacaataacatgattatcgattgtatattctctaatcatatttctaatcctgcccatttacaaacccaattaaaaatgattactggtgtagttgaaacaggattgtttataagtatgacgagtaaagcaattatcggcactaaaaatgggataaaggaattgtaa

SEQ ID NO: 2268 - DNA, 663 bp, Bacillus cereus
atgaatttaaaacaactcgccggtgaatatgctgcaactttcgtaaaagatggaatgaagattgggcttggtacaggttctaccgtatactggacgatagaaaaattaggtgaacgtgtaaaagaaggactatcatttcaagctgtcccgacatcaaaagaaactgaagtattagctcagcaactaaatatcccactaatttcattaaacgacatacaaagtcttgatcttacaattgatggagcggatgaaattgattcaaatttacaccttataaaaggaggcggtggcgcattacttcgtgaaaaaatcgttgcctcctcctctaaagaactacttatcattgctgatgaatcaaaacttgtaacgcatttaggtacttttccattacctgttgaaatcatacctttttcatggaaacaaaccgaaagtaaaattcaatctttaggttgtcaaacaacgttacgcttaaaaaataatgaaacatttataaccgataataataacatgattattgattgtgtattccctcataacataacgaatcctgccaatttacacaatcatttaaaaatgattactggtgtagttgaaaccggattgtttgttaatatgactagtaaggcgattattggaacaaaaaacgggatacaggaattataa

SEQ ID NO: 2269 - DNA, 669 bp, Bacillus cereus
atggtgaatttaaaacagattgcaggtgaatacgctgctaactttgtacaagatggaatgaaagttggtcttggtacaggatcaactgtatattggacgatacaaaagttaggacaacgtgtacaagaaggtttatccattcaagctatacccacatctaaggaaacagaatcattagcacaacaactaaacattccgctgatttcgttaaatgacatacaaacacttgatttaacaattgatggagctgacgaaattgattcgaatttacagttaataaaaggtggcggtggtgctttacttcgtgaaaaaatcgttgccgcctcctctaaagaactgattatcattgctgatgaatcgaaactcgttacgcatttaggtactttcccattgcctgttgaaattattcctttttcatggaaacaaaccgaaaataaaattcagtctttaggatgtcaaacaacgttacgtttaaaaaacaacgatacatttataacggataacaataacatgattatcgattgtgtgttccctaatcatatatctaatccagctactttacacgaaaaattaaaaatgattactggtgtagtggaaacaggcttgtttataaatatgacaagtaaagcaattatcggaactaaaaatgggataaaagaattatcatga

SEQ ID NO: 2270 - DNA, 666 bp, Bacillus cereus
atgatgaatttaaaacaacttgttggcgaatatgctgctaactttgtaaaagatggaatgaacattggactaggcacaggatctaccgtatattggacgatacaaaaattaggtcaacttgtacaagacgggctatactttcaagctgtaccaacatcaaaggaaactgaagctttagcaaagcaactaaacatcccgctgatttctttaaataacgtacaaagtcttgatcttacaattgatggagcggatgaaattgattccgatttacagcttataaaaggcggcggtggcgcattacttcgtgagaaaattgttgcctcctcctctaaagaactcattattattgctgatgaatcaaaacttgtggctcgtttaggtaatttcccattgcctgttgaaattatccctttttcatggaaacaaaccgaaagtaaaattcaatctttagggtgtcaaacaacgttacgtataaaaaataatggaacctttattaccgataataataacatgattatcgattgtatatttcctaatcatatatctaatcctgctaatttacacgaacaattaaaaatgattactggtgtagttgattcaggattgtttataaatatgacaaggaaagcgattatcggtactaaaaacgggataaaggaactataa

SEQ ID NO: 2271 - DNA, 666 bp, Bacillus cereus
atgatgaatttaaaacaacttgttggcgaatatgctgctaactttgtaaaagatggaatgaacattggactaggcacaggatctaccgtatattggacgatacaaaaattaggtcaacttgtacaagacgggctatactttcaagctgtaccaacatcaaaggaaactgaagctttagcaaagcaactaaacatcccgctgatttctttaaataacgtacaaagtcttgatcttacaattgatggagcggatgaaattgattccgatttacagcttataaaaggcggcggtggcgcattacttcgtgagaaaattgttgcctcctcctctaaagaactcattattattgctgatgaatcaaaacttgtggctcgtttaggtaatttcccattgcctgttgaaattatccctttttcatggaaacaaaccgaaagtaaaattcaatctttagggtgtcaaacaacgttacgtataaaaaataatggaacctttattaccgataataataacatgattatcgattgtatatttcctaatcatatatctaatcctgctaatttacacgaacaattaaaaatgattactggtgtagttgattcaggattgtttataaatatgacaaagaaagcgattatcggtactaaaaacgggataaaggaactataa

SEQ ID NO: 2272 - DNA, 666 bp, Bacillus cereus
atgatgaatttaaaacaacttgttggcgaatatgctgctaactttgtaaaagatggaatgaacattggactaggtacaggatctaccgtatattggacgatacaaaaattaggtcaacttgtacaagaaggactatactttcaagctgttccaacatcaaaggaaactgaagctttagcaaagcaactaaacatccccctgatttctttaaacgacgtacaaagtcttgatcttacaattgatggagcggatgaaattgattccgatttacagctcataaaaggcggcggtggcgcattacttcgtgagaaaattgttgcctcctcctctaaagaactcattattattgctgatgaatcaaaacttgtggctcgtttaggtaatttcccattgcctgttgaaattatccctttttcatggaaacaaaccgaaagtaaagttcaatctttagggtgtcaaacaacgttacgtataaaaaataatgaaacctttattaccgataataataacatgattatcgattgtatatttcctaatcatatatctaaccctgctaatttacacgaacaattaaaaatgattactggtgtagttgattcaggattgtttataaatatgacaaggaaagcgattatcggtactaaaaacgggataaaggaactataa

SEQ ID NO: 2273 - DNA, 666 bp, Bacillus cereus
atgatgaatttaaaacagcttgttggcgaatatgctgctaactatgtaaaagatggaatgaacattggactcggcacaggatctaccgtatattggacgatacaaaaattaggtcaatttgtacaagaaggactatactttcaagctgttccaacatcaaaggaaactgaagctttagcaaagcaactaaacatccctctgatttctttaaacgacgtacaaagtcttgatcttacaattgatggagcggatgaaattgattccgatttacagcttataaaaggcggcggtggcgcattacttcgtgagaaaattgttgcctcctcctctaaagaactcattattattgctgatgaatcaaaacttgtggctcgtttaggtaatttcccattgcctgttgaaattatccctttttcatggaaacaaaccgaaagtaaaattcaatctttagggtgtcaaacaacgttacgtttaaaaaataacgaaacctttattactgataataataacatgattatcgattgtatatttcctaatcatatatctaatcctgctaatttacacgaacaattaaaaatgattactggtgtagttgattcaggattgtttataaatatgacaagaaaagcgattatcggtactaaaaacgggataaaggaactataa

SEQ ID NO: 2274 - DNA, 663 bp, Bacillus cereus
atgaatcttaaacaactcgcaggtgaatatgctgctaactttgtaaaagatggaatgaacattggactcggcacaggatctaccgtatattggacgatacaaaaattaggtcaatttgtacaagaaggactatactttcaagctgttccaacatcaaaggaaactgaagctttagcaaagcaactaaacatccctctgatttctttaaacgacgtacaaagtcttgatcttacaattgatggagcggatgaaattgattctgatttacagcttataaaaggcggtggtggtgcgttacttcgtgagaaaattgttgcctcctcttctaaagaactcataattatagctgatgaatcaaaacttgtgactcgtttagggaatttccccttgcctgttgaaataatccctttttcatggaaacaaaccgaaagtaaaattcaatctttagggtgtcaaacaacgttacgtttcaaaaataatgaaacctttataactgataataataacatgattatcgattgtatatttcctaatcatatatctaatcctgcccatttacacactcaattaaaaatgattactggtgtagttgattcaggtttgtttataaatatgacaaagaaagcgattatcggtactaaaaacgggataaaggaattataa

SEQ ID NO: 2275 - DNA, 666 bp, Bacillus cereus
atgttaaatttaaaacagctcgctgatgaatatgctgctaactttgtaaaagatggcatgaaagttggacttggtacaggttctacagcatactgggcgatacaaaaattaggtcaacgtgtaaaagaagggttatcaattcaagctgtcccgacatcaaaggaaactgaagcattagcaaagcaactaaatatcccgttaattttgttaaacgacgtacaaaggcttgacctgacaattgatggagctgatgaaattgattctaatttacagcttattaaaggaggcggtggcgcattacttcgtgagaaaattgtagcctcctcctcgaaagaacttataattatcgctgatgaatcaaaatttgtgacacgtttagggacttttccattacctgttgaaatcatccctttttcatggaaacaaaccgaaaggaaaattcaatctttaggttgtcaaacaacgttacgtttaaaaaataatgaaatatttataaccgataataataacatgattgtcgattgtatatttcctaatcatatagctactccttccgatttacacaaaagattaaaaatgattactggtgtagttgaaaccggattgtttgttaatatgactagtaaggcaattattggaacaaaaaacgggatacaggaattataa

SEQ ID NO: 2276 - DNA, 711 bp, Bacillus thuringiensis
ttgaaaattcaggccttgatgctggaccacgtccggcggagtaaagcgatggatttaaaacagatagctggtgaatatgctgcaaccttcgtaaaagatggtatgaagattggtcttggcacaggatcaactgcatactggacgatacaaaaattaggtcagcgtgtaaaagagggattatcaattcaagctgtcccgacatcaaaggaaacggaagcattggcacagcagctaaatattccgttgatttcgttaaacgacgtacaaagtcttgatcttacaattgatggagctgatgaaattgattctaatttacagcttattaaaggaggcggtggtgcattacttcgcgagaaaattgtagcctcctcctcgaaagaacttatcattatcgttgatgaatcaaaagttgtgacacgtttagggacttttccgttacctattgaaatcataccttttgcatggaaacaaaccgaaagtaaaattcaatctttaggatgtcaaacaacgttacgcttaaaaaataatgaaacgtttatcaccgataataataacatgattatcgattgtatattccctaatcatatacctactccttccgatttacacaaacgattaaaaatgattactggtgtagttgaaaccggattgtttgttaatatgactagtaaggcgattattggaacaaaaaacgggatacaggaattataa

SEQ ID NO: 2277 - DNA, 663 bp, Bacillus anthracis
atggatttaaaacagatagctggtgaatatgctgcaaccttcgtaaaagatggtatgaagattggtcttggtacaggatcaaccgcatactggacgatacaaaaattaggtcaacgtgtaaaagagggattatcaattcaagctgtcccgacatcaaaggaaacggaagcattggcacagcagctaaatattccgttgatttcgttaaacgacgtacaaagtcttgatcttacaattgatggagctgatgaaattgattctaatttacagcttattaaaggaggtggtggtgcattacttcgcgagaaaattgtagcctcctcctcgaaagaacttatcattatcgttgatgaatcaaaagttgtgacgcgtttagggacttttccattacctattgaaatcataccttttgcatggaaacaaaccgaaagtaaaattcaatctttaggatgtcaaacaacgttacgcttaaaaaataatgaaacgtttatcaccgataataataacatgattatcgattgtatattccctaatcatatacctactccttccgatttacacaaaagattaaaaatgattactggtgtagttgaaaccggattgtttgttaatatgactagtaaggcgattattggaacaaaaaacgggatacaggaattataa

SEQ ID NO: 2278 - DNA, 663 bp, Bacillus cereus
atggatttaaaacagatagctggtgaatatgctgcaaccttcgtaaaagatggtatgaagattggtcttggcacaggatcaactgcatactggacgatacaaaaattaggtcagcgtgtaaaagagggattatcaattcaagctgtcccgacatcaaaggaaacggaagcattggcacagcagctaaatattccgttgatttcgttaaacgacgtacaaagtcttgatcttacaattgatggagctgatgaaattgattctaatttacagcttattaaaggaggcggtggtgcattacttcgcgagaaaattgtagcctcctcctcgaaagaacttatcattatcattgatgaatcaaaagttgtgacacgtttagggacttttccattacctattgaaatcataccttttgcatggaaacaaaccgaaagtaaaattcaatctttaggatgtcaaacaacgttacgcttaaaaaataatgaaacgtttatcaccgataataataacatgattatcgattgtatattccctaatcatatacctactccttccgatttacacaaacgattaaaaatgattactggtgtagttgaaaccggattgtttgttaatatgactagtaaggcgattattggaacaaaaaacgggatacaggaattatga

SEQ ID NO: 2279 - DNA, 663 bp, Bacillus thuringiensis
atggatttaaaacagatagctggtgaatacgctgcaaccttcgtaaaagatggtatgaaggttggtcttggtacaggatcaaccgcatactggacgatacaaaaattaggtcaacgtgtaaaagagggattatcaattcaagctgtcccgacatcaaaggaaacggaagcattggcacagcagctaaatattccgttgatttcgttaaacgacgtacaaagtcttgatcttacaattgatggagctgatgaaattgattctaatttacagcttattaaaggaggcggtggtgcattacttcgcgagaaaattgtagcctcctcctcgaaagaacttatcattatcgttgatgaatcaaaagttgtgacacgtttagggacttttccattacctattgaaatcataccttttgcatggaaacaaaccgaaagtaaaattcaatctttaggatgtcaaacaacgttacgcttaaaaaataatgaaacgtttataaccgataataataacatgattgtcgattgtatattccctaatcatatacctactccttccgatttacacaaacgattaaaaatgattactggtgtagttgaaactggattgtttgttaatatgactagtaaggcgattattggaacaaaaaacgggatacaggaattataa

SEQ ID NO: 2280 - DNA, 663 bp, Bacillus cereus
atggatttaaaacagatagctggtgaatatgctgcaaccttcgtaaaagatggtatgaagattggtcttggtacaggatcaaccgcatactggacgatacaaaaattaggtcaacgtgtaaaagagggattatcaattcaagctgtcccgacatcaaaggaaacggaagcattggcacaacagctaaatattccgttgatttcgttaaacgacgtacaaagtcttgatcttacaattgatggagctgatgaaattgattctaatttacagcttattaaaggaggcggtggtgcattacttcgcgagaaaattgtagcctcctcctcgaaagaacttatcattatcgttgatgaatcaaaagttgtgacacgtttagggacttttccattacctattgaaatcataccttttgcatggaaacaaaccgaaagtaaaattcaatctttaggatgtcaaacaacgttacgcttaaaaaataatgaaatgtttataaccgataataataacatgattatcgattgtatattccctaatcacatacctactccttccgatttacacaaacgattaaaaatgattactggtgtagttgaaaccggattgtttgttaatatgactagtaaggcgattattggaacaaaaaacgggatacaggaattataa

SEQ ID NO: 2281 - DNA, 663 bp, Bacillus cereus
atgaatttaaaacaactcgctggtgaatatgctgcaaccttcgtaaaagatggtatgaagattggtcttggtacaggatcaaccgcatactggacgatacaaaaattaggtcaacgtgtaaaagagggattatcaattcaagctgtcccgacatcaaaggaaacggaagcattggcacagcagctaaatattccgttgatttcgttaaacgacgtacaaagtcttgatcttacaattgatggcgctgatgaaattgattctaatttacagcttattaaaggaggcggtggtgcattacttcgcgagaaaattgtagcctcctcctcgaaagaacttatcattatcgttgatgaatcaaaagttgtgacacgtttagggacttttccattacctattgaaatcataccttttgcatggaaacaaaccgaaagtaaaattcaatctttaggatgtcaaacaacgttacgcttaaaaaataatgaaacgtttataaccgataataataacatgattatcgattgtatattccctaatcatatacctactccttccgatttacacaaaagattaaaaatgattactggtgtagttgaaaccggattgtttgttaatatgactagtaaggcgattattggaacaaaaaatgggatacaggaattataa

SEQ ID NO: 2282 - DNA, 666 bp, Bacillus thuringiensis
atggatttaaaacagatagctggtgaatatgctgcaaccttcgtaaaagatggtatgaagattggtcttggtacaggatcaaccacatactggacgatacaaaaattaggtcaacgtgtaaaagagggattatcaattcaagctgtcccgacatccaaggaaacggaagcattggcacagcagctaaatattccgttgatttcgttaaacgacgtacaaagtcttgatcttacaattgatggagctgatgaaattgattctaatttacagcttattaaaggaggcggtggtgcattacttcgcgagaaaattgtagcctcctcctcgaaagaacttatcattatcgttgatgaatcaaaagttgtgacacgtttagggacttttccattacctattgaaatcataccttttgcatggaaacaaaccgaaagtaaaattcaatctttaggatgtcaaacaacgttacgcttaaaaaataatgaaacgtttataaccgataataataacatgattatcgattgtatattccctaatcatatacctactccttccgatttacacaaacgattaaaaatgattactggtgtagttgaaaccggattgtttgttaatatgactagtaaggcgattattggaacaaaaaacgggatacaggaattatcatga

SEQ ID NO: 2283 - DNA, 666 bp, Bacillus cereus
atggatttaaaacagatagctggtgaatatgctgcaaccttcgtaaaagatggtatgaagattggtcttggtacaggatcaaccgcatactggacgatacaaaaattaggtcaacgtgtaaaagagggattatcaattcaagctgttccgacatcaaaggaaacggaagcattggcaaagcaactaaatatccccctaatttcgttaaacgacgtacaaagtcttgatcttacaattgatggagcggatgaaattgattctaatttacagcttattaaaggaggcggtggtgcattacttcgcgagaaaattgtagcctcctcctcgaaagaacttatcattatcgttgatgaatcaaaagttgtgacacgtttagggacttttccattacctattgaaatcataccttttgcatggaaacaaaccgaaagtaaaattcaatctttaggatgtcaaacaacgttacgcttaaaaaataatgaaacgtttatcaccgataataataacatgattatcgattgtatattccctaatcatatacctactccttccgatttacacaaacgattaaaaatgattactggtgtagttgaaaccggattgtttgttaatatgactagtaaggcgattattggaacaaaaaacgggatacaggaattatcatga

SEQ ID NO: 2284 - DNA, 663 bp, Bacillus cereus
atggatttaaaacagatagctggtgaatatgctgcaaccttcgtaaaagatggtatgaagattggtcttggtacaggatcaaccgcatactggacgatacaaaaattaggtcaacgtgtaaaagagggattatcaattcaagctgtcccgacatcaaaggaaacggaagcattggcacagcagctaaatattccgttgatttcgttaaacgacgtacaaagtcttgatcttacaattgatggagctgatgaaattgattctaatttacagcttattaaaggaggcggtggcgcattacttcgcgaaaaaatcgttgcctcttcctctaaggaactacttatcattgctgatgaatcgaaactcgtaacgcatttaggtactttcccattacctgttgaaattatacctttttcatggaaacaaatcgaaagtaaaattcaatctttaggatgtcaaacaacgttacgcttaaaaaataatgaaacgtttataaccgataataataacatgattatcgattgtatattccctaatcatatacctactccttccgatttacacaaaagattaaaaatgattactggtgtagttgaaaccggattgtttgttaatatgactagtaaggcgattattggaacaaaaaacgggatacaggaattataa

SEQ ID NO: 2285 - DNA, 666 bp, Bacillus cereus
atgctgaatttaaaacagctcgctggagaatatgctgctaactttgtaaaagatggaatgacggttgggctaggtacaggttctactgtatattggacgataaaaaaattaggtgagcgtgtaaaagaaggattatcatttcaagctgtaccaacgtcaaaagaaacagaggctttagctaaacaactaaatatccctctaatttcgttaaacgacgtacaaattcttgagcttacaattgatggagcggatgaaattgatgctaatttacagcttataaaaggtggtggtggcgcattacttcgtgaaaaaatcgttgcctcatcttctaaagaactaattatcattgctgatgaatcaaaactcgtaacgtatttaggtactttcccattacctgtagaaattacacctttttcatggaaacaaactgaaaggaaaattcgatctttaggttgtcaaacaacgttacgtttaaaaaataatgaaacgtttattaccgataacaataatgtgattattgattgtgtattccctcaaaatataacgaatcccgccaatttacacaccaaattaaaaatgattacaggcgtagttgaaacagggttgtttgttaatatagctagtaaggcgattatcggaactgaaaacggaataaaggaattataa

SEQ ID NO: 2286 - DNA, 666 bp, Bacillus cereus
atgatgaatttaaaacagcttgcaggcgaatatgctgctggctttgtaagagatggtatgacgattggacttggtacgggttcaaccgtatattggacgatacaaaagttaggtcaccgtgtacaagaagggttatctattcaagctgcaccgacatcaaaagaaactgaagtattagcaaaacaattatctattccgctaatctctttaaatgaaattgatatacttgatctcacaattgatggagcagatgaaatcaataatgatttacaattaataaaaggtggcggtggtgcattacttcgcgaaaagattgttgccacctcctctaaagaacttattattattgcagatgaatccaaactcgtttcacatttaggtacctttccacttcctattgaaattatccccttctcttggaagcaaactgaaaaaagaattcaatctttaggatgcgaaacgcgtttacgtatgaaagatggcggaccatttataactgataacggcaatttaattattgattgtatttttccaaacaaaatattgaatccaaatgatacacatacagagttaaagatgattaccggtgtagttgaaacaggattatttatcaatatgacgagcaaagcgatcatcggaacaaaaaacggtataaaagaatattaa

SEQ ID NO: 2287 - DNA, 666 bp, Bacillus mycoides
atgatgaatttaaaacagcttgcaggcgaatatgctgctggctttgtaagagatggtatgacgattggacttggtacgggttcaaccgtatattggacgatacaaaagttaggtcaccgtgtacaagaagggttatctattcaagctgcaccgacatcaaaagaaactgaagtattagcaaaacaattatctattccgctaatctctttaaatgaaattgatatacttgatctcacaattgatggagcagatgaaatcaataatgatttacaattaataaaaggtggcggtggtgcattacttcgcgaaaagattgttgccacctcctctaaagaacttattattattgcagatgaatccaaactcgtttcacatttaggtacctttccacttcctattgaaattatccccttctcttggaagcaaactgaaaaaagaattcaatctttaggatgcgaaacgtgtttacgtatgaaagatggcggaccatttataactgataacggcaatttaattattgattgtatttttccaaacaaaatattgaatccaaatgatacacatacagagttaaagatgattaccggtgtagttgaaacaggattatttatcaatatgacgagcaaaacgatcatcggaacaaaaaacggtataaaagaatattaa

SEQ ID NO: 2288 - DNA, 666 bp, Bacillus weihenstephanensis KBAB4
atgatgaatttaaaacagcttgcaggcgaatatgctgctggctttgtaagagatggtatgacgattggacttggtacgggttcaaccgtatattggacgatacaaaaattaggtcaccgtgtacaagaagggttatctattcaagctgtaccgacatcaaaagaaactgaagtattagcaaaacaattatctattccgctaatctctttaaatgaaattgatatacttgatctcacaattgatggagcagatgaaatcaataatgatttacaattaataaaaggtggcggtggtgcattacttcgcgaaaagattgttgccacctcctctaaagaacttattattattgcagatgaatccaaactcgtttcacatttaggtacctttccacttcctattgaaatcatctccttctcttggaagcaaactgaaaagagaattcaatctttaggatgcgaaacacatttacgtatgaaagatagcagaccatttataactgataacggcaatttaattattgattgtatttttccaaacaaaatattgaatccaaatgatacacatacagagttaaagatgattaccggtgtagttgaaacaggattatttatcaatatgaagagcaaagcgatcatcggaacaaaaaacggtataaaagaatattaa

SEQ ID NO: 2289 - DNA, 666 bp, Bacillus cereus
atgatgaatttaaaacagcttgcaggcgaatatgctgctggctttgtaagagatggtatgacgattggacttggtacgggttcaaccgtatattggacgatacaaaagttaggtcaacgtgtacaagaagggttatctattcaagctgtaccgacatcaaaagaaactgaagtattagcaaagcaattatctattccgctaatctctttaaatgaaattgatatacttgatctcacaattgatggagcagatgaaatgaattcaaatttacagttaataaaaggcggcggtggtgcattacttcgtgaaaaaattgttgccgcttcctctaaagaacttatcattattgcagatgaatccaaactcgtttcacacttaggtgtctttccacttcctgttgaaatcatccccttctcttggaagcaaactgaaaagcgagtgcaagctttaggatgcgaaacacgtttacgtatgaaggatgacggaccttttataactgataacggcaatttaattattgatagtatttttccaaacaaaatattgaatccaaatgaaacacatacaaagttaaaaatgattaccggtgtagttgaaacaggattatttattaatatgacgagcaaagcgatcatcggaacagaaaacggtataaaagaatattaa

SEQ ID NO: 2290 - DNA, 663 bp, Bacillus cereus
atgaatttaaaacagctagccggtgaatatgctgctgactttgtaaaagatggaatgaaggttggacttggtacgggttcaactgtatattggacaatacaaaagttaggtgaacgtgtgcaagaaggtttatccattcaagctgtaccgacatcaaaagaaactgaagtattagcaaaacaactagctattcctttaatctctttaaatgaaaccgacatactcgatcttacaatcgatggtgcagatgaaatcaataatgatttacaattaataaaaggtggcggtggtgcattacttcgcgaaaaaattgtcgctacctcctctgaaaagcttataattattgcagatgaatccaaaatcgtttcacatttaggcacttttccacttcctattgaaatcatccccttctcttggaaacaaactgaaaagaaagttcaatctataggatgcgaaacatgtttacgtatgaaagatggtggaccatttataaccgataacggtaatttcattattgattgtatttttacaaacaaaatattgaatccaaatgatacaaatacagagttaaagatgattaccggtgtagttgaaacaggattatttatcaatatgacgagcaaagtgatcatcggaacagaaaacggtataaaagaatattaa

SEQ ID NO: 2291 - DNA, 666 bp, Bacillus mycoides
atgacggatttaaaacgcttagctggtgaatatgctgctgattttgtaaaagacgggatgaaaatcggccttggtactggttctactgtatattggacaatacaaaaattaggacagctaatcagcgaaggtttaacgattcaagctgtaccaacatcaatagaaactcagaaattagcagtgcagctttctatccctttaattcctttaagtgacgttgattaccttgatctcacgattgatggtgcagacgagattaaccccaatctacatttaattaaggggggcggcggcgctcttctacgtgaaaaaatagtcgccacttcttcccaaaaactcattataatcgctgatgaatcaaaactggtaaaagatttaggtacctttcctcttcctattgaaatcgtaccgttcgcttgggagcaaactgcaaaacgaattcaatcctttggttgccagacgattttacgtacccaaaataatcaaccatttataacagacaatggcaatatgatcttagattgtgtttttccaaaccaaataacgaacccaatcgaaactcatcagcaggtaaaaatagtaactggtgtaattgaaactggtttatttattaatatggtaaataaagcgattattgcaactgaaaaaggaataaaagtattatga

SEQ ID NO: 2292 - DNA, 666 bp, Bacillus pseudomycoides DSM 12442
atgacggatttaaaacgattagctggtgaatatgctgctgattttgtaaaagacgggatgaaaatcggccttggtactggttctactgtatattggacaatacaaaaattaggacagctaatcagcgaaggtttaacgattcaagctgtaccaacatcaatagaaactgagaaattagcagtgcagctttctatccctttaattcctttaagtaacgttgattaccttgatctcacgattgatggtgcagacgagattaaccccaatctacatttaattaaggggggcggcggcgctcttctacgtgaaaaaatagtcgccacttcttcccaaaaactcattataatcgctgatgaatcaaaacttgtaaaagatttaggtacctttcctcttcctattgaaatcgtaccgttcgcttgggagcaaactgcaaaacgaattcaatcctttggttgccagacgattttacgtacccaaaataatccaccatttataacagacaatggcaatatgatcttagattgtgtttttccaaaccaaataacgaacccaatcgaaactcatcagcaggtaaaaatagtaactggtgtaattgaaactggtttatttattaatatggtaaataaagcgattattgcaactgaaaaaggaataaaagtattatga

SEQ ID NO: 2293 - DNA, 666 bp, Bacillus cereus
atgacaaatttaaaacgcaaagttggtgaatatgctgctgattttataaaagatgggatgaaaatcggccttggaacgggttccactgtatattggacgatacaaaaattagggcagctaatcagcgagggtttaacgattcaagctgtagcaacttcaatagaaactgagaaattagcagagcaactttctatccctttaatttctttaagtgacgttgattaccttgatctcacgattgatggtgcagacgaaatcaatcccgatttacacgtaattaaaggaggtggcggtgctcttctacgtgaaaaaatagtcgctacttcatccaaaaaactcattataatcgcagatgaatcaaaacttgtaaaagatttaggtacctttcctcttccaattgaaatcgtaccgttcgcttgggagcaaaccgcaaaacgaattcaatcattaggttgccagacaattttacgtatccaaaacaatcaagcatttataacagacaatggcaatatgatcttagattgtgttttccaaaaccgaataaagaatccaatcgacactcatcaacagctaaaaatgctaacaggagtaatagaaacaggtctatttattaatatggtagataaagcgattcttgccactgaaaaaggaataaaggaattatga

SEQ ID NO: 2294 - DNA, 675 bp, Paenibacillus sp. JDR-2
atggaatcgaaacgtattgcagcagaaaaagcagttgaactcgtcaaagacgggatgaaagtaggacttggaaccggctctaccgcttattgggcgatccaagccattggccgtaaggtgaaagaagaggggctaaccattcaagcggtcgcgacctccgttcaatccgagcagctggcgaaagaacttggcattccgatgatgccattcgcagacgtggacgtgcttgatctgacaattgacggagcagatgaggttgatcccgccctgcacctcataaaaggcggcggcggcgctctgctccgcgagaaaattgtagcggctgcaagcaagcagctgattattatcgtggacgagagcaaggacgtgaagcagctgggcaagttcccgctgcctgtcgagattgttccgtttgcgttcgagctgacggtgaggaagcttcgcaagctgggctgcgagccgaagctccgcaagaacggtgaagagctgtatgtgaccgataacggcaactatattgcggattgcgagtttggcgccattgcggatccggaagcgctacatgacgacctgaaccggattcccggagttgtagacaacggattgtttatccatatggcaagtcttgttattgtgggctccgcagacggttcgatccggagtatcacgaaggaataa

SEQ ID NO: 2295 - DNA, 717 bp, Geobacillus sp. Y412MC10
atgacgagtgaaatgaatatgaagaaaatagcggctgagcatgccgccaagtatgttcaggacgggatgaagatcggtctaggcacaggctccaccgcctattacgccattctcaaaatcggggagatggtcaggtccggactctcgatccaagccgtggctacctctgacgcttcggagaagctggcgatggaacaaggaatacccctgacgcccgtacaccagatcgatcgcctggatttgacgatcgacggggctgacgagctggatgatcagctgcggttaatcaagggaggaggcggagcccttcttcgcgagaagatcacggcttatcacagcgaacggctcgtgattgtggcggatgaggcaaaagcggtagctcaactgggcgcttttccgctgccggttgagattgtcccttttgcctatgagtggacgattcggtccctggcacagcttggttgttcggtccaattgcgccgtcagccggatgaagggttgtatgtaacggataacgggaattatgttgctgattgccggttccaggaaatctcggggccggaggaattgagctcccgtttaggcactgtacccggcgtggttgaacatggtctgttcatcggcatggccgaccaagcgattatcggctgccgggacggttcggtacggatattgcattccgcgagcatgcaggccaagaatacatttgacagttga

SEQ ID NO: 2296 - DNA, 687 bp, Paenibacillus sp. oral taxon 786 str. D14
atgaatgccaaacaggcggcgggttaccgcgctgcaaaatgggtaaaggacggaatgaccgttggtctcgggacggggtcaaccgcttattatgcgatcgagaaaatcggcgagatggtggggaacgggttgcaaattcgtgccatcgcaacttcgaaggcttcagaggagcttgccgcgaaatatcacatcccgctaattgaggcgaaggacgtggaccgattggatctggcgatcgacggggccgatgaggtggatccgcaaatggcgctgatcaaaggcggcgggggagcgctgcttcgggagaagctcgttgcgatcaacagcgatcgatttatcgttatcgccgataacgggaagatggtctctacattagggcgtttcaaactgccaattgagctggttccgttttgttacgaatggactctgcgggagttgaagagccgttatgatgtgccgttcgagatgcggatgcaaggggatcagttgtacgtgacggataacggcaactacattgtcgatgcggccttcggacagataaccgacccagcccggttaagcgacgagttgaaggcgatgacgggcgttgttgagcatggattgttcgtgggtattgcacacacggttgtgattggttacgaggatgggcgtacggaaatcaaggaggcttcatgttcaaatcaatga

SEQ ID NO: 2297 - DNA, 675 bp, Chitinophaga pinensis DSM 2588
atggacacgatcacaaaagcaaagaaagcagccggagagaaggctgcatcgttggtacagcccggtatgttagtaggattgggaaccgggtcaactgcttactgggcgatagaaaagattggtcagatggtaaaggaaggattgaatatccgtgcggtagctacctccgttgcctcagaacaacaggcaatcgccttgggtatacccattacctctttcagcgaaattcagcagctggacattgatattgatggtgcagacgagatcagtgaagatttacagatcatcaaaggtggcggtggcgccctgttgcgcgaaaagatcgtcgcacacgccagcagaaggaaagtgatagtggccgatgaaagaaaatatgtaaagacactgggtaaattcccgctgccggtagaaattattccgtttggctgggaactggtgttcaaaagcatacaagccctgcaaggcgctcctactttaaggaccagagaagataaaccttatattacagacaacggtaactatatcctcgattgtatgttcggcgctatagaacacccggaacaactgcatcatcagctgaaagcgatgacaggtgttgtggaaaccggtctgtttatcaacctgaaaccaaccgtgattattgcatatgaaaacggtgaagtaaaaaccctctaa

SEQ ID NO: 2298 - DNA, 693 bp, Aciduliprofundum boonei T469
atggagttgaaagaagaattgaaaaggaaggcgggagagagagctgtggaatacataaaagacggcatggttgtgggcttaggaactggctctactgtaaaatacaccattctcaaactcggggagcttgtaaaagatggcttggatataatagggatacccacatcaattgcaacagaaaaacttgcgaaggagatgggaataaaattggggagcatcaacgattaccaagtcattgatttgacaatagatggagctgatgaagttgatagaaatttgaatttgataaagggagggggtggcgctcttctcagggagaagatgattgctcacgcttcaaaatatgaaatcatcgtggtggacgagagcaaagtaaaaagcgttttgggagattttcccttgccaatagagattgtaaaattcggatacaagagaacaatgaatgttctatcaaccctgggctgcaaacccttgcttagggtgaaaaatggggaagcgtacataaccgacaacggcaattatatcgtggattgtaaatttgagagaattgacgagcctgcaaagctggaaagaaggatcgatgagataccgggagttgtagaggtagggctattcgtgggcttgacaaacaaagtaatagttggaaaaaaagataaaatagaaattatgacaagttctggagattctttataa

SEQ ID NO: 2299 - DNA, 693 bp, Aciduliprofundum boonei T469
atggagctaaaagaagaattgaaaaggaaggcgggagagaaagctgtgaaatacataaaagacggcatggttgtgggcttaggaactggctctactgtaaaatacaccattctcaaactcggggagcttgtaaaagatggcttggatataatagggatacccacatcaattgcaacagaaaaacttgcaaaggagatgggaataaaattgggaagcatcaacgattaccaagtcattgatttgacaatagatggagctgatgaagttgatagaaatttgaatttgataaagggagggggtggcgctcttctcagggagaagatgattgctcacgcttcaaaatatgaaatcatcgtggtggacgagagcaaagtaaaaagcgttttgggagattttcccttgccaatagagattgtaaaattcggatacaagagaacaatgaatgttctatcaaccctgggctgcaaacccttgcttagggtgaaaaatggggaagcgtacataaccgacaacggcaattatatcgtggattgtaaatttgagagaattgacgagcctgcaaagctggaaagaaggatcgatgagataccgggagttgtagaggtagggctattcgtgggcttggcaaacaaagtaatagttggaaaaaaagataaaatagaaattatgacaagttctggagattctttataa

SEQ ID NO: 2300 - DNA, 675 bp, Oceanobacillus iheyensis HTE831
gtgaatgagcaagataaattaaaaaaagcagttggggaaaaagcggcaactatggtgaaggacggaatgaaagttggattaggatcaggatccactgtatattggatgattcgttcattgggtgaacgtattcaacaagatggcttgaaaattgaaggcattccatcttcaaatcaaacagcaacatgggcagaagaagctggtattccgttaacagatttctcgaatgtgaaagaattagatataacgattgatggggcggatgaagtagatgctaataatcatttgattaagggtgggggagctgcgctttttcgtgaaaaaataattgctcaagctgctaaagagtttgtcataattgtcgatcaatcaaaagtagtagagactctaggagaattttctcttcctgttgaggttctgccattttcatggcaacgaactgcaaatgaaatatctaaattaggttgtgttcctacggttcgtgttcatgaggaggagccactagttaccgataatgggaattatattttagattgtccttttaaagttattccgcatccggataaattaaataaagagattaaatcaattgtaggagtaattgaaacgggcttatttattgatatggctactacggtaattgttggagaaaaagataatatttatataaaataa

SEQ ID NO: 2301 - DNA, 687 bp, Bacillus clausii KSM-K16
ttggatcagctgaaaagaatggcggcggaagctgctgcagagtatgtgaaagatggcatgaagatcgggctaggttctggttcaacggtgtttgaatttgtccgtgtgttaggagaaaaagcaaaagaagggctgaacatacaagctgtggcggcctcacggaaaacggaagcacttgctaaagcatgtggcatacacatcatcgattttccaacaatggaaaagctagaggtcgcttttgacggagctgatgaaattgcccctggccttatgttattaaaagggggcggcgggtcgcttttacgagaaaaactggtagcggcagcagcgaagcgtctcgtcgtacttgccgatgaaagcaagcttgtagaggagttgggcgctttcaaactaccagtcgagatcattccatttgggtgggaaacaacagccatgcggattgaagcgctaggcggtgtagcgagtttgcggcaaacgggcaaaagcccatttgtttcagataaccataattggatacttgactgtgattttggcaacattcgcgatccttatagcttgcatgaaaaggtgaaaaaacttgttggcgtcgtagaaacaggcctatttttggacatggcttgcgaagccattgtagcaagcaaaaacggtatccatcatataacaaaaggagacgaattcaatgtttga

SEQ ID NO: 2302 - DNA, 675 bp, Alicyclobacillus acidocaldarius
atggaaaagaagcggatggcgggtgaagcagccgcaaagcggattcagtccgggatgaaggtcggcctcgggacgggttcgaccgcgtactacaccattgtcgaagtggggagacgcgtcaaggaagggctcgagatcgtcgccattcctacgtcccgcgagacggagcggttggcccgagagctgggtatccccctgaccgattttcgcagctgcccgcgcctggatctcaccatcgacggcgcggatgcggtcacgcccgaccttcagctcatcaagggcggcggtggcgcgctgttgcgcgaaaagttggtcgcgtccatctcggatgaactcatcatcgtcgtggatgacagcaaattgtacgactctctgtcggggctcgcgatccccgtcgaagtggttcccttcgcgtgggagacgaccgcgcggcggatcgaacagctcggcgggcgctggacccttcgcgagcgaaacggcgagacgttcgtcacggacaatcacaactacatcctcgacacggtgttcgacgaagtggtcgatcccgcggatttggcgcggcgtctcaagctgaccaccggggtcgtggagtcgggcctgttcatcgacatggcgagcgaggtggccatcggcaccgatgaaggcgtggtgtggcggaagaagccagggacttga

SEQ ID NO: 2303 - DNA, 675 bp, Alicyclobacillus acidocaldarius
atggaaaagaagcggatggcgggtgaagaagccgcaaaacggattcaacctgggatgaaggtcggcctcgggacgggttcgacggcgtactacaccattgtcgaagtggggagacgcgtcaaggaagggctcgagatcgtcgccattcctacgtcccgcgagacggagcggttggcccgagagctggggatccccctgaccgattttcgcagctgtccgcgcctcgatctcaccatcgacggcgcggacgcggtcacgcccgaccttcagctcatcaagggcggcggtggcgcgctgttgcgcgaaaagttggtcgcgtccatctcggatgaactcatcatcgtcgtggatgacagcaaattgtacgactctctgtcggggctcgcgatccccgtcgaagtggttcccttcgcgtgggagacgaccgcgcggcggatcgaacagctcggcgggcgttggacccttcgcgagcgaaacggcgagacgttcgtcacggacaatcacaattacatcctcgacacggtgttcgatgaagtcgccgatccggcggacttggcgcggcgtctcaagctgaccaccggggtcgtggagtcgggcctgttcatcgacatggcgaacgaggtggccatcggcaccgatgaaggcgtggtgtggcggaagaagccagggacttga

SEQ ID NO: 2304 - DNA, 693 bp, Synechococcus sp. JA-3-3Ab
atggccagtgcagatgagctgaaacaggcggcagcccaagcggcggcccaaaaggtgcagtcgggcatggtggtggggctgggcacgggatccacagccgcctttgctgtgggcgccctagcccagcgcatgcaaaaggaggggctgcagttcattggggtgcccacttccgagcgcacggcagaacaggcccgctctctagggatcccgctggccacgctggaggagcagccgcgcctagatcttgccatcgatggagccgacgaaatcgaagtgggatccctcaacctcatcaagggggcagggggagctctgctgcgggagaaactggtggaggccagcgctgctgagctcatcatcatcgccgatgcctccaaaaaggtggcccacctgggcacccgcttcccggtgccggtggaggtggtgcgctttggctggaagacgaccctagcgcgggtggaggccctgggctgtcaggcggtgctgcggcgcactgccgagggggatccctacctcaccgacgagcagcactacatcctcgactgccagtttggccccatcgccaatccggccaagctggccgagcagctcaagggaacggtgggggtggtggagcacggcctgtttatcggcatggccacggaggccattatcgctgggcctgaagggatcgagacgctgcggcagagctga

SEQ ID NO: 2305 - DNA, 717 bp, Synechococcus sp. JA-2-3B'a(2-13)
atgactacccttcgcgtcagcgggaccgagtctttagatgatctgaaacaagcagcagcccgagccgcggttcaaaaggtgcagtcggggatggtggtggggctgggcacgggatccacagccgcctttgccgtgagcgccctagcagagcggatgcaaaccgaaggtctccagattatcggcgtgcctacctcggagcgcacggctgaacaggcccgctccctggggatcccgctggctaccctagaagagcagccgcgcctggatctggccatcgatggggccgacgagattgaagtgggatccctgaacctgatcaaaggggcaggaggggccctgttgcgggaaaagttggtggaggccagcgctgccgagctgatcatcatcgccgatgcctctaaaaaagtcgcgcagttgggcattcgcttcccggtgccggtagaggtggtgcgctttggctggaaaaccaccttggcgcgggtagaggctctggggtgcacagccaccttacggcggaatgccaacggggatccctacttgacggacgagcagcactacatcctcgactgccaattcggccccatggcggatcctgccaagatcgccgatcaactcaaggggacggtgggggttgtggaacatggcctgttcatcggcatggccaaagaggcaatcatcgccctcccgactgggatcgaaacgctgcaacccagctga

SEQ ID NO: 2306 - DNA, 693 bp, Gloeobacter violaceus
gtggacctcgatatcctcaagcaaacggcggctcggcgcgctgtcgagcttgtcgaagatggcatggtggtcgggctgggcaccggctcgaccgccgcatttgcagtgagcgtcctcgccgagcgagtgcgcctggggctgcgggtggtggggatccccacctcggagcgcaccgcccgccaagctgaggcggagggtattgttctggggacactggcggagcaatccagggtcgatctcaccatcgatggggcggacgaggtggccctgggggagctggcccttatcaagggcctgggtggtgctttgttgcgcgaaaagattgtcgctgccgcgagcgagaggctgattatcatcgtcgatgccaccaagctcgtcgaacagcttggtagccacggcccgctgccggtggaggtggcgccgtttggctggcaggcgaccgcccgcgccctggagcggctcggtgccgaggtgaatctgcgagcccagcatggacaagcgtttctcaccgacggcggccactacatccttgattgtcgttttggaccgatcgcccggccggccgaactcgaagcggccatcgaccgtatcccgggggtggtggaaagcggtctgtttgtcggcatggcaagcgcggtgatcgtagccgacgaggggggtatcgaagtgctcacaccttctgcagcgccttga

SEQ ID NO: 2307 - DNA, 705 bp, Sphaerobacter thermophilus
gtgccgccggagggggatgagcagacgcggcgcaagcgggcggcggccgagcgcgccgcgtctgccgtgcaggacggtgcggtggtgggtctgggcaccggttccaccgccgagtgcgtgattcaggcgctggcggagcgggtgaaagagggtctgcgtatcgtgggggtgcccacgtcgctgcgctcggagcgcctcgcccgctcactgggtatcccgctgatcgatctgcaagacgccacccgcatcgacgtcaccatcgacggagccgacgaggtcgcggtcggcaccttggacgtactcaagggccacggcggcgcgctgctgcgcgagaagctggtggcggtggcgtcggagcgcgaggtgatcgtcgtcgacgacacgaagctggtcgagcggctcggcagccgcttcgcggtgccggtagaggttgttcccttcggctggcgtgttcccgcccaggcgctggaagcgctcggggggcgggtggcgctgcggtcggttccgcccgagggcgagcccttcgtgaccgacaacgggaactacatcctcgatgtcgacttcggcccgattgccaacccggccgcgctcgcgaacgagatcaagacgatcaccggggtgatcgagcacggactcttcattggaatcgcccacgaggtcatcgtcgccggcgcccagggtgtcgaggtgctgacgcgcgggtag

SEQ ID NO: 2308 - DNA, 693 bp, Granulibacter bethesdensis CGDNIH1
atggatacggatgcgctgaagcgcctggcgggggaagaggcggcagcccttgttcaggatggcatggtggttgggcttgggactggatcgaccgctgcctgcatggtggatgcgctgatcagacgcgtggctcaggggctgaagatcgtgggaattccgacatcgctccgcacggcggagcaggcgcaggctggcggcattcctctgaccgatctgggtgcccatccgcggatcgacctcacgattgacggtgcggatcaggtagagcgtggcaccttgaatctcatcaagggtatgggcggcgccctgttgcgtgaaaagctggtggctgctgccagtgagcggctggtcattattgtcgatgatcgcaaattgtccgaaaatctgtctctgccggttcctgtcgaggtggttcccttcggctggcaggcgaccgatctgcgtattcaggcgctcggtggccgtaccgtattgaggggtggtgcggatggcactccttatgtcacggataatcacaactatatccttgatgtggatttcggagcgatgggcggctcccgtaagccggagacactggatgcggcgttgcgggagattgtcggtgtcgtggagaccggatttttcatccaccgtgcagaaaccgtcattatcgctggtgaagggggcgtcacacgctggcagcgttcggcctga

SEQ ID NO: 2309 - DNA, 705 bp, Gluconacetobacter diazotrophicus PAl 5
atgggcgtccagaattcggacccgatgattgaactgaaacgcatggcggcggaagaagccgccgccatggtccaggacggaatggccgtcgggctgggatcgggcagcacctcggcgatgatgatcgacgcgctgggccgccgctgggccgaggggctgcgcttcgtggccatccccacctcggaacactcggccgaacaggcgcgcgcgcatgggatcacgctggtgacgttcgccacccatccgcagctcgacatggccatcgacggcgcggacgaggtggaacgcggctcgctgaacctggtcaagggtctggggggcgccctgttccgcgaaaagatcgtcgcctcggcagcgaagcgcttcatcatcgtggtcgatgaaagcaagctggtcgatcatctgggcagccgggtcgcggtcccggtcgaagtcacgtcgttcggctgggaaagcacggcgcggcaactgggcgaactcggcgcccgggtgtcgcagcgcatggaccgcaatggcggcctgttcgtgaccgacggcggcaacatgatcctggactgcgccttcggccccatcgccgacccgccgcaactggcggcggacatccgcgccatcgtgggcgtgatcgaaagcggactgttcatccgtcgcacgtccgaagtcatcgtggccggccgcagcggcctgacccgcctggtggcggcatga

SEQ ID NO: 2310 - DNA, 714 bp, Acetobacter pasteurianus
atgaccgcaacaccgcccgaccccgccgccgcctttaaacagcaggctgccatcaaggccgcatcccttgtgcaggatggcatggccgttggccttggcacgggttctaccgccaaatttgttgttgctgaactcggccgccgtgtgcgggaagaagggctgcgtatccgtgccattcccacatccagtgttacggaaaaacaggccaaagaagaagggattccccttacgacttttggggagcagcctgagctggatatcgccatagatggggcagatgaaattgaaccccgcaccctcaacctgattaaaggtctggggggcgctttgttgtgggaaaaaattgttgcctctgccgcaaaacagtttgttgtggtggccgacgccagcaaatacgtggatcatctgggtgcaaaatgccccctgcccgtagaggttattccttttggttgggaaaacgttgcacgccagttgggcgaattgggcgcacacgtcacaccacggcgtaaccgtgatggatctttctatctgaccgatgaaaagaacctgatcatggattgcgtatttggccccatgatggaacctgaaaaactgggccgctccattctggaaattgttggcgtggttgagcacgggctgttcctgcatatggcatgccagaccatcaccgcagggccagaaggcatacgcatcctcaccccgcaacaggattaa

SEQ ID NO: 2311 - DNA, 696 bp, Gluconobacter oxydans
atgagcggtacggatatgaacgttcacaagcgtacggccgcacgtgaagccgcggatatggtcaaaagcggtatggtcgtggggctcgggaccggcagcacggcggcgtacatgatcgagcgtctgggcgagcgcgttgcggaaggcctggagatctttggcattccgacctcggatgacagcgaggacaaggcgctcaaggccggtattccgctgaccgatttcagcgcgcatcgccgcatcgatattgccattgatggcgcggacgaggtccagcgtggttcgctcaatcttatcaaggggctgggcggggcgttgctgcgtgaaaagattgtggcgcaggcagccaagcgtttcgtggtgatcgtggacggcaccaagcccgtggacctgctgggcgaacgggcgccggtgccggtggaagtcatttctttcggctgggaatgtacggcggaacgtctggcggcctgtggcgcacgcggcgtgaagccgaggacggaccgggccggatcgctgttcgtaaccgataccggcaacatgattctggactgccattttggaccgatcgaaaagcccgaggaactggctgagaaaatcgaccggatcgtgggtgtcgtggagcacggcatgtttctcaacatggcgtccgaagtcctcgtggcgacgccggacggtgtggagcactgggagccatga

SEQ ID NO: 2312 - DNA, 714 bp, Thermomicrobium roseum
gtgggaaccgaacgcgcgaaagagcgagcggcacgctttgcggcctcgctcgtcgaagacggcatgatcgtcggtctgggctccggttctaccgcggagctggcggtgcgtgcgctcggtgagcgactgcacgatgggcttcggctgatcggggttgcgacctcgcaacgtactgcagccctggcccgccgggtaggcatcgagctccgcgatccggattcggtcgaccggatcgatctggcgatcgacggtgctgacgaggtcgaggaacgctcgctcggtcttctcaaggggcgagggggagcgctcgttcgcgagaagctcgtggcccgcatggctcgccgcctggtgatcatcatcgatgactcgaagctcgtcgcagctctgggcgcgcgtttcccgctcccggtcgaggtcgtgcccttcggctggcgctggtgcgctcggtggctcgaggatttaggagggcgaccgacactgcgctgccgtccgactgggcatccatttcgctccgacaatgggaatctcattctcgatgtcgcgttcggtgcgatcgccgatccagcgtggctcgaccgaacgatcaagatgctgccaggtgtcatcgaccacggactgtttttggacatggcggatctcgtcatcgtcggaagcgagaccggcattcgcctgctcgagcgctcgcgaacggtgagcgagacttcgaaaagttga

SEQ ID NO: 2313 - DNA, 690 bp, Thermobaculum terrenum ATCC BAA-798
ttgaatcagctagatctcaaaaggatggtagcttatagagcagctcaactcgtgcctgatggtgcattaataggtttgggatctggatccactgctgagttatttgtgcaattcctgggagagagggtaagaaacgaaggactaagggttgtgggggttcccactagcgagaggactgtagcagccgctaaagcagcaggagtcgaacttactacattggaagagcatcctgagttagatatggcttttgatggcgcagatgaggtcgaccccgatctcaacctcgtgaaaggactaggaggagctttagccagagaaaagatagtggctaaggctagcagagttttcgtggtactagtggatgagtcgaagttagtggatatcttaggctcaaaatcccctgtgccagtagaagtgcttcaatttggttggactaggacttcacgagagctcgagtctatgggactacagccggttctgcgcacgagagatgggttgccatatgtaactgacaatggtaattatgttcttgacctacacgttggccctatatccaatcccagcgacctcgatctcaagttacaccttgtaacaggagttgtggagacgggactatttatagatatagcttccctagtaatggtaggcacacaagatggtgtgatagagatgaggagacctcaagattag

SEQ ID NO: 2314 - DNA, 702 bp, Clostridium beijerinckii
atggatcaaaaaagagttgcaggagaaaaatcaacagaatatataaaagatgggatgatattaggattgggaacaggttctactgcctattacatgattaaaaaagttggagaattgattaaaaatggaatgaagataaaagctgtagcaacatcaaaaagtactgagagtttggcaagagaacttaagatccctttattatcaattgatgaagttgataggattgatttagcaattgatggtgtagacgaaatagataatgaatttaatgctattaaaggtggtggtggagccttatttagagaaaaaattgtggcgagtttggctaatgaagttatatggattatggatgaaagtaaattagttgatggtattggagaatttcctttaccagttgaaatattaccatatggatacaaacatgtaattaaagaattacaggattattcattaaatcccaaaataagaatgaaggaagaagagatttttgtgactgataatggtaactatatagttgatttgcatataggaacgccaatgaacattaatgacgtttataataaagttaatagaataactggagtgctagaaacaggattatttattaatatgtgcaatcgtattattattggcacaaatagtggcgccaagattattaataatagcaacagtcaaaatgtgaagatggagcaatttagatag

SEQ ID NO: 2315 - DNA, 675 bp, Gemella haemolysans
atgaatctaaaagaagttgttggtaaaaaagctgtagattatgtaaaagatggtatgatcgttgggttagggacaggttcaactgtattctattttgttcatgcattagctgatagagtaaaagaaggattgaatgttgaaatggtatcaacatcgattcaaacggttgaactagctaaaagccttggtctttcaatcaaagaactagaagagattgatcatattgatcttgctgttgatggagtagatgaaattgataaggattttaatgcgataaaaggtggaggagcagcattatttagagaaaaaatagttgctgatattgctcgtgaagtaatctggatctatgatgagagtaaagatgtagaaaaactaggaaacttcaacctacctgtggagatcttgccatttggttatagtcatactataagaaaaatggaagaagtgggcttaaaaccagtgttaagattaaaagatggagctactctcataacggacaacaataattacattgtagatttacacttaggttacggatttgatattaaagctgtaaaagaaaaactagaaagcatagttggagtagtagagcatggtttatttttaaatatgtgtaaactatgcattaagggaacagaacagggagctgtaattatagaaaatccaaataattaa

SEQ ID NO: 2316 - DNA, 681 bp, Clostridium bolteae ATCC BAA-613
atgtacagtaaagaagaacagaaaaaagcggctgcctggcaggcggccatggaggtagaggataacatggtgttgggcctcggaaccggttcaactgtatattatctcatggaaaaactgtccgaacgaatccgcggcggactgtatgtccatggggcagccacttctcttgagacggaaggcttggcccgccgtttgggcatcccccttatctccctggaggatgcccggaccatacacctggctatcgacggggtggacgctattgacccggatttctattccattaagggcggaggcggtgccctgttccgtgaaaagatcatcgcctgcaaggcccggcgggtcttatggattatggaccagagcaagcttgtacattccctgagcggatgtgtgctgcctgtggaggttcctgcttttgcagttccctatgtggaggaacaggtaagggaagcagggtttataccgaagctgaggataaaaaacgggacagtatttgtcacagacaacggcagccatatcctggatctgacaggaggcgttgaaatggattaccccatggcagcggttcgtctcaaatccatgaccggcgtcttggaaacaggtctgttcggtgatatctgcgaaaaaatcatagtgggaacggaaaacggaactcaagaacgcttccataattga

SEQ ID NO: 2317 - DNA, 744 bp, Clostridiales bacterium 1_7_47FAA
ctggcagcattaaaagctgccagtgagatacaggacaatatggtattgggattaggcaccggctccaccgtgtattaccttattcttaaactggccgaacgcgtccgcggcggccttcatatccatgccgccgccacctctgccaggacagagggactggctgcccattacggcatcccccttatcccgctccatcaggcggaacagatccaccttgccattgacggagtggacgccattgattcggacttctattccatcaagggcggtggcggcgcgctgttcagggaaaaggtgattgcctcaaaagcccggcgggttatctggatcatggaccaaagcaagctggtcccaacgctgaacggacttacgctgccagtggaggtggtgccctttgcaacgggatttgtggaggaacaggtacgggccatgggttttatatccaggctgcgccggaacggggatggcctggacgggaataacccggacagggatgattcgggagccagcgtatttcttaccgataacggaaatcatatcctggatttacaggggaaggaaggcgtggactaccgtctgatggctggaaggcttaaagctttgaccggagtggtggagactggggtatttggtaatatctgtgaaaaaatcattattgggacagaggacggggtgattgtaaaatcctctggaaaccatagtatcccttcacctctcattcagatatcttcatgtcaaaaatag

SEQ ID NO: 2318 - DNA, 696 bp, Clostridium hathewayi DSM 13479
atgccagatacaaaagacaaacagataaaagaacagaaaaaagccgcggccgttatggccgcgggtgaactgcgtgacggcatggtcgcaggcctgggaaccggtacaaccgtatattatctgatacaggaaatcgccaggctggtaaaagaaggacttaccattcacgtcctgccaacctcagaacaaacccggagtcttgccagtcagcttaacatccctctgctctcaaccgataccgccccggccgctgacttggcaattgacggtgtagacggtgtggacagccatttctggtccgtgaaaggaggcggcggcgcactgttccgggaaaagctgatcgcctccaacgcccggagggtgatctggatactggatgagagcaagctcttaaaccatttaagtgaggttccgctccccatagaggtcgtcccctttggcttttcttatgtcatgaaggaagtcgccgctctgggtttccggcccagactgcgcttaaacgacggtatgccctttctgactgataacggaaactatattttggacctggccggtgattcgtccatggattacagggaaaaatcggcattgctgaagtccttaaccggcgttgtcgaaaccggactgttcccggatttctgcgaaaagctgataatcggcggagcggacggggtcagagtcctggaaaacaggtga

SEQ ID NO: 2319 - DNA, 699 bp, Exiguobacterium sibiricum 255-15
atgtatgagcaagagaagaagatgctggcggaagcggcaatcaagcaggtcaagaacggtatgatccttggtctcgggaccggttcgacgacccggagtttcatcgatgccttgggtgaatgggtcaaagcgggcggcgaggtgcaaggggtcgcaacatccaacgagacggttgaacaagcgaaacgattgaacattcccctcctgtcactcgaagaagcaacccatatcgatctcgtcatcgacggcatcgatcagatcgatccacggttccgagtgctcaagggcgggggcggcgcgttattccgggaaaaagtcgtcgcgctgatgagccgggaaatcctctacttagcggacgcctcgaaattcgtgcaccacttgaccggaccgttaccggtcgaaatcgatgcgtttgcgagaccgtatgtcgagcgttatctgcgggacaagcagctggacgtgacattgcgggaacacgatggtcaaccgttcgtgacggatggcggacatttgattctggatgtggatctcgagcgggttcaggatgtccgtcattttgcccaggaactaaaaagtttgacgggggtgctcgaaaccggttatttcgaacggcaaccggatcacgttctgaccgtcgaacagggaaaagtccgacagttggcccacccgaacctccgggacgggggaggacttgtctaa

SEQ ID NO: 2320 - DNA, 687 bp, Staphylococcus capitis
atgaaagacgtaaaagaacttaaacttatgacattagatgatgtaacgagccaaataaaagatggtatgacactcggaatcggtacaggaagtactattgagttgttagtacctaaaattgctgagttgattcatcaacatcattacgaaattacaggcgtgtgcacatcaaataaaactgcttttcttgccaaggagttagatataaacattgttgaagtcaacgacgtaaaaaaaattgatcttgctatagatggtgcagatgaagttgatccaaatctcaaccttattaaaggtgggggcggtgcactgttcagagaaaaagtgattgatgaaatggctgaaaaatttgttgtcattgccgatgaaaataaaatcgttgactatttaggtcaaacgtttgttttaccagttgaagttgataaatttaattggtatcaagtttccaaaaagattgagagtattaagggcgtaaaagtgaatagacgtgtgaatgaagacgttccatttacaacagataatggaaattatatattagattgtaatttaccagaaggcattgatccgtatgaaatgcatgaatttttgattcatttaacaggagtattagaaacaggatattttctcgatatgactgatcaagtgattgtaggtacccaaaatggcgtaaaaatcatggataaataa

SEQ ID NO: 2321 - DNA, 690 bp, Staphylococcus epidermidis
atgaaagacgtaaaagaacttaaactcatgacgttagatgatgtgattagtcagatagaagatggtatgacgcttgggatagggactggaagtacaatcgaattgctagtacctagaattgctgaattggttcatcaacatcattacgatattactggcgtatgtacatcaaataaaacggcctttctggcgaaagaattagatattaaaattgttgaggttaatgatgtcaatcacattgacttagctatcgacggtgctgatgaagtagatccaaaccttaaccttattaaaggtggtggcggtgcactattcagagagaaagtgattgatgaaatggctgaaagattcgttgtcattgctgatgaaaataaacttgttgattatttagggcaaacgtttgtattaccagttgaagtagataagtttaattggtatcaagtagcgaaaagaatagaagacattcaaggagtgaaagttaatagacgcgtgaatgaggatgttccatttacgacagataatggaaattacatattagattgtacattgccagaaggcattgacccttatgacatgcatgaatttttaatacatctaacgggtgtattagaaacaggttacttccttgatatgacggatcaggtaattgtgggaacacaagatggcgttaaaattatgaataaagcgtag

SEQ ID NO: 2322 - DNA, 693 bp, Staphylococcus warneri
atgaatgatgtaaaacaacttaaattgatgacgcttgatgatgttttaagtcaaatcgaggatggtatgacacttggtattggaacaggaactacaattgagttattagtgcctaaaattgctcaacttattaaagaaaagcattataatattatcggtgtttgtacttctaataagacggcgtttttagctaaagaattaaatattaatattgttgatgtgaatgatgttgaaaaaattgatttagctattgatggtgctgacgaagtagatcctcaacttaacctcattaaaggtggcggtggagcgctatttagagaaaaagtaatcgatgaaatggcagaccgttttgtggttattgctgatgaaaacaaagttgttaactacctaggtgaaacatttaaattaccggttgaagtagataaatttaactggtatcaagttgctaagaaaatagaaacaattggcggcgtgacaacacaacgtcgtgttacggatgatgtcccatttacgactgataatggtaattatattttagattgtgcattaccaaaaggtatcgatccttatgaaatgcatgaatttttaattcatatcacaggagtactagaaacaggctacttccttgatgttgctgaccaagcaattattggaacacaacaaggtgttaagaagatgaacagacaagattaa

SEQ ID NO: 2323 - DNA, 693 bp, Staphylococcus epidermidis
atgaaagatgcaaaagagctaaaattgatgaccttagaagatgtacttagtcaaattgaaaatggtatgacaatcggaataggaacagggagcacaattgaattattaattccccaaattgctgaattaattcagcaaaagaattatacaattaccggcgtctgtacttctaataaaacagcatttttagctaaagaattagctatgaatatagttgatgtaaatgatgttgagaaaatcgacttagcaatagatggcgctgatgaagtagacagtgcgcttaaccttattaaaggcggtggtggagccttatttagggaaaaggtcatagatgaaatggctgaccgatttgtcgttgttgtagatgaaagtaaactcgtcaactatttaggagaaacatttgcattaccagttgaagtcgataaatttaattggtaccaagttgccaaaaaaattgagcgtacttatgatattcatgtaagcagaagagttaatgaagatgtaccgtttataaccgacaatggtaattacatattagattgttcattgcaaaatagaattcctgcttatgagctacacgaatttttaattcatttaactggcgttcttgaaacaggatatttcctcgatattgccgatcaagtaatagtaggaacacaagaaggcgtaaaaatattaaataaagaaacttag

SEQ ID NO: 2324 - DNA, 693 bp, Staphylococcus epidermidis
atgaaagatgcaaaagagctaaaattgatgaccttagaagatgtacttggtcaaattgaaaatggtatgacactaggaataggaacagggagcacaattgaattattaattccccaaattgctgaattaattcagaaaaagaattatacaattaccggcgtctgcacttctaataaaacagcatttttagctaaagaattagctatgaatatagttgatgtaaatgatgttgagaaaatcgacttagcaatagatggcgctgatgaagtagacagtgcgcttaaccttattaaaggcggtggtggagccttatttagggaaaaggtcatagatgaaatggctgaccgatttgtcgttgttgtagatgaaagtaaactcgtcaactatttaggagaaacatttgcattgccagttgaagtcgataaatttaattggtaccaagttgccaaaaaaattgagtgtacttatgatattcatgtaaacagaagaattaatgaagatgtaccttttattaccgacaatggtaattacatattagattgttcattgcaaaatcgaatttctgcttatgagctacacgaatttttaattcatttaactggtgttcttgaaacaggatatttcctcgatattgccgatcaagtaatagtaggaacacaagaaggcgtaaaaatattaaataaagagacttag

SEQ ID NO: 2325 - DNA, 687 bp, Staphylococcus aureus
atgaaagatgtcaaagcactcaagttaatgacattaaatgatgttttaagtcaaatcaatggtgacatgacgctgggaattggtacaggaagtacaatggaattactcttacctcaaatggcgcaactaattaaagaacgtggttacaatattacaggtgtatgcacttctaataaaattgcatttttagcaaaagaattaggtattaaaatatgtgaaatcaatgatgttgatcatatcgacttagcaattgatggtgctgatgaagtagatccatctttaaatataattaaaggtggcggtggtgcgctgttcagagagaaagttatagatgaaatggcatcgcgttttgttgtggttgtcgatgaaacgaaaatagttcaatacttaggtgagacgtttaagttaccagtagaggtggataaatttaactggtatcagatattacgtaaaattgaatcatacgctgatataaaagtagaacgtcgtgtaaacgaagatgtcgcatttataactgataatggcaattatattttagattgtaagttaccaaaaggaattgacccatataagttccatgagtatttaattcatctgacaggtgtgtttgagacaggatacttcttagatatggcagatcaagttattgtaggcactcaagagggtgttaaaattttagaaaaataa

SEQ ID NO: 2326 - DNA, 687 bp, Staphylococcus aureus
atgaaagatgtcaaagcactcaagttaatgacattaaatgatgttttaagtcaaatcaatggtgacatgacgctgggaattggtacaggaagtacaatggaattactcttacctcaaatggcgcaactaattaaagaacgtggttacaatattacaggtgtatgcacttctaataaaattgcatttttagcaaaagaattaggtattaaaatatgtgaaatcaatgatgttgatcatatcgacttagcaattgatggtgctgatgaagtagatccatctttaaatataattaaaggtggcggtggtgcgctgttcagagagaaagttatagatgaaatggcatcgcgttttgttgtggttgtcgatgaaacgaaaatagttcaatacttaggtgagacgtttaagttaccagtagaggtggataaatttaactggtatcacatattacgtaaaattgaatcatacgctgatataaaagtagaacgtcgtgtaaacgaagatgtcgcatttataactgataatggcaattatattttagattgtaagttaccaaaaggaattgacccatataagttccatgagtatttaattcatctgacaggtgtgtttgagacaggatacttcttagatatggcagatcaagttattgtaggcactcaagagggtgttaaaattttagaaaaataa

SEQ ID NO: 2327 - DNA, 687 bp, Staphylococcus aureus
atgaaagatgtcaaagcactcaagttaatgacattaaatgatgttttaagtcaaatcaatggtgacatgacgctgggaattggtacaggaagtacaatggaattactcttacctcaaatggcgcaactaattaaagaacgtggttacaatattacaggtgtatgcacttctaataaaattgcatttttagcaaaagaactaggtattaaaatatgcgaaatcaatgatgttgatcatatcgacttagcaattgatggtgctgatgaagtagatccatctttaaatataattaaaggtggtggtggtgcgctgttcagagagaaagtgatagatgaaatggcatcacgttttgttgtggttgtcgatgaaacgaaaatggttcaatacttaggtgagacgtttaagttaccagtagaggtggataaatttaactggtatcacatattacgtaaaattgaatcatacgctgatataaaagtagaacgccgtgtaaacgaagatgtcgcatttataactgataatggcaattatattttagattgtaagttaccaaaaggaattgacccatataagttccatgagtatttaattcatctgacaggtgtgtttgagacaggctacttcttagatatggcagatcaagttattgtaggtactcaagagggcgttaaaattttagaaaaataa

SEQ ID NO: 2328 - DNA, 687 bp, Staphylococcus aureus
atgaaagatgtcaaagcactcaagttaatgacattaaatgatgttttaagtcaaatcaatggtgacatgacgctgggaattggtacaggaagtacaatggaattactcttacctcaaatggcgcaactaattaaagaacgtggttacaatattacaggtgtatgcacttctaataaaattgcatttttagcaaaagaattaggtattaaaatatgtgaaatcaatgatgttgctcatatcgacttagcaattgatggtgctgatgaagtagatccatctttaaatataattaaaggtggcggtggtgcgctgttcagagagaaagttatagatgaaatggcatcgcgttttgttgtggttgtcgatgaaacgaaaatggttcaatacttaggtgagacgtttaagttaccagtagaggtggataaatttaactggtatcacatattacgtaaaattgaatcatacgctgatataaaagtagaacgtcgtgtaaacgaagatgtcgcatttataactgataatggcaattatattttagattgtaagttaccaaaaggaattgacccatataagttccatgagtatttaattcatctgacaggtgtgtttgagacaggatacttcttagatatggcagatcaagttattgtaggcactcaagagggtgttaaaattttagaaaaataa

SEQ ID NO: 2329 - DNA, 690 bp, Staphylococcus hominis
atgaaggatgcgaaagaactcaaattaatgacgacagatgatgcagtggctcaaattcaagataatatgattcttggaattggaacaggaagtacaattgaactattgatccctaagattgcagagcgtattcaacaagataatttaaatgttacaggtgtatgtacatctaataaaagtgaatttcttgctaaacaatataatattaatgtggttgatattaatgatattacttatataaatttagctattgatggtgcagatgaaattgattcagatttaaaccttattaaaggaggcggaggtgccttattcagagagaaagtcattgatgaaatggcaagaaaatttatcgttttagcagacgaaagtaaaatggtaaattacttaggtgaaaccttcaaattacctattgaagttgataaatttaactggttacttgtatctaaaaaaattgaagcatatcatgatatctcagtcgaacgaagaatgaatgaggatataccatttattacagataatggaaattatattttagactgtgaattaaaaagtaagatagatccttatcaattacatgaatttttaattcatctcacaggtgtgctagaaacaggttattttttagatatgacaacacaagcgattattggcactcaagaaggaattaaagtaattaataagaagtaa

SEQ ID NO: 2330 - DNA, 693 bp, Staphylococcus haemolyticus
atgaaagattctaaagaacttaaaatcatgacagtagatgatgctgtagctcaaattgaagataatatggtgctaggaattggaacgggtagtaccattgaattgcttattccaaagctcgctgaaagaattcacaaagaacaattaaatatcactggcgtgtgtacttctaataaaagtgcatttattgcaaaaaaactagatattaatgttgttgatatcaatgatgttggtcatgttgatttagcaatcgatggcgctgatgaagtggatgttaatatcaatttaattaaaggcggtggtggagcactatttcgcgaaaaagtaatagatgaaatggctcatcgttttgtagttttagcagatgaaagcaagctcgtaaattacttaggtgaaagttttaaactgccagtagaggtggataagttcaattggttccatatcgctaaaaaaattgaagcttttgatgatattattacagagcgtcgaatgagtgatgatgttccatttataacggataatggcaattacattttagattgtcagttaaataaacagattgatccatatcaatttcatgagtatttaattcatctaacaggtgtcttagaaactggatattttttaaatataacagatcaagttatagtaggtacacaagatggcgttaaaatcataaacaaatctaactaa

SEQ ID NO: 2331 - DNA, 684 bp, Staphylococcus carnosus
atggatataaaagagttgaaattaaaaactgttgatgatgcagtaacagaaattaaggatggtatgattgtaggcataggcacaggcagtacaattgaactattattacctaaaattgcagcattattgaatgacggcactcaaattacaggtgtgtgtacttcaaataaaactgcattaattgctaaggaactcggaatcaaaatcgttgatgtgaatgatgtagattatatcgatgtcgcaattgacggtgctgatgagttcgactctgatttaaatttaattaaaggcggaggcggcgcattattccgtgagaaagtcattgatgatatggcagaacggtttgttgtgattgctgatgaaactaagttcgttgattaccttggacaaacatttaaattaccagtagaagtagacaaattcaattggttgctcgtatcgaaaaaaatcacaaaagatacacaagcggttgtttcacgcagaaacgttgaagatattccatttgttactgataacggtaattatattttagatgtagaactgctaccgcatacaaatccttatgaaatgcatgaatacttaattcatttaacaggtgtgttagaaacaggttatttccttgatgttactgatcgtgtcattgtcggcacaaaagagggcgttaaaattctagataaagaataa

SEQ ID NO: 2332 - DNA, 699 bp, Staphylococcus saprophyticus
atggataagaaacagttaaaaatgagtacatttaatgatgcattagaccagattaaagatggtatgattgttggtattggctctggatcaacgattgaattgcttgtcccaaaaatagcagagaaactggaacaagaacaaataaaaatcacaggtgtctgtacctctaataaaacggcatttatagccaaagagttaggtatccatatcattgatgtgaatgatgtggatcatatcgatattgcaatagatggcgcagatgaaattgataacgacttaaacttaattaaaggcggtggaggcgcgctatttagagaaaaagtaatagatgccatggccgaaagatttgttgtcttagctgacgatagtaaatgtgtagactatcttggacaaacgtttaagttgcctgttgaagtggacaaatttaattggttacttgtagctaaacgaattaaagcatatgatgaattaaaagtaacacgtagaatggttgatgatgtgccatttattacagataacggtaattatatcttagatgttgtattaaatgaaggtatcaacgcagcaggtatgcatgaatttttgattcaccttatcggtgtactagaaacaggttattttttaaatgttgcagaccaagccattattggtacaacgaatggagtaaagattaaaaataaagcatcattgatagattaa

SEQ ID NO: 2333 - DNA, 699 bp, Sorangium cellulosum
atgagcaccgcgggaccggacccctccgacctcgatcgaatcgccaacgccgcgctcgcgcgcgtggagagcgggatgctgctcgggctcggcaccgggcgggcgtccgaggccttcatccgccgcctcggggagcgcgtccgccgagggctccagatcaagggcgtcgccacgtcggagcgctcggaggcgctcgcccgccgcgagaacatcccgacggtgtcgctcgaggaggtcgagcgcctccacgtcgccgtcgacggcgccgacgaggtgacgcccgatctcggcctcatcaagggcctcggcggcgcgctcctccgcgagcgcgtggtcgcctacgaggccgcgcagttcatcatcctcgtcacccccgagaagctcgtcgagaagctcggctcgcgcgtgcccatccccatcgaggtggtgcccttcgcggtcacgacggccacgcggcacctgaccgcgctcggaggcaagccggcgatccgcaagaacgcggacgggtatcccttccagaccgacaaccacaactggatcctcgacaccgcgttcggtccgatggacgcgcccgcagcggtcgacgcgcgcatccgcagcatccccggcgtcgtcgacacggggctgttcctcgacatggcgaccctcgtgctggtggcggacccgggcgccgtccgcgagctgacgcggcagcgctag

SEQ ID NO: 2334 - DNA, 693 bp, Gemmata obscuriglobus
atgtccgcgggcactcccgacaccgacgccatcgccgcgaaggcggtcgaactcgttcagcccgacaccgtggtcggtctgggtacggggcgcgccgcgaccgcgttcattcaggcgctcggggccaaagtgcaggccgggctccgcatccgcgggttgcccacctcggaagtctccgccgaactcgccaccaaactgggcatccccctcgtgaccttcgatgacgtgccgtacatcgacgtgtgcgtggacggcgccgacgaagtcgacccgaacggcgacctcatcaagggctacggcggcgccctcgtgcgcgagaaggtcgttgcggcctacgcccgcacgttcgttgtgctcgcgggcggcgaaaaggttgtcaaggtgctcggcgaacgtggcaagcttcccgttgaagtcgtgacgttcgcactgaccccgtgccgcaagcgtctcgaaacgctgggtctcccgtccgcgctgcggatgaaagacgggaaaccattcgtcaccgataacgggaactacatcctcgactgccgcaccaccgccatcacggcccccgccgacacggaggcgcaaattctcgcgatccccggcgtcgtcgggacgggcatcttcgcgaagatggcccacaccatcatgattcaaggcaccgatgggagcgttgaagtgcgtgcgggtagcgcgaaataa

SEQ ID NO: 2335 - DNA, 675 bp, Listeria monocytogenes
atgattaatcaaaagaagattgcaggagaaaaggcttgtgaatggattaaagatggaatggttgtgggtcttggaacgggcagtacagtttattacacgattgaaaagcttggagaaatggtaaataacggtttgcacattacaggggtagcgacttctgaagaaacaaacaaacaagcacaaaatttaggaatacctttgaaatcgctaaatgacgttacggaaatagatattactattgatggtgcagatgaaattgatacggattttcaaggaataaagggtggaggaggagcactgttacgcgaaaaaatggtagcaagtgcgagtttgaaaaacatttgggttgtcagtgaggagaagcttgtaagaaacttagggaagtttcctttacctttagaagtaataccttttggttggaagcaggttgagagaaaacttgaaaaagagcatattcaaacaaatttacggaaacaatcttcaggagaagtctatgtgacaaataacgggaactatattttggatatagtaaatcaaacttttacggatgcagaaatgtggcaagaaaaattagcgcaaatcccagggattgtggagcatggattatttcttcattatgtggatataattatttgtgcgaaggcgaatggcgaaattgaactaataaaaaaatag

SEQ ID NO: 2336 - DNA, 675 bp, Listeria monocytogenes
atgattaatcaaaagaagattgcaggagaaaaggcttgtgaatggattaaagatggaatggttgtgggtcttggaacgggcagtacagtttattacacgattgaaaagcttggagaaatggtaaataacggtttgcacattacaggggtagcgacttctgaagaaacaaacaaacaagcacaaaatttaggaatacctttgaaatcgctaaatgacgttacggaaatagatattactattgatggtgcagatgaaattgatacggtttttcaaggaataaagggtggaggaggagcactgttacgcgaaaaaatggtagcaagtgcgagtttgaaaaacatttgggttgtcagtgaggagaagcttgtaagaaacttagggaagtttcctttacctttagaagtaataccttttggttggaagcaggttgagagaaaacttgaaaaagagcatattcaaacaaatttacggaaacaatcttcaggagaagtctatgtgacaaataacgggaactatattttggatatagtaaatcaaacttttacggatgcagaaatgtggcaagaaaaattagcgcaaattccagggattgtggagcatggattatttcttcattatgtggatataattatttgtgcgaaggcgaatggcgaaattgaactaataaaaaaatag

SEQ ID NO: 2337 - DNA, 675 bp, Listeria monocytogenes
atgattaatcaaaagaagatagcaggagaaaaggcttgtgagtggattaaagatggaatggttgtgggccttggaacgggcagtacagtctattacacgattgaaaagcttggagaaatggtaaataatggtttgcatattacaggggtggcaacttctgaagaaacaagcaaacaagcacaaaatttaggaatacctttgaaatcgctaaatgacgtagcggaaatagatattactattgatggtgctgatgaaattgatacggattttcaaggaataaaaggtggaggaggagcactattacgtgaaaaaatggtagcaagtgcgagtttgaaaaacatttgggttgtcagtgaggagaagcttgtaagaaacttagggaagtttcctttgcctatagaagtaataccttttggttggaagcaaattgagagaacacttgaaaaagagcatgttcaaacaattttacggagacaatcttcaggagaaatctatgtgacaaataacgggaactatattttggatatagtaaatcaaacttttagggatgcagaaatgtggcaagaaaaattagcgcaaattccagggattgtggagcatggattatttcttcattatgtggatataattgtttgtgcgaaggcaaatggcgaaatagagctaataaaaaaatag

SEQ ID NO: 2338 - DNA, 675 bp, Listeria monocytogenes
atgattaatcaaaagaagatagcaggagaaaaggcttgtgagtggattaaagatggaatggttgtgggccttggaacgggcagtacagtctattacacgattgaaaagcttggagaaatggtaaataatggtttgcatattacaggggtggcaacttctgaagaaacaagcaaacaagcacaaaatttaggaatacctttgaaatcgctaaatgacgtagcggaaatagatattactattgatggtgctgatgaaattgatacggattttcaaggaataaaaggtggaggaggagcactattacgtgaaaaaatggtagcaagtgcgagtttgaaaaacatttgggttgtcagtgaggagaagcttgtaagaaacttagggaagtttcctttgcctatagaagtaataccttttggttggaagcaaattgagagaacacttgaaaaagagcatattcaaacaattttacggagacaatcttcaggagaaatctatgtgacaaataacgggaactatattttggatatagtaaatcaaacttttagggatgcagaaatgtggcaagaaaaattagcgcaaattccagggattgtggagcatggattatttcttcattatgtggatataattgtttgtgcgaaggcaaatggcgaaatagagctaataaaaaaatag

SEQ ID NO: 2339 - DNA, 675 bp, Listeria monocytogenes
atgattaatcaaaagaagatagcaggagaaaaggcttgtgagtggattaaagatggaatggttgtgggccttggaacgggcagtacagtctattacacgattgaaaagcttggagaaatggtaaataatggtttgcatattacaggggtggcaacttctgaagaaacaagcaaacaagcacaaaatttaggaatacctttgaaatcgctaaatgacgtagcggaaatagatattactattgatggtgctgatgaaattgatacggattttcaaggaataaaaggtggaggaggagcactattacgtgaaaaaatggtagcaagtgcgagtttgaaaaacatttgggttgtcagtgaggagaagcttgtaagaaacttagggaactttcctttgcctatagaagtaataccttttggttggaagcaaattgagagaacacttgaaaaagagcatattcaaacaattttacggagacaatcttcaggagaaatctatgtgacaaataacgggaactatattttggatatagtaaatcaaacttttagggatgcagaaatgtggcaagaaaaattagcgcaaattccagggattgtggagcatggattatttcttcgttatgtggatataattgtttgtgcgaaggaaaatggcgaaatagagctaataaaaaaatag

SEQ ID NO: 2340 - DNA, 672 bp, Listeria monocytogenes
atgaatcaaaagaaacttgccggagaaaaagcttgcgaatggattgaagatggaatggttgtcgggcttggaacaggtagcacggtttattacacgattgaaaagcttggacaaatggtaaataatggcttgcatattacgggagtggcgacttctgatgaaacaaccaaacaagccgaaaagttaggaatccctttgaaagcgctaaatgatgtaacggaaattgatgtcactattgatggagcagatgaaattgatacgaattttcaaggaataaaaggtggagggggagcattattacgcgaaaaaatggttgctagtgcgagtttgaaaaatatttgggttgttggtgaagagaaacttgtaaggacgctagggaagtttcctttaccattagaagtaattccttttggttggaagcaaattgagcgcacacttgcaaaagaacaaatacaaactaatttacggaaacaatctaatggggaagtctatgtgacaaataatgggaactatattttggatatagtaaatcagtcatttacggatgcggaaatgtggcaagaaaaattagcgcaaataccaggggttgttgagcatgggttatttcttgattatgtggatgtaattatttgtggaaaggcgaacggggaaacggagataataaaaaaatag

SEQ ID NO: 2341 - DNA, 672 bp, Listeria monocytogenes
atgaatcaaaagaaaattgccggagaaaaagcttgcgaatggattgaagatggaatggttgtcgggcttggaacaggtagcacggtttattacacgcttgaaaagcttggacaaatggtaaataatggcttgcatattacgggagtggcgacttctgatgaaacaaccaaacaagccgaaaagttaggaatccctttgaaatcgctaaatgatgtaacggaaattgatgtcactattgatggagcagatgaaattgatacgaattttcaaggaataaaaggcggagggggagcattattacgcgaaaaaatggttgctagtgcgagtttgaaaaatatttgggttgttagtgaagagaaacttgtaaggacgctagggaagtttcctttaccattagaagtaattccttttggttggaagcaaattgagcgcacacttgcaaaagaacaaatacaaactaatttacggaaacaatctaacggggaagtctatgtgacaaataatgggaactatattttggacatagtaaatcagtcatttacggatgcggaaatgtggcaagaaaagttagcgcaaataccaggggttgttgagcatgggttatttcttgattatgtggatgtaattatttgtggaaaggcgaacggggaaacggagataataaaaaaatag

SEQ ID NO: 2342 - DNA, 672 bp, Listeria monocytogenes
atgaatcaaaagaaaattgccggagaaaaagcttgcgaatggattgaagatggaatggttgtcgggcttggaacaggtagcacggtttattacacgattgaaaagcttggacaaatggtaaataatggcttgcatattacgggagtggcgacttctgaagaaacaaccaaacaagccgaaaagttaggaatccctttgaaatcgctaaatgatgtaacagaaattgatgtcaccattgatggagcagatgaaattgatgcgaattttcaaggaataaaaggcggagggggagcattattacgcgaaaaaatggttgctagtgcaagtttgaaaaatatttgggttgttagtgaagaaaaacttgtaaggacgctagggaagtttcctttaccagtagaagtaattccttttgggtggaaacaaattgagcgcatacttgcaaaagaacacatacaaactaatttacgaaaacaatcttctggagaagtatatgtgacaaataatgggaactatattttggacatagtaaatcagtcatttacggatgcgaaaatgtggcaagaaaaattagcacaaataccaggggttgtagagcatgggctatttcttgattatgtggatgtaattatttgtggaaaggcaaacggagaaacggagataataaaaaaatag

SEQ ID NO: 2343 - DNA, 618 bp, Listeria monocytogenes
atggttgtgggccttggaacgggcagtacagtctattacacgattgaaaagcttggagaaatggtaaataatggtttgcatattacaggggtggcaacttctgaagaaacaagcaaacaagcacaaaatttaggaatacctttgaaatcgctaaatgacgtagcggaaatagatattactattgatggtgctgatgaaattgatacggattttcaaggaataaaaggtggaggaggagcactattacgtgaaaaaatggtagcaagtgcgagtttgaaaaacatttgggttgtcagtgaggagaagcttgtaagaaacttagggaagtttcctttgcctatagaagtaataccttttggttggaagcaaattgagagaacacttgaaaaagagcatgttcaaacaattttacggagacaatcttcaggagaaatctatgtgacaaataacgggaactatattttggatatagtaaatcaaacttttagggatgcagaaatgtggcaagaaaaattagcgcaaattccagggattgtggagcatggattatttcttcattatgtggatataattgtttgtgcgaaggcaaatggcgaaatagagctaataaaaaaatag

SEQ ID NO: 2344 - DNA, 675 bp, Listeria innocua
atgattaatcaaaagaaaatcgcaggtgaaaaagcgtgtgaatggattgaagatggaatggttgtcggtcttggaacgggaagtaccgtttattatacgattgaaaaattaggggaaatggtgcaaaaaggcttaaacattactggggtgtctacttctatagaaacagaacaacaagctcggacattagggattccgctaaaatctttaaatgatgtaacgaaaattgatgtcacaattgatggcgctgatgaaattaatcaagcttttcaaggaataaaagggggcggaggagcacttttacgagaaaagatggttgctcaagctagttcaaagaatatttgggttgttggggaagagaagcttgtgacagagcttggaaaatttcctttgccacttgaagtgattccttttggatggaagcaaattaaacgaatgctagaaaatgacggggttgaaactactttacgcaaacagtcgtcaggagaaatatatgaaacaaataacggcaattatattttagatattataaatcagacctttactaatccagaagcctggcatgaaaagttagcgggcattcctggggtacttgagcacggcttatttcttcattatgtagatataattatttgcggcaaagcatcaggagaaatagagataataaaaaaatag

SEQ ID NO: 2345 - DNA, 672 bp, Listeria welshimeri
gtgaatcagaagaaaattgcaggagaaaaagcatgtggatgggtgaaagatggaatggttgtcggacttggaacagggagtactgtttactatacaatcgaaaaattaggagaaatggtacgtgacggtctcaatattactggaattgctacatctgaagaaactgcaatacaagctaaaaaactgggcatcccattaaaatctttaaatgatgtaaagcaaatagatgtcacaattgatggagcagatgaagtgaacaaagattttcaagggataaaaggtggaggaggagcgcttttacgcgaaaaaatggtagcagcagctagcttgatgaatatttgggtagtggaagaaaagaaattagtggaagaacttggcgaattttcacttccaatagaagtaattccatttggctggaaacaaattaagtggagtcttgaaaaagaagcaattgaaacagaattacgaaaaaatgattcaggaaaagtgtatcagacaaataatggaaattatattttggacattaaaaatcaaattttgacgaatccagtagaatggcaagaaaaactagcggggattcctggaattgtcgagcatggattgtttttagattatgtggatatagttatttgtggaaaagcaaatggagaagcaatagtaataaaaaaatag

SEQ ID NO: 2346 - DNA, 696 bp, Listeria grayi
atggaggcgttaggtatgaacgcaaaacaattggcaggcgaaaaagcagcagaatgggtcgaggacggaatgacgatcggtctcggaacaggtagtacggtctattatacgatcgagaaaatcggtgaaatggtcaaaaacgggttgcagatcgttggtgtaccaacatcagaacgaacacgcattcaagcagaaggattgggcattccattaacaagtttaaatgaagtagaaaaaatcgacttaacgatcgacggttctgatgaagtagatgcttcattccgtggcatcaaaggcggtgggggagcattgctgcgcgaaaaaatggttgcagatatctcagatacgaatatttgggtcgtaagcagtaacaaacgtgtggatgtattaggtaaattcccacttccaatcgaagtcattccttttggctataagcaagtcgcaaataaattacaaaaacgcagtgctgacgcaagactgcgcaagacagaagacggagacatttatgtcacggataacggcaactatattttagatgtctatgaccaagcatttacagacccagcagaatggcaagattggctgcaaaaggttcctggcattgtcgagcaaggttttttccttgggatcgtggatatcgtgatcgcagcaagtgaaagcggcgaaattgaactgtttgaaagtgagaagagctga

SEQ ID NO: 2347 - DNA, 687 bp, Bacillus coagulans
atggacgggaaaaagatggccggggagaaagcagcggaactcgtagaagatggaatgattgtcgggcttgggaccggctcaactgtttattacacgataaaaaaattaggggaacgggtgcaaagcggcctgcacatcaccggtgtgcccacctcgcgtgcgacagaaaaacttgcgcgcgaatgcggcattccgatagcagacttgaacgacacggcacaaatggatgtgaccattgacggggccgatgaagtggacccttccttaaatggcattaaaggcggcggcggggcgttgttgtttgaaaagctggtggcaaaggcatcaaaaagaaatatctgggtggtggattcccggaaaatggttcaacaacttggcgcttttccgctgccggtggaagtggtcccgttcggatacaagcatttgatgaaaacgtttgagcgggaaggattaaaccctgtcctccggatgaaagaaggccggccgtatgtaacagacggcggccactatatcgtggatataaagctcaaatcgcctgatatcggcgcgtttggagcctggcttgatggttacacaggtgttgttgaacacgggctttttctcggcatttgcgatcttgttgtcatcggggacggcagcaaggtatataccaagaaccgggcggaggcaaagaatattattttgtga

SEQ ID NO: 2348 - DNA, 681 bp, Granulicatella elegans ATCC 700633
atgcgtgtgaacatgaaagagatggtcggcaaacaggccgcaacttatattgaatcaggtatgacagtaggtctaggaacaggttctacagcttattattttgtagaagaaattggtagacgtgtgaaagaagaaggtttagacattattggtgtaacaacttcaaaacgtacaaaagaacaagctgaaaagttaggaattccattgaagagtgtagacgaagtagatttcattgatgtaacagttgatggagcagatgaaattgctcctgatttttcaggaattaaaggaggcggtggagccttactatttgaaaaaattgttgcagaacaatcaaagcgtattatttggattgtcgatgaatctaaaatggtagattatttaggacgcttcccacttccggtagaagtgattccgtatggttcagaacaattattcaaaaaatttgaagcaaaaggctatcgtccaaaattccgagtattagaaaacggagaacgttatttaacagatagtcaaaattatattattgacttagatgtattcccgattaaagatcctgtgacattcggagcagaattaaaagctctaacaggagtagtggaacaaggattgtttacaaatatgacagaaacagttttaattggaacaccggatggtgtcaaagtgcaaactttaggataa

SEQ ID NO: 2349 - DNA, 669 bp, Granulicatella adiacens ATCC 49175
atgaacatgaaagaattagtcggcaagaaagccgcagaatatgtagaaagtggaatgacggttggattaggaactggttcgacagcttactattttgtggaagaaatcggtcgacgagtaaaagaagaagggcttgaaattgttggagtaacaacttctttagcaacgaagaaacaagcagaagcacttggaattccattgaagagcgtggatgaagtggattatatcgacgtcacaatcgatggtgcagacgaaatcgctcctgatttttcaggaatcaaaggcggtggcggtgcgttattattcgaaaaaatcgttgccgagcaatcaaagagcgtaatctggattgtagacgaatcaaaaatggtcgactatttaggtcgtttcccattaccagtggaagtggtgccttatggttcgcttcaattattcaaacgttttgaagcgctaggatacaaaccaacgttccgcgaacgtgacggagaacgctacttaacggatagcaaaaactacattatcgacttggatgtgtatccaattaaagacccaattgcattcggagaaaaaatcaaaggcatgacaggtgtggtagagcaaggcctcttcacaaacatgaccgatatcgtgcttgtaggaactcctgatggggttgtcgtaaaacaattctaa

SEQ ID NO: 2350 - DNA, 684 bp, Enterococcus faecium
atgaatttaaaacaattagctggcattgaagccgcgaaattcgtaaaggacgggatgatcgtaggtctcgggaccggttcaaccgcctattatatggtagaagagattggtcgccgtatgcgtgaagaaggtttacgtatcacaggagttactacttcaaatgcgacaaaagaacaagcggaaaaattaggaataccgttaaagagtattgatgaagtccccgtagtcgatttgacaatagacggtgctgatgaaatcagtgctgattttcaagggatcaaaggcggcggcgctgctttgcttttcgagaaaatagtcgctacgtactcaaaagaaacgatttggatcgttgattcttctaaattagtcgataaacttgggaagttcccactcccagttgaagtgatcccttatggatcccaacagctacttcatatttttgaagaaaaaggattccaacctgtcttgcgtacagacgaaaacggagaagtcctaaccacagatggtggtcattacatcattgatctgcatctagaagtcatcgaacagccagaaagcttagctacctatttagatgaacttgttggggtagtagaacatgggcttttcctaaacatggtttctaaagtagttgtcggctcagaaaaaggcgttgagattcttgacgcaatccgtcgtaaataa

SEQ ID NO: 2351 - DNA, 684 bp, Enterococcus faecium
atgaatttaaaacaattagctggcattgaagccgcgaaattcgtaaaggacgggatgatcgtaggtctcgggaccggttcaaccgcctattatatggtagaagagattggtcgccgtatgcgtgaagaaggtttacgtatcacaggagttactacttcaaatgcgacaaaagaacaagcggaaaaattaggaataccgttaaagagtattgatgaagtccccgtagtcgatttgacaatagacggtgctgatgaaatcagtgctgattttcaagggatcaaaggcggcggcgctgctttgcttttcgagaaaatagtcgctacgtactcaaaagaaacgatttggatcgttgattcttctaaattagtcgataaacttgggaagttcccactcccagttgaagtgatcccttatggctcccaacagctacttcatatttttgaagaaaaaagattccaacccgtcttgcgtacagacgaaaacggagaagtcttaaccacagatggtggtcattacatcattgatctgcatctagaagtcatcgaacagccagaaagcttagctacctatttagatgaacttgttggggtagtagaacatgggcttttcctaaacatggtttctaaagtagttgtcggctcagaaaaaggcgttgagattcttgacgcaatccgtcgtaaataa

SEQ ID NO: 2352 - DNA, 684 bp, Enterococcus faecium
atgaatttaaaacaattagctggcattgaagccgcgaaattcgtaaaggacgggatgatcgtaggtctcgggaccggttcaaccgcctattatatggtagaagagattggtcgccgtatgcgtgaagaaggtttacgtatcacaggagttactacttcaaatgcgacaaaagaacaagcggaaaaattaggaataccgttaaagagtattgatgaagtccccgtagtcgatttgacaatagacggtgctgatgaaatcagtgctgattttcaagggatcaaaggcggcggcgctgctttgcttttcgagaaaatagtcgctacgtactcaaaaaaaacgatttggatcgttgattcttctaaattagtcgataaacttgggaagttcccactcccagttgaagtgatcccttatggctcccaacagctacttcatatttttgaagaaaaaggattccaacctgtcttgcgtacagacgaaaacggagaagtcctaaccacagatggtggtcattacatcattgatctgcatctagaagtcatcgaacagccagaaagcttagctacctatttagatgaacttgttggggtagtagaacatgggcttttcctaaacatggtttctaaagtagttgtcggctcagaaaaaggcgttgagattcttgacgcaatccgtcgtaaataa

SEQ ID NO: 2353 - DNA, 684 bp, Enterococcus faecium
atgaatttaaaacaattagctggcattgaagccgcgaaattcgtaaaggacgggatgatcgttggtctcgggaccggttcaaccgcctattatatggtagaagagattggtcgccgcatgcgtgaagaaggattacgtatcacaggagtcactacttcaaatgcgacaaaagaacaagcggaaaaattaggaataccgctaaagagtatcgacgaagtcccagtagtcgatctgacgatagatggtgctgatgaaatcagtgctgattttcaaggaataaaaggcggcggtgctgctttgcttttcgagaaaatagttgctacgtactcaaaagaaacgatttggatcgttgattcttctaaattagtccataaactcgggaagttcccactcccagttgaagtcatcccttatggctcccaacagctacttcatatttttgacgaaaaaggattccaacctgttttgcgtacagacgaaaacggcgaagtcctaaccacagatggtggtcattatatcattgatctgcatctagaagttattgaacaaccagaaagtttagctacctatttagatgaacttgttggggtagtcgaacatggacttttcctaaatatggtttcaaaagttgttgttggctcagaaaaaggtgttgagattcttgatgccatccgccataaataa

SEQ ID NO: 2354 - DNA, 696 bp, Enterococcus faecium
gtggatgcaaagatgaatttaaaacaattagctggcattgaagccgcgaaattcgtaaaggacgggatgatcgttggtctcgggaccggttcaaccgcctattatatggtagaagagattggtcgccgcatgcgtgaagaaggattacgtatcacaggagtcactacttcaaatgcgacaaaagaacaagcggaaaaattaggaataccgctaaagagtatcgacgaagtcccagtagtcgatctgacgatagatggtgctgatgaaatcagtgctgattttcaaggaataaaaggcggcggtgctgctttgcttttcgagaaaatagtcgctacgtactcaaaagaaacgatttggatcgttgattcttctaaattagtccataaactcgggaagttcccactcccagttgaagtcatcccttatggctcccaacagctacttcatatttttgacgaaaaaggattccaacctgttttgcgtacagacgaaaacggcgaagtcctaaccacagatggtggtcattatatcattgatctgcatctagaagttattgaacaaccagaaagtttagctacctatttagatgaacttgttggggtagtcgaacatggacttttcctaaatatggtttcaaaagttgttgttggctcagaaaaaggtgttgagattcttgatgccatccgccataaataa

SEQ ID NO: 2355 - DNA, 681 bp, Enterococcus faecalis
atgaatctgaaacaaatggtaggaatcgaagctgcaaaatatgtagaagacggcatgattgtcggtttgggtactggctcaacagcaaaatttatggtagacgaaattggtcgtcgcgtaaaagaagaaggattgtcaatcgtaggggttactacttcaaaagaaacagagaaacaagccttggccttgggcattcctttaaaaagtattgatgaggttccgtatgtggatcttacgattgatggcgccgatgaaatcagcgctgattttcaaggaatcaaaggcggtggcgctgccttactttttgaaaaaattgtggccacttattcaaagaaatgtatttggattgtggataaatcaaaaatggtggacgatttaggggctttcccgcttccagttgaggttgttccttatggcagccgccaactagtgcatttatttgaagaaaaaggctatcacccaacacttcgtttaaacgctgctggcgaaacattaataacagatggaggccaccatatcatcgatttgcatttagaaaaaattacagatccagaagctttgggttcttatttagacaacttggttggcgtcgttgaacacggcttatttttaaatatggtttctatggtaatcgtcggttatgaagatggaccgaaaaccttacatgttcccgcacgttaa

SEQ ID NO: 2356 - DNA, 681 bp, Enterococcus faecalis
atgaatctgaaacaaatggtaggaatcgaagctgcaaaatatgtagaagacggcatgattgtcggtttgggtactggctcaacagcaaaatttatggtagacgaaattggtcgtcgcgtaaaagaagaaggattgtcaatcgtaggggttactacttcaaaagaaacagagaaacaagccttggccttgggcattcctttaaaaagtattgatgaggttccgtatgtggatcttacgattgatggcgccgatgaaatcagcgctgattttcaaggaatcaaaggcggtggcgctgccttactttttgaaaaaattgtggccacttattcaaagaaatgtatttggattgtggataaatcaaaaatggcggacgatttaggagctttcccacttccagttgaggttgttccttatggcagccgccaattagtgcatttatttgaagaaaaaggctatcacccaacacttcgtttaaacgctgctggcgaaacattaataacagatggaggccaccatatcatcgatttgcatttagaaaaaattacagatccagaagctttaggttcttatttagacaacttggttggcgtcgttgaacacggcttatttttaaatatggtttctatggtaatcgtcggttatgaagatggaccgaaaaccttacatgttcccgcacgttaa

SEQ ID NO: 2357 - DNA, 681 bp, Enterococcus faecalis
atgaatctgaaacaaatggtaggaatcgaagctgcaaaatatgtagaagacggcatgattgtcggtttgggtactggctcaacagcaaaatttatggtagacgaaattggtcgtcgcataaaagaagaaggattgtcaatcgtaggggttactacttcaaaagaaacagagaagcaagccttggccttgggcattcctttaaaaagtattgatgaggttccgtatgtagatcttacgattgatggcgccgatgaaatcagcgctgattttcaaggaatcaaaggcggtggcgctgccttactttttgaaaaaattgtggccacttattcaaagaaatgtatttggattgtggataaatcaaaaatggtggacgatttaggggctttcccgcttccagttgaggttgttccttatggcagccgccaactagtgcatttatttgaagaaaaaggctatcacccaacacttcgtttaaacgctgctggcgaaacattaataacagatggaggccaccatatcatcgatttgcatttagaaaaaattacagatccagaagctttgggttcttatttagacaacttggttggcgtcgttgaacacggcttatttttaaatatggtttctatggtaatcgtcggttatgaagatggaccgaaaaccttacatgttcccgcacgttaa

SEQ ID NO: 2358 - DNA, 681 bp, Enterococcus faecalis
atgaatctgaaacaaatggtaggaatcgaagctgcaaaatatgtagaagaaggcatgattgtcggtttgggtactggctcaacagcaaaatttatggtagacgaaattggtcgtcgcgtaaaagaagaaggattgtcaatcgtaggggttactacttcaaaagaaacagagaaacaagccttggccttgggcattcctttaaaaagtattgatgaggttccgtatgtggatcttacgattgatggcgccgatgaaatcagcgctgattttcaaggaatcaaaggcggtggcgctgccttactttttgaaaaaattgtggccacttattcaaagaaatgtatttggattgtggataaatcaaaaatggtggacgatttaggagctttcccgcttccagttgaggttgttccttatggcagccgccaactagtgcatttatttgaagaaaaaggctatcacccaacacttcgtttaaacgctgctggcgaaacattaataacagatggaggccaccatatcatcgatttgcatttagaaaaaattacagatccagaagctttaggttcttatttagacaacttggttggcgtcgttgaacacggcttatttttaaatatggtttctatggtaatcgtcggttatgaagatggaccgaaaaccttacatgttcccgcacgttaa

SEQ ID NO: 2359 - DNA, 681 bp, Enterococcus faecalis
atgaatctgaaacaaatggtaggaatcgaagctgcaaaatatgtagaagacggcatgattgtcggtttgggtactggctcaacagcaaaatttatggtagacgaaattggtcgtcgcgtaaaagaagaaggattgtcaatcgtaggggttactacttcaaaagaaacagagaaacaagccttggccttgggcattcctttaaaaagtattgatgaggttccgtatgtagatcttacgattgatggcgccgatgaaatcagcgctgattttcaaggaatcaaaggcggtggcgctgccttactttttgaaaaaattgtggccacttattcaaagaaatgtatttggattgtggataaatcaaaaatggtggacgatttaggggctttcccacttcctgttgaggttgtcccttatggcagctgccaactagtgcatttatttgaagaaaaaggctatcacccagcacttcgtctaaacgctgctggcgaaacattaataacagatggaggccaccatatcatcgatttgcatttagaaaaaattacagatccagaagctttaggttcttatttagacaacttggttggcgtcgttgaacacggcttatttttaaatatggtttctatggtaatcgtcggttatgaagatggaccgaaaaccttacatgttcccgcacgttaa

SEQ ID NO: 2360 - DNA, 681 bp, Enterococcus faecalis
atgaatctgaaacaaatggtaggaatcgaagctgcaaaatatgtagaagacggcatgattgtcggtttgggtactggctcaacagcaaaatttatggtagacgaaattggtcgtcgcgtaaaagaagaaggattgtcaatcgtgggggttactacttcaaaagaaacagagaaacaagccttagccttgggcattcctttaaagggtattgatgaggttccgtatgtggatcttacgattgatggcgccgatgaaatcagcgctgattttcaaggaatcaaaggcggtggcgctgccttactttttgaaaaaattgtggccacttattcaaagaaatgtatttggattgtggataaatcaaaaatggtggacgatttaggggctttcccacttcctgttgaggttgtcccttatggcagctgccaactagtgcatttatttgaagaaaaaggctatcacccagcacttcgtctaaacgctgctggcgaaacattaataacagatggaggccaccatatcatcgatttgcatttagaaaaaattacagatccagaagctttaggttcttatttagacaacttggttggcgtcgtcgaacacggcttatttttaaatatggtttctatggtaatcgtcggttatgaagatggaccgaaaaccttacatgttcccgcacgttaa

SEQ ID NO: 2361 - DNA, 681 bp, Enterococcus faecalis
atgaatctgaaacaaatggtaggaatcgaagctgcaaaatatgtagaagacggcatgattgtcggtttgggtactggctcaacagcaaaatttatggtagacgaaattggtcgtcgcgtaaaagaagaaggattgtcaatcgtaggggttactacttcaaaagaaacagagaaacaagccttggccttgggcattcctttaaaaagtattgatgaggttccgtatgtggatcttacgattgatggcgccgatgaaatcagcgctgattttcaaggaatcaaaggcggtggcgctgccttactttttgaaaaaattgtggccacttattcaaagaaatgtatttggattgtggataaatcaaaaatggtggacgatttaggggctttcccacttcctgttgaggttgtcccttatggcagctgccaactagtgcatttatttaaagaaaaaggctatcacccagcacttcgtctaaacgctgctggcgaaacattaataacagatggaggccaccatatcatcgatttgcatttagaaaaaattacagatccagaagctttaggttcttatttagacaacttggttggcgtcgttgaacacggcttatttttaaatatggtttctatggtaatcgtcggttatgaagatggaccgaaaaccttacatgttcccgcacgttaa

SEQ ID NO: 2362 - DNA, 681 bp, Enterococcus faecalis
atgaatctgaaacaaatggtaggaatcgaagctgcaaaatatgtagaagacggcatgattgtcggtttgggtactggctcaacagcaaaatttatggtagacgaaattggtcgtcgcgtaaaagaagaaggattgtcaatcgtgggggttactacttcaaaagaaacagagaaacaagccttggccttgggcattcctttaaaaagtattgatgaggttccgtatgtagatcttacgattgatggcgccgatgaaatcagcgctgattttcaaggaatcaaaggcggtggcgctgccttactttttgaaaaaattgtggccacttattcaaagaaatgtatttggattgtggataaatcaaaaatggtggacgatttaggggctttcccacttccagttgaggttgttccttatggcagccgccaactagtgcatttatttgaagaaaaaggctatcacccagcacttcgtctaaacgctgctggcgaaacattaataacagatggaggccaccatatcatcgatttgcatttagaaaaaattacagatccagaagctttaggttcttatttagacaacttggttggcgtcgttgaacacggcttatttttaaatatggtttctatggtaatcgtcggttatgaagatggaccgaaaaccttacatgttcccgcacgttaa

SEQ ID NO: 2363 - DNA, 675 bp, Enterococcus faecalis
ctgaaacaaatggtaggaatcgaagctgcaaaatatgtagaagacggcatgattgtcggtttgggtactggctcaacagcaaaatttatggtagacgaaattggtcgtcgcataaaagaagaaggattgtcaatcgtaggggttactacttcaaaagaaacagagaagcaagccttggccttgggcattcctttaaaaagtattgatgaggttccgtatgtagatcttacgattgatggcgccgatgaaatcagcgctgattttcaaggaatcaaaggcggtggcgctgccttactttttgaaaaaattgtggccacttattcaaagaaatgtatttggattgtggataaatcaaaaatggtggacgatttaggggctttcccgcttccagttgaggttgttccttatggcagccgccaactagtgcatttatttgaagaaaaaggctatcacccaacacttcgtttaaacgctgctggcgaaacattaataacagatggaggccaccatatcatcgatttgcatttagaaaaaattacagatccagaagctttgggttcttatttagacaacttggttggcgtcgttgaacacggcttatttttaaatatggtttctatggtaatcgtcggttatgaagatggaccgaaaaccttacatgttcccgcacgttaa

SEQ ID NO: 2364 - DNA, 675 bp, Enterococcus faecalis
ctgaaacaaatggtaggaatcgaagctgcaaaatatgtagaagacggtatgattgtcggtttgggtactggctcaacagcaaaatttatggtagacgaaattggtcgtcgcgtaaaagaagaaggattgtcaatcgtaggggttactacttcaaaagaaacagagaaccaagccttggccttgggcattcctttaaaaagtattgatgaggttccgtatgtggatcttacgattgatggcgccgatgaaatcagcgctgattttcaaggaatcaaaggcggtggcgctgccttactttttgaaaaaattgtggccacttattcaaagaaatgtatttggattgtggataaatcaaaaatggtggacgatttaggggctttcccacttccagttgaggttgttccttatggcagccgccaactagtgcatttatttgaagaaaaaggctatcacccaacacttcgtttaaacgctgctggcgaaacattgataacagatggaggccaccatatcatcgatttacatttagaaaaaattacagatccagaagctttaggttcttatttagacaacttggttggcgtcgttgaacacggcttatttttaaatatggtttctatggtaatcgtcggttatgaagatggaccgaaaaccttacatgttcccgcacgttaa

SEQ ID NO: 2365 - DNA, 675 bp, Enterococcus faecalis
ctgaaacaaatggtaggaatcgaagctgcaaaatatgtagaagacggcatgattgtcggtttgggtactggctcaacagcaaaatttatggtagacgaaattggtcgtcgcgtaaaagaagaaggattgtcaatcgtaggggttactacttcaaaagaaacagagaaacaagccttggccttgggcattcctttaaaaagtattgatgaggttccgtatgtgaatcttacgattgatggcgccgatgaaatcagcgctgattttcaaggaatcaaaggcggtggcgctgccttactttttgaaaaaattgtggccacttattcaaagaaatgtatttggattgtggataaatcaaaaatggtggacgatttaggggctttcccacttcctgttgaggttgtcccttatggcagctgccaactagtgcatttatttaaagaaaaaggctatcacccagcacttcgtctaaacgctgctggcgaaacattaataacagatggaggccaccatatcatcgatttgcatttagaaaaaattacagatccagaagctttaggttcttatttagacaacttggttggcgtcgttgaacacggcttatttttaaatatggtttctatggtaatcgtcggttatgaagatggaccgaaaaccttacatgttcccgcacgttaa

SEQ ID NO: 2366 - DNA, 675 bp, Enterococcus casseliflavus
atgaacctaaaagaaatggtcggcattgaagcggctagttatgtaaaagatggcatggtcgttggcttgggcactggctcaacagcctactacatgattgaagaactgggtcgacgtgtaaaagaagaaggtctatcgatcacgggtgtcccaacttcttgggcatcgaaaaaacaagcagaaggattaggtatcccgattcgcaccatcgatgaagtggacgctgtggatctaacgatcgacggtgcagatgagatcagccaggattatcatggcatcaaaggcggcggtgcagcccttttattcgaaaaaatcgtggcgtctaactccaaaaaagtcttgtggatcgttgatgaatcgaaaatggtcgaaacacttggtgccttcccgttgccagtggaagtgatcccttatggcagccaacagctgttgcgtctgttcgagaagaaaaactaccatccaaaactgcgtctgaatgaagaaggcgaaccgttaaaaaccgattgtagcaattacatcatcgatcttcatctagaaacgatcaccgcccctactgagttggcacaggaattagatgctacagtgggcgtggttgaacacggtctgtttttggatatggtccacacgatcattgtcggattgcctgaaggcccgagtaccaagcacgttagataa

SEQ ID NO: 2367 - DNA, 675 bp, Enterococcus casseliflavus
atgaacctaaaagaaatggtcggcattgaagcggctagttatgtaaaagatggcatggtggttggcttgggcactggctcaacagcctactacatgattgaagaactgggtcgacgtgtaaaagaagaaggtctatcgatcacgggtgtcccaacttcttgggcatcgaaaaaacaagcagaaggattaggtatcccgattcgcaccatcgatgaagtggacgctgtggatctaacgatcgacggtgcagatgagatcagcaaggattatcatggcatcaaaggcggcggtgcagcccttttattcgaaaaaatcgtggcgtctaactcaaaaaaagtcttgtggatcgttgatgaatcgaaaatggtcgaaacacttggtgccttcccgttgccagtggaagtgatcccttatggcagccaacagctgctgcgtctgttcgagaagaaaaactaccatccaaaactgcgtctgaatgaagaaggcgaaccgttaaaaaccgattgcagcaattacatcatcgatcttcatctagaaacgatcaccgctcctactgagttggcacaggaattagatgctacagtgggcgtggttgaacacggtctgtttttggatatggtccatacgatcattgtcggattgcctgaaggcccgagtaccaagcacgttagataa

SEQ ID NO: 2368 - DNA, 675 bp, Enterococcus gallinarum
atgaatctaaaagagatggtcggtattgaagcggccagctatgtcactgacggtatggtcgtcggtttaggaactggttcaactgcgtattacatgatcgaagaattggggcgcagagtgaaagaagaaaacttgtcgatcgttggtgtaccaacatcctgggcatcaaaaaaacaagcagaatcgttagggatcccggtcaaaacgatcgatgaagtggcaagtgtcgatttaacgatcgatggtgcagatgagattagtggagactatcatggaatcaaaggtggcggtgccgcactgctttttgaaaaaatcgtcgcaacctactctaaaaaagttctttggattgttgataaatcaaagatcgttgaaaaattaggcgcattcccattacctgtagaagtgattccctatggcagtcagcaattgatgcgattgtttacagaaaaaaactatcaccctgtccttcgcctagccgaagatggcaccccgctaaaaactgattgcggtcattacatcattgatcttcatctacaaaccatcaatgaaccagttgcattggctcatgaactagatcaaaccgtcggtgttgtagagcacgggctcttcttggatatggtccatacgatcatcattggacaagaagatggacctgagacccgcagcgttcgctga

SEQ ID NO: 2369 - DNA, 672 bp, Carnobacterium sp. AT7
atgaatttaaaacaactagttggagaaaaagcagcagaatatgtgaaagacggtatggttgtaggattaggaactggatcaacggcttactacatggttgaagctttaggaaagcgagttaaagaaggtttgactattaccggagtgacaacttcaactcgaacaaaagagcaagcagaaaaattaggcattccactgaaaaccattgatgaagtggaatcggttgatttaacgattgacggagcagatgaaattgattctaagtatcaaggagtaaaaggtggcggtggagctctgttatttgaaaaaatcgttgcagattattctaaaaaagtaatttggattgttgatgagagcaaaatggtggaaacgttaggtgcatttccactgccgatagaagtcatgccttatggtagccaacagttagtgcgcatttttgaagaaaaagggtttcaaccaactatgagaaaaaatgatgttgggggaaattatttaacagatggtggtcattatattattgatttgcatatgactaaaattgaagatccacattcgttagcgacttggttagatggtttaacaggagttatggaacacggcttatttttggaccgagtaaatactattattgtagggcgtaatacaggacttgaaattatagaagcacgctga

SEQ ID NO: 2370 - DNA, 684 bp, Streptococcus pneumoniae
gtggaaaatctgaagaaaatggcaggtatcacggctgctgaatttatcaaggatgggatggttgtagggctaggaacaggttctactgcctattattttgtcgaagaaatcggtcgtcgaatcaaggaagaaggcttgcagattacagctgtgacgacttctagtgtgaccagtaaacaggctgaagggctcaatatcccgctcaagtctattgaccaagtagactttgtcgatgtgacagtcgacggggcggatgaagtggatagtcagtttaatggaatcaaaggcggtggtggtgcccttctcatggaaaaggtggtcgcaacaccatcaaaagaatacatttgggtggtggatgaaagcaagctggtcgaaaaactaggtgcttttaaattgccagtagaagtggttcagtatggtgcagagcaggtctttcgtcattttgaacgagctggctacaaaccaagtttccgtgaaaaagacggccaacgttttgtgaccgatatgcagaattttatcattgacctcgccttggatgtcattgaaaatccaattgcttttggacaagaattggaccatgtcgttggtgttgtggagcatggtttattcaaccaaatggtggataaggtaatcgttgctggacgagatggagttcagatttcaacttcaaaaaaaggaaaatag

SEQ ID NO: 2371 - DNA, 684 bp, Streptococcus pneumoniae
gtggaaaatctgaagaaaatggcaggtatcaaggctgctgagttcgtgagcgatggaatggtcgttggacttggaacaggctcgactgcctattattttgtcgaagaaatcggtcgtcgtatcaaggaagaaggattgcagattacagctgtaacaacttctagtgtgaccactaaacaggcagaaggccttaatatcccgctcaagtctattgaccaagtagactttgtcgatgtgacggttgatggcgcggatgaagtggatagtcagtttaatggaatcaaaggcggtggtggtgcccttctcatggaaaaggtggtcgcaacaccatcaaaagaatacatttgggtggtggatgaaagcaagctggtcgaaaaactaggtgcttttaaattgccagtagaagtggttcagtatggtgcagagcaggtctttcgtcattttgaacgagctggctacaaaccaagtttccgtgaaaaagacggccaacgttttgtgacggatatgcagaattttatcattgacctcgccttggatgtcattgaaaatccaattgcttttggacaagaattggaccatgtcgttggtgttgtggagcatggtttattcaaccaaatggtggataaggtaatcgttgctggacgagatggagttcagatttcaacttcaaaaaaaggaaaatag

SEQ ID NO: 2372 - DNA, 684 bp, Streptococcus pneumoniae
gtggaaaatctgaagaaaatggcaggtatcaaggctgctgagttcgtgagcgatggaatggtcgttggacttggaacaggctcgactgcctattattttgtcgaagaaatcggtcgtcgtatcaaggaagaaggattgcagattacagctgtaacaacttctagtgtgaccactaaacaggcagaaggccttaatatcccgctcaagtctattgaccaagtagactttgtcgatgtgacggttgatggcgcggatgaagtggatagtcagtttaatggaatcaaaggcggtggtggtgcccttctcatggaaaaggtggtcgcaacaccatcaaaagaatacatttgggtggtggatgaaagtaagctggtcgaaaaactaggtgcttttaaattgccagtagaagtggttcagtatggtgcagatcaggtctttcgtcattttgaacgagctggctacaaaccaagtttccgtgaaaaagacggccaacgttttgtgacggatatgcagaattttatcattgacctcgccttggatgtcattgaaaatccaattgcttttggacaagaattggaccatgtcgttggtgttgtggagcatggtttattcaatcaaatggtggataaggtaatcgttgctggacgagatggagttcagatttcaacttcaaaaaaaggaaaatag

SEQ ID NO: 2373 - DNA, 684 bp, Streptococcus pneumoniae
gtggaaaatctgaagaaaatggcaggtatcaaggctgctgagtttgtcaaggatggaatggtcgttggacttggaacaggctcgactgcctattattttgtcgaagaaatcggtcgtcgtatcaaggaagaaggattgcagattatagctgtaacgacttctagtgtgaccactaaacaggcagaaggccttaatatcccactcaaatctattgaccaagtagactttgtcgatgtgacagttgatggcgcagatgaagtggatagtcagtttaatggaatcaaaggtggtggtggtgctcttctgatggagaaggttgttgcgacaccatcaaaagaatacatttgggtggtggatgaaagcaagctggtcgaaaaactaggtgcttttaaattgccagtagaagtggttcagtatggtgcagaacaggtctttcgtcgttttgaacgagctggctacaaaccaagtttccgtgaaaaagacggccaacgttttgtgacggatatgcagaattttatcattgacctcgccttggatgtcattgaaaatccaattgcttttggacaagaattggaccatgtcgttggtgttgtggagcatggtttattcaaccaaatggtggataaggtcatcgttgctggacgggatggagttcagatttcaacttcaaaaaaaggaaaatag

SEQ ID NO: 2374 - DNA, 666 bp, Streptococcus pneumoniae
atggcaggtatcacggctgctgaatttatcaaggatgggatggttgtagggctaggaacaggttctactgcctattattttgtcgaagaaatcggtcgtcgaatcaaggaagaaggcttgcagattacagctgtgacgacttctagtgtgaccagtaaacaggctgaagggctcaatatcccgctcaagtctattgaccaagtagactttgtcgatgtgacagtcgacggggcggatgaagtggatagtcagtttaatggaatcaaaggcggtggtggtgcccttctcatggaaaaggtggtcgcaacaccatcaaaagaatacatttgggtggtggatgaaagcaagctggtcgaaaaactaggtgcttttaaattgccagtagaagtggttcagtatggtgcagagcaggtctttcgtcattttgaacgagctggctacaaaccaagtttccgtgaaaaagacggccaacgttttgtgaccgatatgcagaattttatcattgacctcgccttggatgtcattgaaaatccaattgcttttggacaagaattggaccatgtcgttggtgttgtggagcatggtttattcaaccaaatggtggataaggtaatcgttgctggacgagatggagttcagatttcaacttcaaaaaaaggaaaatag

SEQ ID NO: 2375 - DNA, 741 bp, Streptococcus pneumoniae
ttgaataaaaagcggtttcatagtaaaataagaactgagaatgatggaggtaaatcggtggaaaatctgaagaaaatggcaggtatcaaggctgctgagttcgtgagcgatggaatggtcgttggacttggaacaggctcgactgcctattattttgtcgaagaaatcggtcgtcgtatcaaggaagaaggattgcagattacagctgtaacaacttctagtgtgaccactaaacaggcagaaggccttaatatcccgctcaagtctattgaccaagtagactttgtcgatgtgacggttgatggcgcggatgaagtggatagtcagtttaatggaatcaaaggcggtggtggtgcccttctcatggaaaaggtggtcgcaacaccatcaaaagaatacatttgggtggtggatgaaagcaagctggtcgaaaaactaggtgcttttaaattgccagtagaagtggttcagtatggtgcagagcaggtctttcgtcattttgaacgagctggctacaaaccaagtttccgtgaaaaagacggccaacgttttgtgacggatatgcagaattttatcattgacctcgccttggatgtcattgaaaatccaattgcttttggacaagaattggaccatgtcgttggtgttgtggagcatggtttattcaaccaaatggtggataaggtaatcgttgctggacgagatggagttcagatttcaacttcaaaaaaaggaaaatag

SEQ ID NO: 2376 - DNA, 684 bp, Streptococcus sp. M143
gtggagaatctgaaaaagatggcaggtatcaaggctgctgagtttgtcaaggatggcatggtagtcggacttggaactggatcaactgcctactatttcgtagaagaaatcggtcgtcggattaaggaagaaggtttgcagattactgctgtgacgacttccagtgttactagtaaacaggccgaaggtcttaacatcccgctcaagtcgattgatcaagtggactttgtcgatgtgacagtcgatggagcggatgaagtagatagccagtttaatgggatcaaaggtggtggtggtgcccttctcatggagaaggttgtagcgacaccatcaaaagaatacatttgggtggttgatgaaagcaaactagtagagaaactaggtgcttttaaattgccagtagaagtggttcagtatggatcagaacaggtctttcgtcggtttgagcgagctggctacaagccaagtttccgtgaaaaagacggccaacgttttgtgaccgatatgcagaactttatcattgatctagccttggatgtcattgaagatccaattgccttcgggcaagagttggaccatgtcgttggtgtcgtagagcacggtttattcaaccaaatggtggataaggtcatcgtagcgggacgagatggggttcagattttaacttcaacaaaagggaaataa

SEQ ID NO: 2377 - DNA, 684 bp, Streptococcus pneumoniae
gtggaaaatctgaagaaaatggcaggtatcaaggctgctgagttcgtgagcgatggaatggtcgttggactgggaacgggttctactgcctattattttgtcgaagaaattggtcgtcgtatcaaggaagaaggattgcagattacagctgtaacgacttctagtgtgaccagtaaacaggctgaagggcttaacattccactcaagtctattgaccaagtagactttgtcgatgtgacagtcgacggagcggatgaagtagatagtcagtttaatggaatcaaaggcggtggtggtgcccttctgatggagaagattgttgcaacgccctcaaaagaatacatttgggtagtggatgaaagcaagctggtagacaaactaggtgcttttaaattgcctgtggaagtggttcaatatggtgcagaacagatttttcgtcgttttgagcgagctggctacaaaccaagtttccgtgaaaaagatggccaacgttttgtgaccgatatgcagaactttatcattgaccttgccttggatgtcatcgaagatccaattgtttttggacaagaattggaccatgtcgttggtgttgtagaacacggtttattcaaccaaatggtggacaaggtcattgttgctggacgagatggggttcagattttaacctcaagaaaagaaaaatag

SEQ ID NO: 2378 - DNA, 627 bp, Streptococcus pneumoniae
gtggaaaatctgaagaaaatggcaggtatcaaggctgctgagttcgtgagcgatggaatggtcgttggacttggaacaggctcgactgcctattattttgtcgaagaaatcggtcgtcgtatcaaggaagaaggattgcagattacagctgtaacaacttctagtgtgaccactaaacaggcagaaggccttaatatcccgctcaagtctattgaccaagtagactttgtcgatgtgacggttgatggcgcagatgaagtggatagtcagtttaatggaatcaaaggcggtggtggtgcccttctcatggaaaaggtggtcgcaacaccatcaaaagaatacatttgggtggtggatgaaagcaagctggtcgaaaaactaggtgcttttaaattgccagtagaagtggttcagtatggtgcagagcaggtctttcgtcattttgaacgagctggctacaaaccaagtttccgtgaaaaagacggccaacgttttgtgacggatatgcagaattttatcattgacctcgccttggatgtcattgaaaatccaattgcttttggacaagaattggaccatgtcgtttggtgttgtggagcatggtttattcaaccaaatggtggataa

SEQ ID NO: 2379 - DNA, 678 bp, Streptococcus gordonii
atggagaatctaaagaagatggcagggattaaggctgctgagttcgtgacagatggtatggtagttggacttggaacaggttcgaccgcttattattttgttgaagaaattggccgtcgtataaaagaagaaggcctgcaaattattgcagtaacaacttcaagtgtaaccagccagcaagcagaaggtttgggaattccactcaaatccattgatgaagttgatttagttgatgtgacagttgatggggcagatgaggttgatccaaactttaatggtattaaaggtggtgggggcgctctccttatggagaaggttgttgcaacaccgacaaaaagctacatttgggtagttgatgagagtaaattagttgagaagctaggagcttttaagcttccggtcgaagttgtccagtatggtgcagagcaagttttccgtcgctttgaacgtgcaggttacaaaccagcctttcgtcagaaagatggtcaacgctttgttacagatatgaagaattttatcattgacctagatttgggtgtgattgaaaaccctattgagtttgcccgtgaattagaccatattgttggtatagttgagcacggtctctttaaccaaatggtagataaggttattgtagcaggaaaagctggtgttcaagttttagaagctaataaataa

SEQ ID NO: 2380 - DNA, 678 bp, Streptococcus sp. 2_1_36FAA
atggagaatctaaagaagatggcagggattaaggctgctgagttcgtgacagatggtatggtagttggacttggaacgggttcgaccgcttattattttgtcgaagagattggccgtcggatcaaagaagaaggactgcagattatcgcagtaacaacttcaagtgtaaccagccagcaagcagaaggtttgggaattccactcaaatccattgatgaagtcgatttagttgatgtgacagttgatggggcagatgaggttgatccaaactttaatggtattaaaggcggtgggggcgctctccttatggagaaggtcgttgcaacaccgacaaaatgctacatttgggtagttgatgagagtaaattggttgagaagctaggagcttttaagcttccggtcgaagttgtccagtatggtgcagagcaagttttccgtcgctttgaacgtgcaggttacaaaccagcttttcgtcagaaagatggtcaacgctttgttacagatatgaagaattttatcattgacctagatttgggtgtgattgaaaatcctattgaatttgcccgtgaattagaccacattgttggtgtagttgagcacggtctctttaaccaaatggtagataaggttattgtagcaggaaaagctggtgttcaagttttagaagccaataaataa

SEQ ID NO: 2381 - DNA, 678 bp, Streptococcus sanguinis SK36
atggaaaatctaaagaaactggcaggaatcaaggctgctgaatttgttcaaagcgggatgatagttggtctcgggacgggttcgaccgcttattattttgtcgaagagattggtcggcgtatcaaggaagaaggactgcagattacagctgtgacgacttccagtgtcactagcaaacaggcggaaggattaggtattccgctcaaatctatcgacgatgtggatcaggtggatgtcactgttgatggtgctgatgaggttgattcagcttttaacggtatcaagggtggtggcggcgcgcttctcatggagaaagtcgtagcggtgcctacaaagcactatatctgggtagtcgatgagagcaagatggtcgagaagttaggtgccttcaagctaccagtagaagttgttcagtacggtgctgaacagctctttcgtcgctttgagcgtgctggatataagccagcctttcgtgagaaagatgaccaacgttttgtcacggacatgcagaatttcattattgacttagatttaggtgtgattgaaaattcagttgagtttgcacaagaacttgatcatgttgtgggagtagtggagcatggattgtttaatcaaatggtagacaaggtcattgttgctgggaaatcgggtctccaagttttagaggccaataaatag

SEQ ID NO: 2382 - DNA, 681 bp, Streptococcus thermophilus
atggatgaattaaaaaagctcgccggtgtatacgctgctggatttgttgaagatggcatggttgttggactaggtactggctcaacagcttatttctttgtagaggagattggtcgtcgaataaaggaggaaggtctcagtgtagtaggtgtaacgacgtctagtcaaacaacgaagcaagctgaaggtctaggtattcctttgaaatcagtggatgatattgatagtattgatgttaccgttgatggcgccgacgaagtagatcctcaactcaacggcattaaaggtggcggtggtgccctcttgatggaaaaaatcgttgccacacctacgaaaaagtacatctgggtagttgatgagtctaagatggttgatcaacttggtgcttttaaattaccagtcgaagttgttcaatatggtgctgatcgcttgtatctcgactttgaatctaagggctataagccatcattccgagtaactgaacaaggtgatcgctttgttacagatatgaagaactttattattgatttggatctcggcaaaattaataacccagttgctttaggtgacgaactaaaagctatgactggtgttgttgaacatggcttattcaatggaatggttaataaggttatcgtcgctggaaaagatggtgttaagattgttgaggttaaggattag

SEQ ID NO: 2383 - DNA, 681 bp, Streptococcus thermophilus
atggatgaattaaaaaagctcgccggtgtatacgctgctggatttgttgaagatggcatggttgttggactaggtactggctcaacagcttatttctttgtagaggagattggtcgtcgaataaaggaggaaggtctcagtgtagtaggtgtaacgacgtctactcaaacaacgaagcaagctgaaggtctaggtattcctttgaaatcagtggatgatattgatagtattgatgttaccgttgatggcgccgacgaagtagatcctcaactcaacggtattaaaggtggcggtggtgccctcttgatggaaaaaatcgttgccacacctacgaaaaagtacatctgggtagttgatgagtctaagatggttgatcaacttggtgcttttaaattaccagtcgaagttgttcaatatggcgctgatcgcttgtatctcgactttgaatctaagggctataagccatcattccgagtaactgaacaaggtgatcgctttgttacagatatgaagaactttattattgatttggatctcggcaaaattaataacccagttgctttaggtgacgaactaaaagctatgactggtgttgttgaacatggcttattcaatggaatggttaataaggttatcgtcgctggaaaagatggtgttaagattgttgaggttaaggattag

SEQ ID NO: 2384 - DNA, 681 bp, Streptococcus salivarius
atggaagaacttaagaaaatcgctggtgtaaccgctgccaaatatgttgaagatggaatggttgttggactcggtacagggtcaacagcctacttctttgtagaggaaattggccgtcgtattaaggaagaaggtcttagtgttgttggtgtaacgacatcaagtcaaaccactaaacaagctgaaggcttaggcattcctttgaaggcagtggatgacattgacagtattgatgttactgttgatggagccgacgaagtagaccctcaactcaacgggattaaaggtggcggtggcgcccttttgatggaaaaaatcgtcgctacacctacaaaagaatatatctgggtggttgatgagtctaaaatggttgatcaattaggtgctttcaaactaccagttgaagtggttcaatatggtgctgaccgtctgtaccgtgtctttgagtctaagggctataagccatcattccgacttacggaacaaggtgaccgctttgttacagatatgaagaactatatcatcgatcttgatttaggtaagattgaaaatccagtagctcttggtgaagaactaaaagctatgacaggggttgtcgatcatggattgttcaatggcatggttaacaaagtcatcgttgcaggaaaagacggtgttaaggtcgttgaagttaaggcctag

SEQ ID NO: 2385 - DNA, 657 bp, Streptococcus infantarius subsp. infantarius ATCC BAA-102
atggctggtgttacagctgctcagtatgtgaaagacggcatggtcgttggacttggaactggttcaacagcatatttcttcgttgaagaaatcggtcgtcgtatgaaagaagaaggccttaaagttgtcggtgtgacaacttcaagccaaacaacagctcaagcagaaggccttggtattcctttgaaagctgttgatgatatcgatgttatcgatgtaactgtcgacggtgctgatgaagtagataaaaacttcaacggtatcaaaggtggcggcggtgctcttcttatggaaaaaatcgttgctacaccaagtaaagaatacatctgggttgttgacgaatctaaaatggtcgacacactcggtgctttcaaattgccagttgaagttgtgcaatatggtgctgaccgcattttccgtgaattcgagaaaaaaggttacaaaccatcataccgcatggcaaacggcgaacgctttgtcactgatatgaaaaactatatcatcgaccttgaccttggtgctattaaaaatccagttgaacttggtaaagaattgaaagccatggtcggtgttgttgaagacggtctcttcaatggtatggttaacaaagttatcgttgctggtaaagacggcgttaaaattttagaagctaaataa

SEQ ID NO: 2386 - DNA, 678 bp, Streptococcus mutans
atggaagaacttaaaaagattgctggtgttagggcagctcaatatgttgaagatggtatgattgtgggacttgggacaggttcaacagcctattattttgttgaagaagtcggtcgccgtgtgcaagaagagggcttgcaagtgattggtgtgacgacgtcaagtcggacaactgctcaagctcaagctttaggtattcctctcaaatctattgatgaggttgactctgttgatgtgacagtggatggagctgatgaggttgatcctaatttcaatggtattaaaggcggcggtggtgctctgctgatggaaaagatagtaggaacattgacaaaagactatatctgggtggttgatgaaagcaagatggttgatactttgggagcctttaggttacccgttgaagtagttcaatatggtgctgagcgtctttttcgagagtttgagaaaaaaggctataaaccttcttttcgcgaatatgatggtgttcgctttgtgactgacatgaaaaactttatcattgatttggatttgggctctatccctgatcctattgcttttggcaatatgttagatcatcaagtcggtgttgttgaacacggcctcttcaatggtatggttaatcgtgtgattgttgcaggtaaagatggtgttcgtattttggaagctaataaataa

SEQ ID NO: 2387 - DNA, 684 bp, Streptococcus pyogenes
atggaagcactcaaaaaaattgccggtgttaccgctgcgcaatatgtgactgatggcatgaccattgggcttggaactgggtcaacggcttactattttgttgaggaaattggccgtcgcgtaaagcaagaaggactgcaagtggttggtgtgaccacgtcaagtgtgactagcaagcaagcagaaggcttaggcattcctttaaaatcgatagatgatattgatagcattgacctcaccgtagatggtgctgatgaagtggataaggatttcaatggaatcaagggtggtggcgcagccttactaatggaaaaaattgttgcaacaccaacaaaagaatacatctgggttgttgatgcttctaaaatggtagagcatctgggtgcctttaagttaccagtcgaagtcgttcaatacggtgctgatcgtttgttccgtgtctttgaaaaagctggttacaaaccgtcttttcgtatgaaaggtgatagtcgtttggtgacagacatgcaaaactatattattgatcttgatttgggttgtattaaagatcctgttgcttttggtcacctgctagatgggacagttggtgttgtggaacacggtctctttaatggtatggttgataaggtgattgttgctagtaaagacggcgttactgttttagaagcgcctaaagcaagctag

SEQ ID NO: 2388 - DNA, 684 bp, Streptococcus pyogenes
atggaagcactcaaaaaaattgccggtgttaccgctgcgcaatatgtgactgatggcatgaccattgggcttggaactgggtcaacggcttactattttgttgaggaaattggccgtcgcgtaaagcaagaaggactgcaagtggttggtgtgactacgtcaagtgtgactagcaagcaagcagaaggcttaggcattcctttaaaatcgatagatgatattgatagcattgacctcaccgtagatggtgctgatgaagtggataaggatttcaatggaatcaagggtggcggcgcagccttactaatggaaaaaattgttgcaacaccaacaaaagaatacatctgggttgttgatgcttctaaaatggtagagcatctgggtgcctttaagttaccagtcgaagtcgttcaatatggtgctgatcgtttgttccgtgtctttgaaaaagctggttacaaaccgtcttttcgtatgaaaggtgatagtcgtttggtgacagacatgcaaaactatattattgatcttgatttgggttgtattaaagatcctgttgcttttggtcacctgctagatggaacagttggtgttgtggaacacggtctctttaatggtatggttgataaggtgattgttgctagtaaagacggcgttactgttttagaagcgcctaaagcaggctag

SEQ ID NO: 2389 - DNA, 684 bp, Streptococcus pyogenes
atgaaagcactcaaaaaaattgccggtgttaccgctgcgcaatatgtgactgatggcatgaccattgggcttggaactgggtcaacggcttactattttgttgaggaaattggccgtcgcgtaaagcaagaaggactgcaagtggttggtgtgaccacgtcaagtgtgactagcaagcaagcagaaggcttaggcattcctttaaaatcgatagatgatattgatagcattgacctcaccgtagatggtgctgatgaagtggataaggatttcaatggaatcaagggtggtggtgcagccttactaatggaaaaaattgttgcaacaccaacaaaagaatacatctgggttgttgatgcttctaaaatggtagagcatctgggtgcctttaagttaccagtcgaagtcgttcaatatggtgctgatcgtttgttccgtgtctttgaaaaagctggttacaaaccgtcttttcgtatgaaaggtgatagtcgtttggtgacagacatgcaaaactatattattgatcttgatttgggttgtattaaagatcctgttgcttttggtcacctgttagatggaacagttggtgttgtggaacacggtctctttaatggtatggttgataaggtgattgttgctagtaaagacggtgttactgttttagaagcgcctaaagcaggctag

SEQ ID NO: 2390 - DNA, 684 bp, Streptococcus pyogenes
atggaagcactcaaaaaaattgccggtgttaccgctgcgcaatatgtgactgatggcatgaccattgggcttggaactgggtcaacggcttactattttgttgaggaaattggccgtcgcgtaaagcaagaaggactgcaagtggttggtgtgactacgtcaagtgtgactagcaagcaagcagaaggcttaggcattcctttaaaatcgatagatgatattgatagcattgacctcaccgtagatggtgctgatgaagtggataaggatttcaatggaatcaagggtggcggcgcagccttactaatggaaaaaattgttgcaacaccaacaaaagaatacatctgggttgttgatgcttctaaaatggtagagcatctgggtgcctttaagttaccagtcgaagtcgttcaatatggtgctgatcgtttgttccgtgtctttgaaaaagctggttacaaaccgtcttttcgtatgaaaggtgatagtcgtttggtgacagacatgcaaaactatattattgatcttgatttgggttgtattaaagatcctgttgcttttggtcacctgctagatggaacagttggtgttgtggaacacggtctctttaatggtatggttgataaggtgattgttgctagtaaagacggcgttattgttttagaagcgcctaaagcaggctag

SEQ ID NO: 2391 - DNA, 684 bp, Streptococcus pyogenes
atggaagcactcaaaaaaattgccggtgttaccgctgcgcaatatgtgactgatggcatgaccattgggcttggaactgggtcaacggcttactattttgttgaggaaattggccgtcgcgtaaagcaagaaggactgcaagtggttggtgtgactacgtcaagtgtgactagcaagcaagcagaagtcttaggcattcctttaaaatcgatagatgatattgatagcattgacctcaccgtagatggtgctgatgaagtggataaggatttcaatggaatcaagggtggcggcgcagccttactaatggaaaaaattgttgcaacaccaacaaaagaatacatctgggttgttgatgcttctaaaatggtagaacatctgggtgcctttaagttaccagtcgaagtcgttcaatatggtgctgatcgtttgttccgtgtctttgaaaaagctggttacaaaccgtcttttcgtatgaaaggtgatagtcgtttggtgacagacatgcaaaactatattattgatcttgatttgggttgtattaaagatcctgttgcttttggtcacctgttagatggaacagttggtgttgtggaacacggtctctttaatggtatggttgataaggtgattgttgctagtaaagacggcgttactgttttagaagtgcctaaagcaagctag

SEQ ID NO: 2392 - DNA, 684 bp, Streptococcus pyogenes
atggaagcactcaaaaaaattgccggtgttaccgctgcgcaatatgtgactgatggcatgaccattgggcttggaactgggtcaacggcttactattttgttgaggaaattggccgtcgcgtaaagcaagaaggactgcaagtggttggtgtgactacgtcaagtgtgactagcaagcaagcagaagtcttaggcattcctttaaaatcgatagatgatattgatagcattgacctcaccgtagatggtgctgatgaagtggataaggatttcaatggaatcaagggtggcggcgcagccttactaatggaaaaaattgttgcaacaccaacaaaagaatacatctgggttgttgatgcttctaaaatggtagagcatctgggtgcctttaagttaccagtcgaagtcgttcaatatggtgctgatcgtttgttccgtgtctttgaaaaagctggttacaaaccgtcttttcgtatgaaaggtgatagtcgtttggtgacagacatgcaaaactatattattgatcttgatttgggttgtattaaagatcctgttgcttttggtcacctgttagatggaacagttggtgttgtggaacacggtctctttaatggtatggttgataaggtgattgttgctagtaaagacggtgttactgttttagaagcgcctaaagcaggctag

SEQ ID NO: 2393 - DNA, 684 bp, Streptococcus pyogenes
atggaagcactcaaaaaaattgccggtgttaccgctgcgcaatatgtgactgatggcatgaccattgggcttggaactgggtcaacggcttactattttgttgaggaaattggccgtcgcgtaaagcaagaaggactgcaagtggttggtgtgactacgtcaagtgtgactagcaagcaagcagaagtcttgggcattcctttaaaatcgatagatgatattgatagcattgacctcaccgtagatggtgctgatgaagtggataagaatttcaatggaatcaagggtggcggcgcagccttactaatggaaaaaattgttgcaacaccaacaaaagaatacatctgggttgttgatgcttctaaaatggtagagcatctgggtgcctttaagttaccagtcgaagtcgttcaatatggtgctgatcgtttgttccgtgtctttgaaaaagctggttacaaaccgtcttttcgtatgaaaggtgatagtcgtttggtgacagacatgcaaaactatattattgatcttgatttgggttgtattaaagatcctgttgcttttggtcacctgctagatggaacagttggtgttgtggaacacggtctctttaatggtatggttgataaggtgattgttgctagtaaagacggcgttactgttttagaagcgcctacagcaggctag

SEQ ID NO: 2394 - DNA, 684 bp, Streptococcus dysgalactiae
atggaagcactcaaaaaaattgctggggttactgctgcccaatatgtcacagatggtatgaccattggattgggaacaggatcaaccgcttattattttgttgaagaaattggccgtcgtgtaaaggaagaaggactgcaagtggtcggggttacgacatcaagtgtaaccagtaaacaagcagaaagtctaggtattcctttaaaatcagtagatgacattgatagcatcgacctcaccgtcgatggtgctgatgaagttgataaagacttcaacggtatcaagggaggtggtgcagcgttattgatggagaagattgttgccacaccaacaaaagaatatatctgggttgttgatgattctaaaatggtagagcatttgggtgcctttaaattaccagtcgaagtggttcaatatggtgctgaccgattgctccgtgtctttgaaaaagctggttacaaaccttctttccggatgaagggtgacagtcgtttggtgaccgatatgcaaaactatattattgaccttgatatgggttgcattgaggatccccttgcctttggtcacttgttagatgggacagttggtgttgtggaacacggtctctttaatggtatggtcgataaggtgattgtcgcgagcaaatcgggcgttactgttttagaagcgcctaaagtaggttag

SEQ ID NO: 2395 - DNA, 684 bp, Streptococcus equi
atggaagcactgaaaaagcttgccggtgtgactgctgcgcaatatgtaacagatggaatgaccattggattaggaacaggatcaacagcttattactttgttgaagaaattggtcgtcgcatcaaggaagagggactacaggttgttggtgtgacaacctcaagtgtgacaaccaagcaagcagagggcctaggtattcccttaacatcaattgatgatattgactgcattgacctgactgttgatggtgctgatgaggtggataaggcctttaacggtatcaagggtggtggagcagctctattgatggagaaaatcgttgcaacaccaaccaaggaatacatctgggttgttgatgaatcaaagctggtggatcatttaggtgctttcaagctccctgttgaggtcgttcaatacggtgctgataggctatttcgagtctttgaaagggctggctataagccctcttttcgcatgaagggggataagcgtctcataacggatatgcagaactttatcattgatcttgaccttggctgtatcgaaaatccttgtgagtttgggcgtctgctggatcaaactgttggtgttgtcgagcatggccttttcaatggtatggttgataaggtcattgttgctggtcaggctggtgtaacggtccttgaagctaatcagtcaacctaa

SEQ ID NO: 2396 - DNA, 684 bp, Streptococcus equi
atggaagcactgaaaaagattgccggtgtgactgctgcgcaatatgtaacagatggaatgaccattggattaggaacaggatcaacagcttattactttgttgaagaaattggtcgtcgcatcaaggaagagggactacaggttgttggtgtgacaacctcaagtgtaacaaccaagcaagcagagggcctaggtattcccttaacatcaattgatgatattgactgcattgacctgactgttgatggtgctgatgaggtggataaggcctttaacggtattaagggtggtggagcagctctattgatggagaaaattgttgcaacaccaaccaaggaatacatctgggttgttgatgaatcaaagctggtggatcatttaggtgctttcaagctccctgttgaggtcgttcaatacggtgctgataggctatttcgagtctttgaaagggctggctataagccctcttttcgcatgaagggggataagcgtctcataacggatatgcagaactttatcattgatcttaaccttggctgtatcgaaaatccttgtgagtttgggcgtctgctggatcaaactgttggtgttgtcgagcatggccttttcaatggtatggttgataaggtcattgttgctggtcaggctggtgtaacggtccttgaagctaatcagtcaacctaa

SEQ ID NO: 2397 - DNA, 684 bp, Streptococcus equi
atggaagcactgaaaaagcttgccggtgtgactgctgcgcaatatgtaacagatggaatgaccattggattaggaacaggatcaacagcttattactttgttgaagaaattggacgtcgcatcaaggaagaaggactacaggttgttggtgtgacgacctcaagtgtgacaaccaagcaggcagagggcctaggtattcccttaacatcaattgatgatattgactgcattgacctgactgttgatggtgctgatgaggtggataaggcctttaacggtatcaagggtggtggagcagctctattgatggagaaaatcgttgcaacaccaaccaaggaatacatctgggttgttgatgaatcaaagctagtggatcatttaggtgctttcaagctccctgttgaggtcgttcaatacggtgctgataggctatttcgagtctttgaaagggctggctataagccctcttttcgcatgaagggggataagcgtctcataacggatatgcagaactttatcattgatcttgaccttggctgtatcgaaaatccttttgattttgggcgtctgctggatcaaactgttggtgtcgtcgagcatggtcttttcaatggtatggttgataaggtcattgttgctggtcaggctggtgtaacggtccttgaagctaatcagtcaacctaa

SEQ ID NO: 2398 - DNA, 681 bp, Streptococcus uberis
atggaagcactgaaaaaaatggcgggtgtcacagcagcccaatatgtcaaagatggaatgatagttggtttaggaactggttcaacggcttatttctttgttgaagaaattggtcgtcgtgtcaatgaggaaggtttgcaggttgtcggtgtaaccacatcgagtgctacaacgaaacaagctgaaagccttggtattcccttaaaagctgttgatgagattgatgaaatcgacctcactgtggatggtgctgatgaagtagacaaagaattcaatggaatcaaaggtggcggagcggcccttttgatggaaaaaatcgtagcaactccaaccaaagaatacatttgggttgttgatgaatccaaaatggttgaaaaacttggagctttcaaacttccagtagaagtggttcagtatggcgctgaacgcttgttccgtgttttcgaaaaagctgggtacaacccttcatttaggatgaaagaagaccaaaaacttatcacagatatgggtaactttatcattgaccttgatttgaaagtgattgaaaaaccatttgagtttgctgaaatgctagataaaactgttggtgttgttgagcatggcttattcaatggtatggttcataaagtcatcgttgctggtaaagatggggtcaaagttcttgaagcccctagcaaataa

SEQ ID NO: 2399 - DNA, 672 bp, Streptococcus agalactiae
atggacgaactaaaaaaacttgctggagtgaccgctgcaaaatacgttaaaaacggtatgattgtaggtttagggacaggttctacagcatatttttttgttgaagaaattggacgccgtgtcaaagaagagggattgcaagtcgtaggcgttacaacgtcaaaccgtacgactgagcaggcaagaggattaggtattccgttgaaatcagcagatgatattgatgtcattgatgtcactgtggatggagcagatgaagtagaccctgattttaatggtatcaagggtggcggtggtgcgctgctcatggaaaaaatagtagctactccaactaaagaatatatctgggttgtcgatgagagcaaacttgttgaaacgttaggtgcatttaaattgcctgttgaggttgttagatatggttctgagcgtctttttcgggtttttaaatcaaaaggttattgtccttctttccgtgaaacagaaggtgaccgctttatcactgatatggggaactacattatcgacctagatttgaaaaaaatagaggatccaaagcagttagcgaatgaacttgaccatacagttggtgttgttgaacatggtttatttaatggtatggttaataaagttatagtagcaggcaaaaacggtcttgacatacttgaaaaatag

SEQ ID NO: 2400 - DNA, 672 bp, Streptococcus agalactiae
atggacgaactaaaaaaacttgctggagtgaccgctgcaaaatacgttaaaaacggtatgattgtaggtttagggacaggttctacagcatatttttttgttgaagaaattggacgccgtgtcaaagaagagggattgcaagtcgtaggcgttacaacgtcaaaccgtacgactgagcaggcaagaggattagctattccgttgaaatcagcagatgatattgatgtcattgatgtcactgtggatggagcagatgaagtagaccctgattttaatggtatcaagggtggcggtggtgcgctgctcatggaaaaaatagtagctactccaactaaagaatatatctgggttgtcgatgagagcaaacttgttgaaacgttaggtgcatttaaattgcctgttgaggttgttagatatggttctgagcgtctttttcgggtttttaaatcaaaaggttattgtccttctttccgtgaaacagaaggtgaccgctttatcactgatatggggaactacattatcgacctagatttgaaaaaaatagaggatccaaagcagttagcgaatgaacttgaccatacagttggtgttgttgaacatggtttatttaatggtatggttaataaagttatagtagcaggcaaaaacggtcttgacatacttgaaaaatag

SEQ ID NO: 2401 - DNA, 672 bp, Streptococcus agalactiae
atggacgaactaaaaaaacttgctggagtgaccgctgcaaaatacgttaaaaacggtatgattgtaggtttagggacaggttctacagcatatttttttgttgaagaaattggacgccgtgtcaaagaagagggattgcaagtcgtaggcgttacaacgtcaaaccgtacgactgagcaggcaagaggattaggtattccgttgaaatcagcagatgatattgatgtcattgatgtcactgtggatggagcagatgaagtagaccctgattttaatggtatcaagggtggcggtggtgcgctgctcatggaaaaaatagtagctactccaactaaagaatatatctgggttgtcgatgagagcaaacttgttgaaacgttaggtgcatttaaattgcctgttgaggttgttagatatggttctgagcgtctttttcgggtttttaaatcaaaaggttattgtccttctttccgtgaaacagaaggtgaccgctttatcactgatatggggaactacattatcgacctagatttgaaaaaaatagaggatccaaagcagttagcgaatgaacttgaccatacagttggtgttgttgaacatggtttatttaatagtatggttaataaagttatagtagcaggcaaaaacggtcttgacatacttgaaaaataa

SEQ ID NO: 2402 - DNA, 672 bp, Streptococcus agalactiae
atggacgaactaaaaaaacttgctggagtgaccgctgcaaaatacgttaaaaacggtatgattgtgggtttagggacaggttctacagcatatttttttgttgaagaaattggacgccgtgtcaaagaagagggattgcaagtcataggcgttacaacgtcaaaccgtacgactgagcaggcaagaggattaggtattccgttgaaatcagcagatgatattgatgtcattgatgtcactgtggatggagcagatgaagtagaccctgattttaatggtatcaaggggggcggtggtgcgctgctcatggaaaaaatagtagctactccaactaaagaatatatctgggttgtcgatgagagcaaacttgttgaaacgttaggtgcatttaaattgcctgttgaggttgttagatatggttctgagcgtctttttcgggtttttaaatcaaaaggttattgtccttctttccgtgaaacagaaggtgaccgctttatcactgatatggggaactacatcatcgacctagatttgaaaaaaatagaggatccaaagcagttagcgaatgaacttgaccatacagttggtgttgttgaacatggtttatttaatggtatggttaataaagttatagtagcaagcaaaaatggtcttgacatacttgaaaaataa

SEQ ID NO: 2403 - DNA, 675 bp, Streptococcus suis
atgacaaacctaaaagagcaggttgggattaaggcggcggagtttgtgacggacggtatgattgttgggctggggactggttcgacggcatactatttcgtgcaggagattggccgccgggttgcagaagaagggttacaaatcacaggcgtaacgacctctcatgctacggcagaacatgctgcgtcccttgggattcccctaaaaaatatcgacgaagtcgaatatgtggacttgacggtggatggagcagatgaggttgatggtgacttcaatgggattaaaggcggtggcgcagcgcttctcatggagaaagtggtagcagtcaatagcaaggactgcatctggattgtggatgagtctaaggtggttcaaaccctaggagccttcaagttgccggtggaagttgtacagtacggtgcggaaaatcttttccgactatttgagaaaaaagggtatcgtccaagttttcgtatgcgtaatggagaaaaacatatcacggatatgcagaactttatcattgaccttgatttgcgcagaatagaagacacatatgcattggcggaagaattggatcggaccgtcggtgttgtagaacacggtctctttattggattgatttccaaggtaattgttggtacaccagaaggaccgaacatcatcgaaaagaaataa

SEQ ID NO: 2404 - DNA, 675 bp, Streptococcus suis
atgataaacctaaaagagcaggttgggattaaggcggcggaatttgtgacggacgggatgattgttgggctgggaactggttcgacggcatactatttcgtgcaggagattggccgccgggttgcagaagaagggctacagataacaggcgtaacgacctctcatgccacggctgagcacgctgcgtcccttgggattcccctaaaaaatatcgacgaagtcgaatatgtggacttgacggtggatggagcagatgaggttgatggtgacttcaatgggattaaaggcggtggtgcagcgcttctcatggagaaagtggtagcagtcaatagcaaggactgcatctggattgtggatgagtctaagatggttcaaaccctaggagccttcaagttgccggtggaagtcgtgcagtacggtgcggaaaatcttttccgactatttgagaaaaaagggtatcgtccaagttttcgtatgcgtaatggaaaaaaacatatcacggatatgcagaactttatcattgaccttgatttgcgcagaatagaagacacatatgcattggcggaagaattggatcggaccgtcggtgttgtagaacacggtctctttattggattgatttccaaggtaattgttggtacaccagaaggaccgaacatcatcgaaaagaaataa

SEQ ID NO: 2405 - DNA, 675 bp, Lactococcus lactis
atggataatttaaaaaaacaagtcggcataaaagctgctgaatttgttaaatcgggaatggtcgttggtttaggaactgggtcaacagcagcctattttgtcgaagaattgggtcgaagaattgccgaagaacaattggaaattacgggtgtaacaacgtccaatgtaacaagtagccaagccagagctcttggaattcctttagcctctattgacgaagtagattatgttgatttaacagttgatggcgcagatgaaattgattcttcactaaatggtattaaaggtggtggagcagcacttctaatggaaaaaattgttgcaacctactcaaaagactatatttggattgttgatgaaagtaaattatcagaaaatctaggatcctttaaaattcctgtagaagttattccttatggctcacaacaagtttttaaaaaattcgaagcggctggctatgctccaacttggcgtctaaatgaggaaaacgagagattgataacggatatgcatcactttattattgaccttcatatctctcaaattaaagaaccagaaaaacttgctgaagagcttgatttaatgggtggagttgttgaacacggcctctttaataacatggttaaaaaagtgattgttgctggcaacgaaggcgtaagaataataaataagtaa

SEQ ID NO: 2406 - DNA, 675 bp, Lactococcus lactis
atggataatttaaaaaaacaagttggcataaaagctgctgaatttgttaaatcgggaatggtcgttggtttaggaactgggtcaacagcagcctattttgtcgaagaattgggtcgaagaattgccgaagaacaattggaaattacgggtgtaacaacgtccaatgtaacaagtagccaagccagagctcttggaattcctttagcctctattgacgaagtagattatgttgatttaacagttgatggcgcagatgaaattgattcttcactaaatggtattaaaggtggtggagcagcacttctaatggaaaaaattgttgcaacctactcaaaagactatatttggattgttgatgaaagtaaattatcagaaaatctaggatcctttaaaattcctgtagaagttattccttatggctcacaacaagtttttaaaaaattcgaagcggctggctatgctccaacttggcgtctaaatgaggaaaacgagagattgataacggatatgtatcactttattattgaccttcatatctctcaaattaaagaaccagaaaaacttgctgaagagcttgatttaatggttggagttgttgaacacggcctctttaataatatggttaaaaaagtgattgttgctggcaacgaaggcgtaagaataataaataagtaa

SEQ ID NO: 2407 - DNA, 675 bp, Lactococcus lactis
atggaaaatttaaaaaaacaagttgggataaaagcggctgaatttgttaaatcaggaatggttgtcggcttaggaacagggtcaacagcagcctattttgtagaagaattagggagacgagttgctgaagaacaattagaaattacaggcgtgacaacttctagtgtgacaagtgaacaagcaaaagcgctgggaattcctttagcttcaattgatgaagtagattatgttgacttgactgttgatggagcggacgaaattgattctcacttgaatggtattaaaggaggcggagcggcacttttaatggaaaaaatcgttgccacttactcaaaagattatatttggattgttgatgagagtaaattatcagaaaatcttggttcttttaaagttccggtagaagttattcgttatggctcagagcaattatttaaagagtttgaaagagctgcttatgctcccacttggcgtttaaatgaggaaggggagaaattaataacagatatgcaacactttattattgaccttcatattgcaaaaattgaaaatccccaaaaacttgctgatgaacttgatttaatggtcggagttgtggaacatggtctctttaatgatatggtgaaaaaagtgattgtcgccggttctgacggagtaaaaataatcagtcaataa

SEQ ID NO: 2408 - DNA, 675 bp, Lactococcus lactis
atggaaaatttaaaaaaacaagttgggataaaagcggctgaatttgttaaatcaggaatggttgttggcttaggaacagggtcaacagcagcctattttgtagaagaattagggagaagagttgctgaagaacaattagaaattacgggcgtgacaacttctagtgtgacaagtgaacaagcaaaagcgctgggaattcctttagcttcaattgatgaagtagattatgttgacttgactgttgatggagcggacgaaattgattctcacttgaatggtattaaaggaggaggagcggcacttttaatggaaaaaatcgttgccacttactcaaaagactatatttggattgttgatgagagtaaattatcagaaaatcttggttcttttaaagttccagtagaagttattacttatggctcagagcaattatttaaagagtttgaaagagctgcttatgctcccacttggcgtttaaatgaggagggggagaaattaataacagatatgcaacactttattattgaccttcatattgcaaaaattgaaaatccccaaaaacttgctgatgaacttgatttaatggttggagttgtggaacatggtctctttaatggtatggtgaaaaaagtgattgttgccggttctgacggagtaaaaataataagtcaataa

SEQ ID NO: 2409 - DNA, 684 bp, Lactobacillus brevis
atgacaaaacaagatgaacttaaacaactagttggccaagaagcagttaagtttattgaagatgggatgatcgttggcctgggaacaggttctactgttaaattcatggttgacgcactcggcaaacgagtcgctgacgaacaactatcaatcgtgggtgtcccaacttcccaaagaactaaagaacaagctgccggccttggcattccaacaaaagggcttgatgaagtggatcacatcgacttaacgattgacggcgccgatcaaattgataaaaattttcaaggtattaaaggcggcggtgccgctcacctttgggagaaaattgttgcaattaattccacaaaaaatatgtggatcgttgataaaagcaaaatggttgaccaactcggttcttttccattaccacttgaagtcatcccgtacggcagccaacaactatttaagcgcttggaaaagcggggatttaatccggtttttcgaatgaaaaataataactatgtcacgaccgattccaacaattatcttattgacctacatcttcacaaaatcgataatcccaataaattggcacttacacttgaccaaatgaccggaattgtggaacatggtcttttcttgaacattgtgaacactgtcattgtcggagaagacgatggtccaaaggtacttcaagctaggtaa

SEQ ID NO: 2410 - DNA, 684 bp, Lactobacillus buchneri
atgacaaaacaagatgaacttaaacaactagttggccaagaagcagttaagtttattgaagatgggatgattgttggcctgggaacaggttctactgttaaattcatggttgacgcactcggtaaacgagtcgctgacgaacaactatcaatcgttggtgtcccaacttcccagagaactaaagaacaagctgccggccttggcattccaacaaaggggctcgatgaagtggatcacatcgacttaacgattgacggcgccgatcaaattgataaaaattttcaaggtattaaaggcggcggtgccgctcatctttgggagaaaattgttgcaattaattctacaaaaaatatgtggatcgttgataaaagcaaaatggttgaccaactcggttcttttccattaccacttgaagtcatcccgtacggcagtcaacaattatttaagcgcttggaaaaacaaggatttaatccggtttttcgaatgaaaaataataattatgtcacgaccgattccaacaattatcttattgacctacatcttcacaaaatcgataatcccaaggaattggcacttacacttgaccaaatgaccggaattgtggaacatggtcttttcttgaacattgtgaacactgtcattgttggagaagacgatgggccaaaggtacttcaagctaggtaa

SEQ ID NO: 2411 - DNA, 687 bp, Pediococcus pentosaceus
atggatcaaaacgaattaaaaaaactagttggcgaagaagccgttaaatttattgaagatgggatgactgtgggtttaggtaccggttctactgttaaatttatggtggacgctcttggtgaacgcgttaaaaatgaaaatttaaatatcgttggggtcccaacttccgatcgtacagctgaacaagcccgttcattgggcattaatgttaaatctgttgacgaggttgatcatattgatttaaccattgatggagctgatgaaatcagttctgacttccaaggtatcaaaggtggcggtgccgctcacttgtttgaaaaaattgttgccacaaactcaaaaaaagtaatgtggattgtagatgaatctaaaatggttgatcacttaggggccttcccactccctctagaagtaattccatatggtagcaaacaagtcttcaagaagcttgaaaaagaaggccttcatcctgaatttaggaaaaatgatgctggcgaatatgttttaaccgattctaaaaactacgtaattgatcttcatcttggtgaaattaaacacccgcatcaattagcagattatctaatcaaacaagttggtattgtagaacaaggattgttccttgacatggttaatactgtcattgttggacgccaaaatggtccagaagttttgactgctcgaccataa

SEQ ID NO: 2412 - DNA, 687 bp, Pediococcus acidilactici
atggatcaaaatgaactaaaaaaactggtaggtaacgaagccgttaaatttattgaagacggcatgaccgttggcttaggaaccggctcgacggttaaatttatggttgacgccttaggtaagcgcgttaaggaagaaaatttaaacatcgtgggggttccgacttccgatcgcactgctaaacaagctcgcgatttaggaattaccgttaagtcagttgacgaagttgaccacatcgacttgaccattgacggtgccgacgaaatcagtagcgatttccaaggcattaaaggtggcggggcagcccacctctttgaaaaaattgtggcaaccaattccagcaagaacatgtggattgttgatgaatctaaaatggtcgacaagttgggcgctttcccactcccgcttgaagtaattccttatggtagcaagcaagtcttcaagaaattagaagccaagggattcaaccctgagtttcgcatggatgaaaacggtaatcacgttttaaccgactctaaaaattacgtaatcgacttgcatttacacgaaattgacgatccgcatgctttggcagattacctaatcaaacaggttggaattgtcgaacaaggcctcttcttagacacggttaacacggtaatcgtcggccggcaagatggacccgaagtccttcaagcacgtccttaa

SEQ ID NO: 2413 - DNA, 687 bp, Lactobacillus brevis
atggatcaaaacgcattaaaggccctcgttggtcaagaagcagttaaatacgttgaagatggcatgatcttaggtatcgggactggctcaaccgtccgttacatgattgatgcccttggggaacgggttaaaaatgaaggcctacacatcatcggtgttgccacgtcagaccgttctgccaagcaagctgaatcccttgggattaccatcaaggaacttgacgaagtcgatcacctcgatttaaccatcgacggggccgatgaaattgatgacaacttccaaggaatcaagggtggcggtgccgcgcatctctgggaaaaaattgtcgctatcaactccactaaaaacatgtggatcgttgacgaaagcaaaatggtccaccatttaggtgccttcccactccccttagaagtgattccatttggttccagccacgttctagaaaagctaaacaagatgggcttcaaccccagcttccggatgacagatactggtgaacatgtcttgaccgattccaaaaactacatcattgacttacacctcggccggattgatcacccccacgacttagcgaatacactcaatggcattgtgggtgttgttgaacacggtctgttcttagacacggtcaacaccgtcatcgttggtcggcaggacggtcccgaagttttgaatgctcgcgactaa

SEQ ID NO: 2414 - DNA, 684 bp, Lactobacillus salivarius
atgaaccaagatgaattaaagcaattagtaggtacaaaggcagttgaatggattaaagatggcatgattgtcggtctaggaacaggttcaactgttaaatacatggttgatgcacttggaaaacgtgtaaacgaagaaggtctagacattgttggtgttacaacttctattagaacagctgaacaagctaagtctttgggtattgttatcaaagatattgatgaagttgatcatattgatttaacaatcgatggtgctgacgaaatttcttctgatttccaaggaattaaaggtggcggcgcagctttactatatgaaaagattgttgcaactaaatctaataagaatatgtggattgtcgatgaaagtaaaatggtcgatgatctaggtcaattcccattaccagttgaagttatcccttatggtagtggtactgtctttaaacgttttgaagaaaaaggattaaatccaaaatttagaaaaaatgaagatggcagcttacttcatacagactctgataactatattatcgatcttcacttaggtaaaattgaaaatcctaaagaacttggagattacctaattaatcaagtaggagttgtcgaacacggattattcttagacatcgtaaatactgttattgttgggcgtcaagatggccctgaggttcttgaagccagataa

SEQ ID NO: 2415 - DNA, 684 bp, Lactobacillus salivarius
atgaaccaagatgaattaaagcaattagtaggtacaaaggcagttgaatggattaaagatggcatgatcgtcggtctaggaacaggttcaactgttaaatacatggttgatgcacttggaaaacgtgtaaacgaagaaggtctagacattgttggtgttacaacttctattagaacagctgaacaagctaagtctttaggtattgttatcaaagatattgatgaagttgatcatattgatttaacaatcgatggtgctgacgaaatttcttctgacttccaaggaattaaaggtggcggcgcagctttactatatgaaaagattgttgcaactaaatctaataagaatatgtggattgtcgatgaaagtaaaatggtcgatgatctaggacaattcccattaccagttgaagttatcccttatggcagtggtactgtctttaaacgttttgaagaaaaaggattaaatccagaatttagaaaaaatgaagatggcagcttacttcatacagactctgataactatattattgatcttcatttaggtaagattgaaaatcctaaagaacttggagattacctaattaatcaagtaggagttgtcgaacacggattattcttagacatcgtaaatactgttattgttgggcgtcaagatggccctgaggttcttgaagccagataa

SEQ ID NO: 2416 - DNA, 684 bp, Lactobacillus ruminis
atggatcaaaacgaacttaaaagccttgtcggcaaaaaatcggttgaatggatcaaagacggcatgactgtaggtcttggcaccggttcaaccgtctattacatggttgaagaactgggacgacgcgtcaaagacgaaaatcttaaaattacgggagttacgacttcgatcagaactgccaatcaagccaaaagtctcggaattccgctcaaatcggtcgacaccgttgatcatatcgatattacgattgacggagccgatgaaatttccagcgattttcaaggaatcaagggcggcggtgccgctttgctttacgaaaaaatcgttgcaacgaattccgacaaggtgatgtggatcgttgacgaaagcaagatggtcgataaattgggacggttcccgcttccggtcgaagttattccgtacggcagtcaaaaaatctttgaacgtttcgagaaaaaaggcttgaaccctgcattcagaaaagacgacaaggggggactgcttttgacggactcggacaactacatcatcgatcttcatctcggacaaatcgacaatccgcatgagcttgcagaatatctgattcaccaggtcggcgtcgttgaacatggtcttttccttgacatggtcgatacggtaatcgtcggtcgccaaaacggacctgaagttctcgaggcaaaatag

SEQ ID NO: 2417 - DNA, 684 bp, Lactobacillus plantarum
atgaatcaggatcagttaaaacaacttgttggtcaaaaagccgttgaatacattcaagacggcatgcaggtcggcctcggaaccggctcaaccgttaaattcatggttgatgctctgggtgaacgggtcaaaaatgaacatttaaacattgtcggcgtctcaacctccgaccgaaccgctgcccaagctaaggcgctcggtatcccgatgaaatccgttgacgaagtcgaccatctcgacttaacgatcgacggtgccgacgaaatcgccgatgatttccaaggcgttaagggtggtggcgccgccttactcttcgaaaaaatcgttgccatcaattctgataaagtcatgtggattgttgatgaaagcaaaatggtccatcaattaggtgcctttggcttacccgttgaagtgattccttacggcagccaacatgtctttgaaaaaatggctgcccggggctataacccagtattccgtaaagtcaacgatgaactcgtccggaccgattctaataatattatcatcgatttacacatcgacccaatcacggatccccacgctttagccgaagatttaattcacatggttggtgtggttgaacacggcctgttcttagacatggtcaacactgtcattgtcggtcatgccaatggtcccgaggttatcgaagcacgaccatag

SEQ ID NO: 2418 - DNA, 690 bp, Lactobacillus casei
atgaatcaaaatgacttgaagcagcaggctgctcagaaggcggcagaactagttaaagacggcatgacaattggtttagggaccggatcgacggtctattatcttgttaaagccattgcacagcgagtcgaaaccgaacatgtacagttgactggtgttgccactagtatccgcacgcgtgagcaggctgagtccttagggattcccatgaaagatttagatgaagtggatcatattgatttgacaattgatggtgcggacgaagttgataagcattttcaaggcattaaaggcggcggggcggcccacttaattgaaaaggtcgtcgcgattaattccgcgcaaaatatatggattgttgatgaatctaaactcgttgacacgctgggtaaatttccattaccgcttgaagtgattccatttggcagtggcaagctcgttcagcgtttagccaatgaagggctgaatcctgaatatcgactcactaatgatggagaaaaggtattgacagattcggataattttattgttgatcttcatttagggcgtattgagcatcctcatctgttagcttcttggttaaacgaacaagttgggttggttgaacatgggcttttccttgatgtagttaaaaaggtagtcgttggaacagagaacggaccaaagattttggatgcatatcgcggttaa

SEQ ID NO: 2419 - DNA, 690 bp, Lactobacillus paracasei
atgaatcaaaatgacttgaagcagcaggctgctcagaaggcggcagaactagttaaagacggcatgacaattggtttagggaccggatcgacggtctattatcttgttaaagccattgcacagcgagtcgaaaccgaacatatacagttgactggtgttgccactagtatccgcacgcgtgagcaggctgagtccttagggattcacatgaaagatttagatgaagtggatcatattgatttgacaattgatggtgcggacgaagttgataagcattttcaaggcattaaaggcggcggggcggcccacttaattgaaaaggtcgtcgcgattaattccgcgcaaaatatatggattgttgatgaatctaaacttgttgacacgctgggtaaatttccattaccgcttgaagtgattccatttggcagtggcaagctcgttcagcgtttagccaatgaagggctgaatcctgaatatcgactcactaatgatggagaaaaggtattgacagattcggataattttattgttgatcttcatttagggcgtattgagcatcctcatctgttagcttcttggttaaacgaacaagttgggttggttgaacatgggcttttccttgatgtagttaaaaaggtagtcgttggaacagagaacggaccaaagattttggatgcatatcgcggttaa

SEQ ID NO: 2420 - DNA, 690 bp, Lactobacillus rhamnosus
atggaccagaataagttgaagcaagaagccgctcaacgggcagcagagtttgttgaagacgggatgacaattggcttgggaacgggctcgacggttttttatctcgttgaagccattgcaaagcggattaaagaggagcatcttagtctgaatggtgtggccacaagcattcggacgcggaaacaggcggagtcgttggggatcccgatgaaagaactggacggggttgacaaaattgacctcaccattgacggtgccgatgaagtcgacaagcattttcagggtattaaaggcggcgggcgctcacatctgatcgaaaaaattgttgcgattaattcggcacgtaatatttggatcgtggacgaaaccaaactggtggacacacttggaaagtttccgttgccgctagaagtgattccgtttggtagtggcaagctgttacagcggttggcggatgaaggcctgaaaccagcttatcgtttgaatgaggatggcagcaaagctttgacggattctaagaattacattatcgatctgcatcttggccggatcgaacacccgcatttgttggcagaatggctcaataagcaggttgggattgtcgagcacggattgttccttgatctggttaaaacggtggttgtcggaacaacgcatggtccggaaattttggatgctcatcgtggatag

SEQ ID NO: 2421 - DNA, 690 bp, Lactobacillus rhamnosus
atggaccaagataagttgaaacaagaagccgctcaaaaggcagcggagtttgttgaagacgggatgacaattggcttgggaacgggttccacagtcttttatcttgttgaagccatcgctcagcggattaaagaagagcatcttagtttaaccggcgttgccaccagtgtccggacgcaaaaacaggcagaatcgttggaaattccgatgaaagcactggacgatgtggataaaattgatctgaccattgacggtgccgatgaagtcgacaagcactttcaaggcattaaaggcggtggccgttctcacttaatcgaaaagattgtcgcgattaattcggcacgtaatatttggatcgtggacgaaaccaaactggtggacacacttggaaagtttccgttgccgctagaagtgattccgtttggtagtggcaagctgttacagcggttggcggatgaaggcctgaaaccagcttatcgtttgaatgaggatggcagcaaagctttgacggattctaagaattacattatcgatctgcatcttggccggatcgaacacccgcatttgttggcggaatggctcaataagcaggttgggattgtcgaacacggcttgttccttgatctggttaaaacggtggttgtcggaacaacgcatggtccggagattttggatgcccatcgcggttag

SEQ ID NO: 2422 - DNA, 723 bp, Lactobacillus rhamnosus
atgaagataataaagcgaaaaggatggttaaccatggaccagaataagttgaagcaagaagccgctcaacgggcagcagagtttgttgaagacgggatgacaattggcttgggaacgggctcgacggttttttatctcgttgaagccattgcaaagcggattaaagaggagcatcttagtctgaatggtgtggccacaagcattcggacgcggaaacaggcggagtcgttggggatcccgatgaaagaactggacggggttgacaaaattgacctcaccattgacggtgccgatgaagtcgacaagcattttcagggtattaaaggcggcgggcgctcacatctgatcgaaaaaattgttgcgattaattcggcacgtaatatttggatcgtggacgaaaccaaactggtggacacacttggaaagtttccgttgccgctagaagtgattccgtttggtagtggcaagctgttacagcggttggcggatgaaggcctgaaaccagcttatcgtttgaatgaggatggcagcaaagctttgacggattctaagaattacattatcgatctgcatcttggccggatcgaacacccgcatttgttggcagaatggctcaataagcaggttgggattgtcgagcacggattgttccttgatctggttaaaacggtggttgtcggaacaacgcatggtccggaaattttggatgctcatcgtggatag

SEQ ID NO: 2423 - DNA, 723 bp, Lactobacillus paracasei
atgaaggcaactaagcgaaaaggatggttggccatggaccagaataagttgaagcaggaagccgcgcaaagagcagctgagtttgttgaagacggtatgacaattggtttggggacaggttcgacagtggtttatttggtcgaagcgattgcgcaacgaatcaaagacgagcatctcaatctcaccggtgtcgccaccagtgttcgtacgcgtaaacaagcagaatcgctgggcatcccaatgaaagcactggacgaggttggccagattgatttgacgattgatggcgccgatgaagtcgacaagcactttcagggtatcaagggtggcggccggtcgcacttaatcgaaaagatcgttgctatcaacacggcccgcaacatctggatcgtggatgaaaccaagttggtcgatacccttggcaaatttccactgccgcttgaagtgatcccttttggcagcggcaagctgttgcaacggttggccgacgaaggacttaaaccggcataccgcttaaatgaagatgggagcaaggcgttgacagattccaagaactatatcattgacttgcatctgggcaaaatcgagcacccgcatctgctggctgaatggctgaataagcaggtcggtattgtggagcacggcttgttcttagatttggtcaaaaccgtggtggttggcacaacacatggcccagagattctggacgcacatcgtggatag

SEQ ID NO: 2424 - DNA, 690 bp, Lactobacillus casei
atggaccagaataagttgaagcaggaagccgcgcaaagagcagctgagtttgttgaagacggtatgacaattggtttggggacaggttcgacagtggtttatttggtcgaagcgattgcgcaacgaatcaaagacgagcatctcaatctaaccggtgtcgccaccagtgttcgtacgcgcaaacaagcagaatcgctgggcatcccaatgaaagcactggacgaggttggccagattgatttgacgattgatggtgccgatgaagtcgacaagcactttcagggcatcaagggtggcggccggtcgcacttaatcgaaaagatcgttgctatcaactcggcccgcaacatctggatcgtggatgaaaccaagttggtcgatacccttggcaaatttccactgccgcttgaagtgatcccttttggcagcggcaagctgttgcaacggttggccgacgaaggacttaaaccggcataccgcttaaatgaagatgggagcaaggcgttgacagattccaagaactatatcattgacttgcatctgggcaaaatcgagcacccgcatctgctggctgaatggctgaataagcaggtcggtattgtggagcatggcttgttcttagatttggtcaaaaccgtggtcgttggcacaacacatggcccagagattctggacgcacatcgtggatag

SEQ ID NO: 2425 - DNA, 690 bp, Lactobacillus casei
atggaccagaataagttgaagcaggaagccgcgcaaagagcagctgagtttgttgaagacggtatgacaattggtttggggacaggttcgacagtggtttatttggtcgaagcgattgcgcaacgaatcaaagacgagcatttcaatctcaccggtgtcgccaccagtgttcgtacgcgtaaacaagcagaatcgctgggcatcccaatgaaagcactggacgaggttggccagattgatttgacgattgatggtgccgatgaagtcgacaagcactttcagggcatcaagggtggcggccggtcgcacttaatcgaaaagatcgttgctatcaactcggcccgcaacatctggatcgtggatgaaaccaagttggtcgatacccttggcaaattcccactgccgcttgaagtgatcccttttggcagcggcaagctgttgcaacggttggccgacgaaggacttaaaccggcataccgcttaaatgaagatgggagcaaggcgttgacagattccaagaactatatcattgacttgcatctgggcaaaatcgagcacccgcatctgctggctgaatggctgaataagcaggtcggtattgtggagcacggcttgttcttagatttggtcaaaaccgtggtcgttggcacaacacatggcccagagattttggacgcacatcgtggatag

SEQ ID NO: 2426 - DNA, 684 bp, Lactobacillus sakei subsp. sakei 23K
atggataagaatgcaatgaaaaaaatggccgctgaacgttcagtggactacgtcgaagataatatgattttaggactcgggactggctcaactgtcgtgtacatggtcgaagcactcgctaaacgtgtgaaagccgaaaacctccacctaacttgcgtctgcacatcaatcagaaccgcagaacaagcaacatcgctcggcatcccggttaaagcgctcaacgaagtcgatcatatcgatttaacaattgatggtgccgatgaagttgatgataacttccaagggattaaaggcggtggcgctgcccacttatttgaaaaactagtggcaacaacctcaacccgcaacatctggattgttgatgaagaaaaagtagtcgatacaatcggccgcttcccactccccgttgaagtgattccttttggcagtcaacaagttttcaacaagttcgttaaagaaggcctcaacccagaattcagaacaaccgaagacggccaacgcgtcttaacggattcaaaaaatgaagtgattgatctgcaccttgaaaaaatcacacatccccacttactagcaacttggttaagcgaacaagtcggcgtcgttgaacacggcctattcttagacctcgtcaacgaagtcgtagtaggctcaccagaaggcgtcaaaatcttaaaagcaagataa

SEQ ID NO: 2427 - DNA, 684 bp, Leuconostoc citreum
atgagccaagcattacaaaaaattattgctggtcgtcgcgccgctgaatttgttcaaaatggcatggttgtcgggattgggtctggctcaaccattgcccatgtcatcgaagcacttggtgaacgtgtcgcgcaagaacaacttaacattgttggcgtagcgacttctgaaaaaacacgccgcaatgcagcacaactgggaattcccatgtacaatgtcgatgatattgataaaatcgatttaactattgatggtgctgatcaaattgccgatgacttttcagccattaagggcggtggcgctgcattattatgggaaaaaatcgtcgccttcaactcacgacaaaatatttgggttgttgatgaaacaaaacgtgtcactaaactgaaccaatatctacctgttgaagtaatcccatatggcgctaaccaactgtttaagcgttttcaagcagatggttttcacccaacatggcgtttagaccaaaacggtaatcctgtaagaactgattcagctaattttttaattgatttacatttaccaatgattgataatcctcgtgatttgggggatgaactcatcaagatggtcggtgttgtcgagcatggcctgttcactgatgtcgttaaccgtgtcattatcggcacagattcacaaacagcaaaagtaattgatgttaaataa

SEQ ID NO: 2428 - DNA, 687 bp, Leuconostoc mesenteroides
atgagttcatcacaggatttacaaaaaattattgcaggtcgccgcgccgccgactttgttcaggacggtatggtagtgggcattggctctggatcaacaattgctcaagtcattaccgctttaggtgaacgcgtggccaatgaaaatttaaaaatcgtcggcgtccctacttctgaaaagacaaggcgcaatgctgcaaaactagggatcccgatgtacaacgttgatgatgtcgataaaattgatcttacaattgatggagctgaccaaatttcggatgatttctcagccattaaaggtggcggggccgcgcttttatgggaaaaaatcgttgcgtttaactctcgtgagaatatctgggttgtagacagtagcaaacgtgtatccaaactaaatcagtatttgccagtcgaaattattccatatggatctgaccaattatttaaacgctttactgcagatgggttccatcctacttggcgtttagatcaaaatggcaaccctgtacgtacagattcagcaaattacctcattgatctacatgttcccgttatcgaagatccacgtgatttgggtcaagaattaattaatatggtcggtgttgtagagcacggtctgttcactgatgttgttaaccgtgtagtcattggtagtgatgatggcgttgaaattattgaagcaccgtaa

SEQ ID NO: 2429 - DNA, 702 bp, Weissella paramesenteroides
atggcagatcaaactgcacttaaaaaattagccggttatcgtgcagctgaattcgttgaagatggtatggtggtaggtattgggtcaggttcaaccattgcctttgttgtcgaggcgctaggtaagcgtgtggcggaagaaggattgcaaatcaaggggattcctacttctgataaaacgcgtcgtaccgcggcaaaacttggcattcccatgcataatgttgatgatgttgaccacattgatttgacaatcgacggtgctgatcaaattgatgagaattttgcagcaatcaagggtggtggagccgctttactttgggagaaaatcgttgccgttaattcacgtcgtaatatttgggtcgttgatgacacaaaattagcaccacaattgactcattatcttcctgtagaagtcatcccctatggtgctgatcaactatttaagcgtttgaaatatgctggttaccaaccaacttggcgcttggaccaaaatggcaacccagttcggacagactcagccaattacttaattgatttgcattttactaaaatgcctgatccttttaaattgggacgtgagttgactagtatggtcggtgttgtagaacatggcttgttcctaaatattgttgaccaagttgttgttggtcgtgcagatgagacgattgctgtttttgatgctcaccccaaacccttaatctaa

SEQ ID NO: 2430 - DNA, 684 bp, Lactobacillus reuteri
atggatcaaaatgcattaaaagaacaaacaggtaaggaatcagttaagtacattaaatctgggatgattgtcggtctcggaactggatcgactgttaaatatatggttgatgagcttggtaagcaagtccaagaaggtaaaatcaaagatatcatcggtgtaacgacttcaaaccgaactgctaaacaagcacgcgacctcggaattacaattaaagatattgatgacgttgaccacatcgatttaactattgacggggcagatgaaatcagtgatgacttccaaggaatcaaaggtggcggtggcgccctcctttgggaaaagatcgttgccaatgcctcaaataaagtaatgtggattgtcgatgaaagcaaactcgtccacaaacttggcgctttcccccttcctgttgaagtaattccattcggttctcaacatgtctttgaccgtcttgaaaagaaaggctacaagccaacttggcggatggatggagataaaaagttccgtactgatgaaaataactatattattgaccttcatcttggcgaaattgatgatcctaaggccttagctgacgaattgatccacatggttggaattgttgaaactggtttattcttaaatcgagttaacgacgtaattgttggtacttcagaaggtccaaaggtattgcacgctcgttaa

SEQ ID NO: 2431 - DNA, 684 bp, Lactobacillus reuteri
atggatcaaaatgcattaaaagaacaaacaggtaaggaatcagttaagtacattaaatctggaatgattgtcggtctcggaactggatcaactgttaaatatatggttgatgaacttggtaagcaagtccaagaaggtaaaatcaaagacattatcggtgtaacaacttcaaaccgaactgctaagcaagcacgcgacctcggaattacaattaaagatattgatgacgttgaccacatcgatttaactattgacggggccgatgaaatcagtgatgacttccaaggtatcaaaggtggcggtggcgccctcctttgggaaaagatcgttgccaatgcctcaaataaagtaatgtggattgtcgatgaaagcaaactcgtccacaaacttggcgctttccctcttcctgttgaagtaattccattcggttctcaacatgtctttgaccgtcttgaaaagaaaggttacaagccaacttggcggatggatggagataaaaagttccgtaccgatgaaaataactatatcattgaccttcaccttggcgaaattgatgatcctaaggccttagccgacgaattgatccacatggttggaattgttgaaactggtttattcttaaatcgagttaacgacgtaattgttggtactccagaaggtccaaaggtattacacgcccgttaa

SEQ ID NO: 2432 - DNA, 684 bp, Lactobacillus antri DSM 16041
atgaatcaagacgaattaaaagcacaaacgggacgggaatctgtcaagtacatccagtccggcatgattgtcggcctcggtaccggatccacggtccgctacatggtcgacgagctcggcaagcaggttcaggaaggcaagctcaccgacattatcggggtgacgacttccacccggaccgctaagcaggcccgcgacctggggattaccatcaaggatattgatgacgttgaccacatcgacctgtgtatcgacggggccgacgaggtcagcgacgatttccagggcatcaagggtggcggtggcgccctcctctgggaaaagatcgttgccaacgcctccaacaagattatttggatcgtggacgaaagcaagctggttcacaagcttggcaagtttccgttgccggtcgaagtaatcccctttggtgcccagctggtctttaaccggctggaaaagaagggctacaagccaagctggcggatggacggcgaccacaagttcctgactgacgagaagaactacattatcgacctccacttaggagaaatcgaccacccagtggaactggccgacgagctgatccacatggttgggctcgttgaaaccggcctcttcttaaaccgggttaacgacgtcatcgtcggtacccaagacggtcccaaggtgctgcacgcacggtaa

SEQ ID NO: 2433 - DNA, 681 bp, Lactobacillus fermentum
atggatcaaaatgaattaaaagcactcgttggaaaagaagccgttaagtacgttgaagatggtatgatcgttgggttggggaccgggtcaaccgttcgcttcatggtggatgccctaggtgaacgagttaaaaacgaaggtttgaagatcgttggggtgactacttcacgtcggacaaccaagcaagcaactgaactggggatcacgatcaaagatattgatgaagttgatcacgttgaccttaccattgatggtgccgatgaagtgagcaacgatttccaaggtattaaggggggcgggggcgccctgctttgggaaaaggtcgttaacgatgcctcaaccaagaatatttggattgttgacgaatcaaagttagttgataagcttggcgactttggggtaccagtagaagtaatcccgtttggggcggcccacgttttccgcaagtttgaaaagaagggctaccaaccgcagtggcggatggacggggataaccgttacctgactgacgaaaagaactacattatcgacctcaagatggggaagattgattccccgaagaccctagctgaggaccttattcacaccgtgggcgttgttgaacacggtctcttcttggatcgggtcaacgaagtaatcgttggtcgccaagacggcccggaagttctacacgcgcgataa

SEQ ID NO: 2434 - DNA, 681 bp, Lactobacillus fermentum
atggatcaaaatgaattaaaagcactcgttggaaaagaagccgttaagtacgttgaagatggtatgatcgttgggttggggaccgggtcaaccgttcgcttcatggtggatgccctaggtgaacgagttaaaaacgaaggtttgaagatcgttggggtgactacttcacgtcggacaaccaagcaagcaactgaactggggatcacgatcaaagatattgatgaagttgatcacgttgaccttaccattgatggtgccgatgaagtgagcaacgatttccaaggtattaaggggggcgggggcgccctgctttgggaaaaggtcgttaacgatgcctcaaccaagaatatttggattgttgacgaatcaaagttagttgataagcttggcgactttggggtaccagtagaagtaatcccgtttggggcggcccacgttttccgcaagtttgaaaagaagggctaccaaccgcagtggcggatggacggggataaccgttacctgactgacgaaaagaactacattatcgacctcaagatggggaagattgatgccccgaagaccctagctgaggaccttattcacaccgtgggcgttgttgaacacggtctcttcttggatcgggtcaacgaagtaatcgttggtcgccaagacggcccggaagttctacacgcgcgataa

SEQ ID NO: 2435 - DNA, 684 bp, Lactobacillus coleohominis 101-4-CHN
atggatcaaaatgaattaaaagcccaagtgagtaaggaagccgttaagtacattcaagacggcatgatcgttggactaggaaccggttcaaccgtgcgttatatggtcgacgcccttggtgaacgggttaaaaatgaaggcctcaagattatcggggtaactacctctaaccgcaccactaagcaagccgaatcacttggtattactatcaaggacattgatgatgttgatcacattgacctttgtatcgatggggctgacgaagtcgatgatgactttaatgggatcaaagggggcggtggcgccctgctttgggaaaagatcgttaataacgcctcaactaaaaagatctggattgttgatcaatccaagttagttccccggattggggactttggggttccagtggaagtcatcccgtttggatctcaacacgtttttaacaccttcgaaaagaagggttacaagcctgtttggcgaatggatggcgaccataagtaccgtactgacgaaaataacttcatcattgatatccaccttggtcaaatcgatgatcctcatgctcttgcggaagatctcattcacaccgttggggtggttgaacatggtttgttcctgaaccgggttgatgatgtgattgttggtcgtgacaacggccccgaagttctacacgcaacgaaatag

SEQ ID NO: 2436 - DNA, 693 bp, Lactobacillus vaginalis
atgaatcaagatgagctaaaacaacaagttggccgtgaagcagttaagtacattcatccaggaatggttgtcggcctaggaacagggacaaccgttcattgcttggtggaagcactcggtgagcatgttaagaatggtgatttatcagatgttgtttgtgttacaacctcaaacagaactactcgccaagctcaaagtcttgggatcaaggttgaagaaattgacgatgttgatcatattgaccttactattgatggtgctgatgagattagtgacgatttccaaggaattaagggtggcggtggcgctctcctttgggaaaagattgtttccaactattctgaccacgtaatgtggattgttgatgaatcaaaattagttcatcacttaggagcttttccgctaccagtggaagttaccccatacggaagtcaacacctctttaccaaactagctcgtcgtggctataacccaacatggcggatgctgcctgataacagtgataagttccggacacaccagcgaaacttcattattgatttgcatcttgaggacattaacgatcccttcgcccttcacgaagaattaatcgggatggttggtttaattgaagatggactgttcttaaaccaagttaatgatgttcttgttggtacccaagacggtccaaagttccttcatgcccgtccataa

SEQ ID NO: 2437 - DNA, 687 bp, Lactobacillus fermentum
atgaaccaacaagacagtttaaaacaattggttggccaaactgccgccaagctcgttaaaaacggcatgatcgttgggctgggcaccggctccaccgttcgttttttagttgacgccctaggcaaacgggtccaagaagagggcctagcaattactggggtcaccacctccaaccggacgaccgcccaggccacttccctggggatcaaaatcgttgacctcgatgacgtcgaccacgttgacctgacgattgacggcgccgatgaagtcgaccgggacttttatggtatcaaggggggcgggggtgccctcttgtgggaaaagatcgtcaacgacgcctcaaccaataacgtgtggattgttgaccaatccaaggtggttgaccggattggcgccttcggggtcccggtggaagtgatcccgtttggtgcaagcaaggtctttgcgaagtttgagcaccagggttaccagccacaatggcgaacggacgaagcgggtcaattataccggactgatgaaaacaactacatcatcgacctcaaactggggccgttaaccgacccgctggccctggctgaagatctcattaacacggttggggtggttgaatacggtctcttcttaaaccgggtcaaccaagtgatcgtcggtaatgaggccgggattaccaccctcaccgctccctaa

SEQ ID NO: 2438 - DNA, 687 bp, Lactobacillus fermentum
atgaaccaacaagacattttaaaacaattggttggccaaactgccgccaagctcgttaaaaacggcatgatcgttgggctgggcaccggctccaccgttcgttttttagttgacgccctaggcaaacgggtccaagaagagggcctagcaattactggggtcaccacctccaaccggacgaccgcccaggccacttccctggggatcaaaatcgttgacctcgatgacgtcgaccacgttgacctgacgattgacggcgccgatgaagtcgaccgagacttttatggtatcaaggggggcgggggtgccctcttgtgggaaaagatcgtcaacgacgcctcaaccaataacgtgtggattgttgaccaatccaaggtggttgaccggattggcgccttcggggtcccggtggaagtgatcccgtttggtgcaagcaaggtctttgcgaagtttgagcaccagggttaccagccacaatggcgaacggacgaagcgggtcaattataccggactgatgaaaacaactacatcatcgacctcaaactggggccgttaaccgacccgctggccctggctgaagatctcattaacacggttggggtggttgaacacggtctcttcttaaaccgggtcaaccaagtgatcgtcggtaatgaggccgggattaccaccctcaccgctccctaa

SEQ ID NO: 2439 - DNA, 687 bp, Lactobacillus fermentum
atgaaccaacaagacagtttaaaacaattggttggccaaactgccgccaagctcgttaaaaacggcatgatcgttgggctgggcaccggctccaccgttcgttttttagttgacgccctaggcaaacgggtccaagaagagggcctagcaattactggggtcaccacctccaaccggacgaccgcccaggccacttccctggggatcaaaatcgttgacctcgatgacgtcgaccacgttgacctgacgattgacggcgccgatgaagtcgaccgggacttttatggtatcaaggggggcgggggtgccctcttgtgggaaaagatcgtcaacgacgcctcaaccaataacgtgtggattgttgaccaatccaaggtggttgaccggattggcgccttcggggtcccggtggaagtgatcccgtttggtgcaagcaaggtctttgcgaagtttgagcaccagggttaccagccacaatggcgaacggacgaagcgggtcaattataccggactgatgaaaacaactacatcatcgacctcaaactggggccgttaaccgacctgctggccctggctgaagatctcattaacacggttggggtggttgaacacggtctcttcttaaaccgggtcaaccaagtgatcgtcggtaatgagaccgggattaccaccctcaccgctccctaa

SEQ ID NO: 2440 - DNA, 699 bp, Bifidobacterium adolescentis
atggacaaggcacagcaggacgcgctgaagaaggcggccggcatcgaggctgcaaagctgattcagaacggcatgatcgcaggtctgggcaccggctcgaccgtgcgtttcctggtcgacgagctcggtcgtcgcgtcaaggaggaaggcctcgagttcacgggcgtcaccacctcccgccgcacccaggagcaggccgaaggctacggcatcaagatcgtcaacatcgatgacgtcgaccatatcgacgtgaccatcgacggcgccgacgaggtggacaagaacttcaacggcatcaagggcggcggtgcggctctcctgtgggagaagatcgtggccaccaactccaacaagatcgtgtggatcgtggacgagtccaaggtcgtggacaccatcggcaagttcccgctgccggtcgaggtgattccgttcggcgcaggccaggtcgtcaagaagttcgaggccaagggctacaagccggtgctgcgtctcgacgcgaacggcgagccggtgcgcaccgatgagaacaactatgtggtggatctgcacctcgagcgcatcgaccacccgcaggagctcgcgcaggacctcatcaccacggtcggcgtggtcgagcacggcctgttcctgaacatggtggaccaggtcatcgtcggcgatccgaacggcccgcgcgtgatggacaaccccaacaagtga

SEQ ID NO: 2441 - DNA, 867 bp, Bifidobacterium adolescentis
atgcgcggcttttttgcacgccacctcacgcaggaccgtgaaacattccgtgaaaacttttccgcagtccaaaacagacacctgctcccgcaaccgaccattcgcgccttgaaaatcaacgcatccgatagtatggagacggtcttaaccccatatcgaaggaggatcatggacaaggcacagcaggacgcgctgaagaaggcggccggcatcgaggctgcaaagctgattcagaacggcatgatcgcaggtctgggcaccggctcgaccgtgcgtttcctggtcgacgagctcggtcgtcgcgtcaaggaggaaggcctcgagttcacgggcgtcaccacctcccgccgcacccaggagcaggccgaaggctacggcatcaagatcgtcaacatcgatgacgtcgaccatatcgacgtgaccatcgacggcgccgacgaggtggacaagaacttcaacggcatcaagggcggcggtgcggctctcctgtgggagaagatcgtggccaccaactccaacaagatcgtgtggatcgtggacgagtccaaggtcgtggacaccatcggcaagttcccgctgccggtcgaggtgattccgttcggcgcaggccaggtcgtcaagaagtttgaggccaagggctacaagccggtgctgcgtctcgacgcgaacggcgagccggtgcgcaccgatgagaacaactatgtggtggatctgcacctcgagcgcatcgaccacccgcaggagctcgcgcaggacctcatcaccacggtcggcgtggtcgagcacggcctgttcctgaacatggtggaccaggtcatcgtcggcgatccgaacggcccgcgcgtgatggacaaccccaacaagtga

SEQ ID NO: 2442 - DNA, 795 bp, Bifidobacterium dentium
atgccgaacgtggcgcccatgacatggctcaagccgccaaaaatcagcgcatccgatagtatggaaccggtcttaatcccatatcgaaggagcattatggacaaggcacagcaggatgcactgaagaaggcggccggcatcgaggctgccaagttgattcagagcggcatgatcgcaggcctgggcaccggctcgaccgtacgtttcctggtcgacgagctcggtcgtcgcgtcaaggaggagggtctcgagttcacgggcgtcaccacctcccgccgcacccaggagcaggccgaaggctacggcatcaagatcgttgacatcgatgacgtcgaccatatcgacgtgaccatcgacggcgccgacgaggtcgacaaggacttcaacggcatcaagggcggcggcgccgccctgctgtgggagaagatcgtggccaccaactccaacaagatcgtatggatcgtcgacgagtccaaggtcgtcgacaccatcggcaagttcccgctgccggtcgaggtgattccgttcggcgcaggccaggtcatcaagaagttcgaatcccgtggttacaagccggtgctgcgccttgacgccgaaggccagccggtgcgcaccgacgagaacaactatgtggtcgatctgcatctcgagcgcatcgaccatccggaggatctggccgaagacctcatcaccaccgtcggtgtggtggagcacggcctgttcctgcacatggtcgatcaggtcatcgtcggcgatccgaacggcccgcgcgtcatgaccaactccaacaagtga

SEQ ID NO: 2443 - DNA, 735 bp, Bifidobacterium pseudocatenulatum
atggagacggtcttaaccccatatcgaaggaggatcatggacaaggcacagcaggacgcattgaagaaggcagccggcatcgaagctgccaagctgattcagaacggcatgatcgcaggtctgggcaccggctcgaccgtgcgcttcctggtcgacgagctcggccgccgcgtgcaggaggaaggcttggagttcaccggcgtgaccacctcccgccgcactcaggagcaggcagaaggctacggcatcaagatcgtcgacatcgatgacgttgatcacatcgacgtgaccatcgacggcgccgacgaggtcgacaagaacttcaacggcatcaagggcggcggcgccgctctgctgtgggagaagatcgtggccaccaactccaacaagatcgtgtggatcgtggacgagtccaaggttgtggacaccatcggcaagttcccgctgccggttgaggtgattccgttcggcgcaggccaggtcgtcaagaagttcgaatcccgcggctacaagccggtgcttcgcctcgacgccgaaggccagccggtgcgcaccgacgagaacaactacgtggtcgatctgcacctcgaatgcatcgaacacccggaggctctggccgacgatctcatcaacaccgttggcgtggtggagcatggcctgttcctgcacatggtggaccaggtcatcgtgggcgatcccaacggtccgcgcgtgctcaccaactccaacaagtga

SEQ ID NO: 2444 - DNA, 735 bp, Bifidobacterium catenulatum
atggagacggtcttaaccccatatcgaaggaggatcatggacaaggcacagcaggacgcattgaagaaagcagccggcatcgaagctgccaagctgattcagaacggcatgatcgcaggtctgggcaccggctcgaccgtgcgtttcctagtcgacgagctcggccgccgcgtacaggaggaaggcctggagttcaccggcgtgaccacttctcgccgcacccaggagcaggccgaaggctacggcatcaaaatcgtcgacatcgatgatgttgatcacatcgacgtgaccattgacggcgccgacgaagtcgacaagaacttcaacggcatcaagggcggcggcgctgccctgctgtgggagaagatcgtggccaccaactccaacaagatcgtgtggatcgtggacgaatccaaggtcgttgacaccattggcaagttcccgctgccggtcgaggtgattccgttcggcgcaggccaggtcgtcaagaggttcgaagcacgcggatacaagccagtgctgcgcctcgacgccgaaggtaagccggtgcgtaccgacgaaaacaactatgtggtcgacctgcacctcgagcgcatcgaacatccggaagctctggccgatgacctcatcaacaccgtcggcgtggtggagcacggcctgttcctgcacatggtggatcaggtcatcgtgggcgacccgaacggcccacgcgtgctcaccaactccaacaagtga

SEQ ID NO: 2445 - DNA, 726 bp, Bifidobacterium bifidum
atgcacggacatttcaaggagtacatgatggacaaggcacagcaggatgcactgaagaaggcggccggcatcgaagccgccaagctgatcgagaacggcatgatcgccggtctcggaaccggttcgaccgtgcgtttcctggtcgatgagctcggccgccgcgtcaaggaggagggcctgcagttcaccggcgtgacgacctcccgtcgcacgcaggagcaggccgaaggttacggcatcaagatcgtggacatcgatgatgtggatcatatcgacatcaccatcgacggcgccgacgaggtggacaagaacttcaacggcatcaagggcggcggcgccgcactgctgtgggagaagatcgtggccacgaactccaacaaaatcgtgtggatcgtggacgagtccaaggtcgtcgacaccatcggcaagttcccgctgccggtcgaggtgattccgttcggcgccggccacgtcatcaagcagttcgaggccaagaactacaagccggtgctgcgcctcgacgccgacggcaaggaagtgcgcaccgacgagaacaacttcgtcgtggacctgcatcttgagcgcatcgaccacccgcaggatctcgccgaggacctgatcaacacggtcggcgtcgtcgagcacggcctgttcctcaacatggtcgacaaggtcatcgtcggcgaccccaacggcccacgcgtaatgaccaacggcaacaagtga

SEQ ID NO: 2446 - DNA, 699 bp, Bifidobacterium longum
atggataaggcacagcaggatgcgctgaagaaggcggccggcatcgaagccgccaagctcgttgaaaacggcatgatcgcaggcctcggcactggttcgaccgtgaagttcctggtggacgagctcggccgccgtcatcaggaggaaggtcttgagttcactggcgtaaccacgtctcgccgcacgcaggtccaggctgaaagctacggcatcaagatcgtggacatcgacgacgtggaccacatcgacgtgaccattgacggcgccgacgaagtcgacaagaacttcaacggtatcaagggcggtggcgctgctctgctgtgggagaagatcgtggccaccaactccaaccagatcgtgtggattgtggacgagtccaaggttgtggacaccatcggcaagttcccgctgccggtcgaggtcattccgttcggtgccggccaagtcatcaagaagttcgaggcccgcggctacaagccggtgcttcgtcttgacgccgacggcaaggaagtgcgcaccgacgagaacaacttcgtggtggacctgcacctggagcgcatcgatcacccgcaggagctggccgaagacctcatcaacacggtcggcgtggtggagcacggcctgttcctcaacatggtcgacaaggtcatcgtcggcgacccgaacggcccgcgcgtgatgaccaacgccaacaagtga

SEQ ID NO: 2447 - DNA, 699 bp, Bifidobacterium longum
atggataaggcacagcaggatgcgctgaagaaggcggccggcatcgaagccgccaagctcgttgaaaacggcatgatcgcaggcctcggcactggttcgaccgtgaagttcctggtggacgagctcggccgccgtcatcaggaggaaggtcttgagttcactggcgtgaccacgtctcgccgcacgcaggcccaggccgagagctacggcatcaagatcgtggacatcgacgacgtggaccacatcgacgtgaccattgacggcgccgacgaagtcgacaagaacttcaacggcatcaagggcggcggcgctgctctgctgtgggagaagatcgtggccaccaactccaaccagatcgtgtggatcgtggacgagtccaaggttgtggacaccatcggcaagttcccgctgccggtcgaggtcattccgttcggtgccggccaagtcatcaagaagttcgaggcccgcggctacaagccggtgcttcgtcttgacgccgacggcaaggaagtgcgcaccgacgagaacaacttcgtggtggacctgcacctggagcgcatcgatcacccgcaggagctggccgaagacctcatcaacacggtcggcgtggtggagcacggcctgttcctcaacatggtcgacaaggtcatcgtcggcgacccgaacggcccgcgcgtgatgaccaacgccaacaagtga

SEQ ID NO: 2448 - DNA, 699 bp, Bifidobacterium longum
atggataaggcacagcaggatgcgctgaagaaggcggccggcatcgaagccgccaagctcgttgaaaacggcatgatcgcaggcctcggcactggttcgaccgtgaagttcctggtggacgagctcggccgccgtcatcaggaggaaggtcttgagttcactggcgtgaccacttcccgccgcacgcaggcccaggccgagagctacggcatcaagatcgtggacatcgacgacgtggaccacatcgacgtgaccattgacggtgccgacgaagtcgacaagaacttcaacggcatcaagggcggcggcgctgctctgctgtgggagaagatcgtggccaccaactccaaccagatcgtgtggattgtggacgagtccaaggttgtggacaccatcggcaagttcccgctgccggtcgaggtcattccgttcggcgctggccacgtcatcaagaagttcgaggcctgcggctacaagccggtgcttcgtcttgacgccgacggcaaggaagtgcgcaccgacgagaacaacttcgtggtggacctgcacctggagcgcatcgatcacccgcaggagctggccgaagacctgatcaacacggtcggcgtggtggagcacggcctgttcctcaacatggtcgacaaggtcatcgtcggcgacccgaacggcccgcgcgtgatgaccaacgccaacaagtga

SEQ ID NO: 2449 - DNA, 699 bp, Bifidobacterium angulatum
atggataaagcacaacaggacgcaatgaagaaggcagccggcatcgaagccgccaagcttgttcacaacggcatgatcgccggactcggcaccggttccaccgtaaggttcctggtggatgagctcggccgccgcgtgcaggaggaaggactgcagttcaccggcgtcaccacctcccgccgcacgcaggaacaggccgaaagcttcggcatcaagatcgtggacatcgatgacgtcgatcacatcgatgtgaccatcgacggcgccgatgaggtcgacaaggacttcaatggcatcaagggcggcggcgccgcactgctgtgggagaagatcgtggcgaccaattccaacaagatcgtctggatcgtcgacgaatccaaggtggtggacaccatcggcaagttcccgctgcccgtcgaggtgattccgttcggcgccggccaggtcgtcaagaagttcgaagccaagggctataagccagtgctgcgactggatgcggacggcaaggaagtacgcaccgacgagaacaacttcgtggtcgatctgcatcttgaacgcatcgaccacccgaccgagctggccgaggatcttatcaacaccgtgggcgtcgtggaacacggcctgttcctcaacatggtcgacaccgtgatcgtgggcaaccctgacggcccgcgcatcctgaccaattccaacaagtga

SEQ ID NO: 2450 - DNA, 699 bp, Gardnerella vaginalis
atggataaagcacagcaagatgctcttaagaaggcagctggcattgaggccgcaaaaatcgtacaaaatggcatgatggttggacttggaaccggctctactgttcgttttcttgtagacgaactcggtcgcagagtaaaagaagaaggcttgagcttcactggtgtcacaacttctcgacgcacgcaagagcaggcagagggctacggcattaagattcttgacattaacgatgttgaccatattgacgttactattgatggttcagatgaagtcgataaaaactttgacggtattaagggcggcggtgcagcattgctctgggagaagattgttgcaattaactccgaccgcattgtgtggattgtggacgccagcaaggtagttgatacaatcggcaagttcccacttcctgttgaggtaattccattcggatctgcacaagtgattcgcaagtttgaaaagcgcggatacaagccagttttgcgtcttgatgcagatggcaaggaagtgcgtacagacgaaaataactttgttgttgacttgcacttggagcgcattgagcacccgcaagagcttgctaaggatttgattgagactgttggcgttgtagaacacggattgttcttgaatatggttgacactgtgattgttggtgatccaaacggtccgcgcactcttacaaacccaaataagtaa

SEQ ID NO: 2451 - DNA, 699 bp, Bifidobacterium gallicum DSM 20093
atggataaggcgcaacaggatgcattgaaaaaagcggccggcatcgaagcggccaagctcgtcaaggacggcatgatcgtgggactcggcacgggctcgaccgtgcgtttcctcgtcgatgagctcggccgccgtgtgcaggaggaaggcctgcagttcactggcgttaccacctcgcgccgcacgcaggagcaggctgaaggctacggcatcaagatcgtgaacgtggacgatgtggaagaaatcgacgtgacgattgatggcgccgacgaagtcgatgacaacttcaacggcatcaagggcggtggcgcagcgctgctgtgggaaaagatcgtggccatcaactcgaagaagatcgtctggattgtcgatgaatcgaaggttgtggaaaccatcggcaagttcccgctgcctgtggaagtgattccgttcggtcatggccatgtggtcgaaaagatggaaaagaagggctacaagcccgtgctgcgcctcgacgctgacggcaaccccgtgctgaccgatgaaaagaactatgtggtcgatttgcacctcgagaaaatcgaaaagccgttcgagctgcaggaagacttgatcaacatggtgggcgttgtggaaacgggcctgttcctgaacatggttgacgaagtcatcgttggcgacccggatggcccgcgcatcctgacgaacccgaacaagtga

SEQ ID NO: 2452 - DNA, 702 bp, Bifidobacterium animalis
atggataaagcacagcaggatgcaatgaagaaggaggccggcatcgaggccgcgaagctggtcaaaagtggcatgatcgtggggctcggcaccggttccaccgtgcgcttcctcgtcgacgaactcggccgccgcaagcaggaggaaggtctggagttcaccggcgtcaccacttcgcgccgcacgcaggagcaggccgagggctacggcattaagatcgtgaacatcgacgacgtcgaccacatcgacctgtgcatcgacggagccgacgaggttgacaagaacttcaacggcatcaagggcggcggcgcggccctcctgtgggagaagatcgtggcgatcaactcgaacaggatcgtctggatcgtcgacgcctccaagctcgtcgacgtcattggcaagttcccgctgccggtggaggtcattccgttcggcgccatgcatgtgatcgagcgcatgaaggaacgcggctacaacccgacgctgcgtcttgacgccgaaggcaagccggtgcgcaccgacgagaacaactacgtcgtcgacctgcatctcgagcgcatcgacgacccggcaggtctcaacgaggatctcatcaacatggtgggcgtcgtcgaagacggcctgttcctcgacatggtcaacgaggtcatcgtgggcgatccgaacggcccgcgcacgctcatcaatccgaacaaggcgtga

SEQ ID NO: 2453 - DNA, 723 bp, Lactobacillus brevis
atgagtacgatcaattcagagcttcagaacaagttaaaaaaagctgcggcggttaaagctgcagattatgttaaagacggtatgattgttggtcttggaagtggctcaacggttacaatgctggtcgatgagttgggacgacgggttcaggaaaaaggcctgaaatttacgggcgtttccacgtcaatttcaacagcgaagcaggctgaatcactgggaataaaaattgttgatttggattcgattgacgcaattgatttaaccattgatggtgccgaccaggttgatagtgatttcaacggtattaaaggcggtggtggaaacctgctttgggaaaagattgtggctgccaattctaaaaagcttatttggatcgtagacaaatccaaagttgttgaccgaatcggcgcatttccactagctgttgacgtagaacctttcggtagtcatcatgttttgaaaaagttttccgatgccggattcaatccggttgtcaggactgataaggacggtaaggtctttaaaacggactcaaataacatcattttggatctccacctgcatgaaattaacaaccccgataaactggccgataccttaattaacacggttggcgtggttgaacacggtttgtttttaaatgcggttaatgaggttgttgtgggcaaagaaggagcccctcagatcctgattaatcctaaagctgatccatcctataaataa

SEQ ID NO: 2454 - DNA, 723 bp, Lactobacillus hilgardii
atgagtacgatcaattcagagcttcagaacaagttaaaaaaggctgcggcggttaaagctgcagattatgttaaagacggtatgattgttggtcttggaagtggctcaacggttacaatgctggtcgatgagttgggacgacgggttcaggaaaaaggcctgaaatttacgggcgtttccacgtcaatttcaacagcgaagcaggctgaatcattgggaataaaaattgttgatttggattcgattgacacaatcgatttaaccattgatggtgccgaccaggttgacagcgattttaatggtattaaaggcggtggtggaaacctgctttgggaaaaaattgtggctgccaattctaaaaagcttatttggatcgtagacaaatccaaagttgttgaccgaattggtgcctttccactagctgttgacgtagagcctttcggcagtcatcatgttttgaaaaagttttccgatgccggattcaatccggttgtcaggactgataaggacggcaaggtctttaaaacggattcaaataacatcattttggatcttcacctgcatgaaattaacaaccccgataaactggccgataccttaattaacacggttggcgtggttgaacacggtttgtttttaaatgcggttaatgaggttgttgtgggcaaagaaggagcccctcagatcctgattaatcctaaagctgatccatcctataaataa

SEQ ID NO: 2455 - DNA, 723 bp, Lactobacillus buchneri
atgagtacgatcaattcagagcttcagaacaagttaaaaaaggctgcggcggttaaagctgcagattatgttaaagacggtatgattgttggtcttggaagtggctcaacggttacaatgctggtcgatgagttgggacgacgggttcaggaagaaggcctgaaatttacgggcgtttccacgtcaatttcaacagcgaagcaggctgaatcattgggaataaaaattgttgatttggattcgattgacacaattgatttaaccattgatggtgccgaccaggttgacagcaattttaatggtattaaaggtggtggtggaaacctgctttgggaaaaaattgtggctgccaattctaaaaagcttatttggatcgtagacaaatccaaagttgttgaccgaatcggcgcctttccactagctgttgacgtagaacctttcggtagtcatcatgttttgaaaaagttttccgatgccggattcaatccggttgtcaggactgataaggacggcaaggtctttaaaacggattcaaataacatcattttggatcttcacctacatgaaattaacaaccccgataaactggccgataccttaattaacacagttggcgtggttgaacacggtttgtttttaaatgcggttaatgaggttgttgtaggcaaagaaggagcccctcagatcctgattaatcctaaagctgatccatcttatcaataa

SEQ ID NO: 2456 - DNA, 723 bp, Lactobacillus brevis
atgagtacgatcaattcagagcttcagaacaagttaaaaaaggctgcggcggttaaagctgcagattatgttaaagacggtatgattgttgggcttggaagtggttcaacggttacaatgctggtcgatgagttgggacgacgggttcaggaagacggcctgaactttacggccgtttccacgtcaatttcaacagcgaagcaggctgaatcattgggaataaaaatttctgatttggattcgattgacacaattgatttaaccattgacggtgccgaccaggttgacagtgactttaatggtattaaaggtggtggtggaaacctgttttgggaaaagattgtggctgccaattctaaaaagcttatttggatcgtagaccaatccaaaattgttgaccggatcggtgcctttccactggctgttgatgtagaaccttttggcagtcatcatgttttgaaaaaattttccgatgccggatttaatccggttgttaggactgataagaacggcaagatctttaaaacggactcaaataacatcattttggatcttcatttgcataaaattaacgacccagataaactgtctaacgccttaattaacacagttggtgtggttgaacatggcttgtttttaaatgcagttaatgaggttgttgtgggcaaagagggggcacctcaaattatgattaattctaaagcccatccatcttatcaataa

SEQ ID NO: 2457 - DNA, 702 bp, Oenococcus oeni
atggacgcagaacttcaaaacaaactaaaaaaagaggctgccagaaaggctgcctcttacgttaagaacgggatggttgttggtctcggaagtggttcaactgtcaaaatgcttgttgacgaactcggtcgccgcgtcaaagaagaggacttgcagtttaccggggtggcaacctcgatttttacggcccagcaggcaaagtctttgggtattaaaatcgttgatttggacatggtcgactcaatcgatttaacaattgacggcgccgatcaggtagatagtaatttcaacggcattaaaggtgggggcggtaatctgctctgggaaaaaattgttgcgataaattcaaaaaaaatcgtttgggtcgttgataaatcaaaagtcgtcgatacgattggtgcctttccactggctgttgatgttattccttttggaagccaacatgttatgcaaaacttcgataaggcaggttatgagccggttcttcgtcttgataaagaaggaaaacctttcaagacggattccaataatttaataattgatttgcacctgcataagatcgaggaaccaacccaacttgccgataatctaattcagacggtcggcgttgtcgaacatggcttgtttttaaacatggttagcgaagttgttgtcggcaaagaaggacaaccggaaatattggtcaacccaaatattggttaa

SEQ ID NO: 2458 - DNA, 699 bp, Oenococcus oeni
atggagaaaaatttacagaacgaacttaaaaaagaagccgccattcgggcagctgaatttgttgaaaacgatactgttgttggcctaggtactggatcaacagtcaagtttttggttgatgagttgggacggaaggttagagaagaaaatttatcctttaccggagtgactacttctaagagaactgcttctcaagcggagtctttgggaattaagattgtcagtcttgattcaattccacggattgatctgacgatcgatggagccgatcaggttgataataatttcaatgggatcaagggtgggggagccgctttgctgtgggaaaaaatcgttgccacaaattctaaaaaaaatatctggattgtcgaccaatccaagctggtcgacagaattggaagttttccgcttccggttgaagttattccctttggtgctttacatgtcttaaataaattcgaagagctcaatctcaatccggctttgagattgacggaaaatggaaagaaagtcatgactgattcccaaaattatattatcgatttgcatttaaatcagattattgatccggccaagctttccaatcaattgattaatacagttggcgtggttgagcatggattattcttaaatgtagtcgataaggttgttgttggcaaaaaaggccaacccctcattctggaaaatcccgataaataa

SEQ ID NO: 2459 - DNA, 699 bp, Oenococcus oeni
atggagaaaaatttacagaacgaacttaaaaaagaagccgccattcgggcagctgaatttgttgaaaacgatactgttgttggcctaggtactggatcaacagtcaagtttttggttgatgagttgggacggaaggttagagaagaaaatttatcctttaccggagtgactacttctaagagaactgcttctcaagcggagtctttgggaattaagattgtcagtcttgattcaattccacggattgatctgacgatcgatggagccgatcaggttgataataatttcaatgggatcaagggtgggggagccgctttgctgtgggaaaaaatcgttgccacaaattctaaaaaaaatatctggattgtcgaccaatccaagctggtcgacagaattggaagttttccgcttccggttgaagttattcccttcggtgctttacatgtcttaaataaattcgaagagctaaatctcaatccggttttgagattgacggaaaatggaaagaaagtcatgactgattcccaaaattatattatcgatttgcatttaaatcagattattgatccggccaagctttctaatcaattgattaatacagttggcgtggttgagcatggattattcttaaatgtagtcgataaggttgttgttggcaaaaaaggccaacccctcattctggaaaatcccgataaataa

SEQ ID NO: 2460 - DNA, 714 bp, Catonella morbi
atggtagataccaaggaactagtcggccgttatgccgctaattatgttaaagacggcatggtggtcggtttagggaccggctcaacagcttattggtttgtggaagaggtaggtgcgcggattgctgatggccgtctcaaacagattgtgggtgtggctacttctcggcggactgcggaacaagcccttaagttaggcattaccatcatggatttagaccgagtcaaccacattgatctggtcgttgacggggcggatgaagtaacccgtgatttttacggcatcaaagggggcgggggtgctctcctacatgaaaagattgtggctaaaaatgcgaaacgttctatttgggttgtaggtgaagacaagctagtcgatactttaggagctttccccttgcctgtcgaggtagtgcagtttggttcctggaatcttttccgtcaattgatggcagcaggcctagaaccaagcttccgtaaagtggggtctgattcactctatatgacagattctggtaactacattattgacttgaaactgggccagattccttatcctcaccagctcgcccatgaattgaaaaatacggtgggagtagtcgaacacggcctcttcttagatgtttgtgatactttcttggtggggcgtgcggacggcaccattctcctctatcagaaagaccaaactgagccaatgacaattgaggtgagctaa

SEQ ID NO: 2461 - DNA, 690 bp, Leuconostoc mesenteroides
atgaacaagcaaaagaaacatgccggtgaatttgccgccacactaatagaagatggaatggttgttggtcttggaacaggttctacgatagcatactttttagaggcattagctaaacgtattcaagatgaaaaaatgactattattggcgtgaccacctcaacaaagactgccagatgtgcggaagaacttggtattccgattcgtgatattgacttagtaccaatgatagatttaacaattgatggtgcggatgaggttgatcagcatttaaatggcatcaaaggtggtggagcagctttcttaatggaaaaaattgtggcgagatattctagacgtgtgatttggattattgacgaacagaagctgcatagtaaactgggacaatttcctttgccagtagaagtagtagcatttggcagtggtaaactaatagctgaactaaaagagcgtcatttgcaccccaaattacgtctagacaaccatcagcaaccgctagtaacggacttaggacactatattgttgatctagatttagaacaaattgatcagccgtttgaactagggcgttatttagatggacagattggtatcgttgagcatgggctatttctaaatgttgcggatcaagttattattggacaggacgaaggctatcggatcatgaataatttacagaaagaaatgtaa

SEQ ID NO: 2462 - DNA, 768 bp, Leuconostoc citreum
atggtaatcgtgtgtcacatacgattactatcaatctttttttatttctgttatgataggcacatggacaatatattaatggcaaaaaaaaaggcggcgattgctgcttcaaagttagtcaaagatggtatgacagttggcctgggaacagggtcgacaattgccttctttttagatgccttagctgagcgtgtacaacatgagaagctaaatattattggtgtaacgacctcttttaaaacagctgatcgtgccaaagaattaggcattcaaatacaagatatcgacagtgcacccatgattgatttaacaatagatggcgcagatgaagttgatacagaactgaatggtattaaaggtggtggcgcggcgtttttaatggaaaaaattgtagcgaagaattctaaacgtgtggtttggattgttgatagtcttaaagtacatgataagttaggtcagtttccgttacctgttgaagttgtgccatttggaagtggtaaattgattactgaatttgaacaacatcatttgtatccaaaattgcgtacaggagcagatggtcaaccagttgtgactgatatggggcattatattgttgacctggatttacaagttattgatcagccctacgagttaagccgatatctagacggacggattggtgttgttgagcatggtttatttttagatattgccgatgaagtaattgttgggtcacaacagggtgttagttacttacgacgcactgatttacagaaaaaaatgtaa

SEQ ID NO: 2463 - DNA, 837 bp, Weissella paramesenteroides
atgttttttagtctaaaaaattttatgattcagattcttttggttataaatattggttcgatagtaaacacgtttattgctatctttttttatgctttatcggtaaaattaatttactgtcagggggaaaaggaggaacacatagtgattgatcagcaaattattcaaaaaaagcaagctggcgaatttgcagcgactttaattactgatggcatgattgttggtttgggaacagggtcgaccgtacgtttttttattgaagcgttggctgccaaaatcaacaatgaaggtctgaatattactggggtgacaacctcaaataaaacgtcatcattagcaaaatcattggggattaagcttgcttctgttgacgaagtaccaatgatcgatttaacgattgatggtgcagatgaagttgaccatcagctaaatggtattaagggtggtggtgcagcgttattatttgaaaaaattgtggctttgaattcgaagaagaatatttggattattgatgaatcaaagtatcatgaggtcatcggccagtttccattacctgttgaagtggtgccttatggtagccaccatctgttgaaaaaatttttggcagcagatatgcagcctacttttcgtcggacagcgactggtgaacgggttacaactgatgttggtaattatattattgatttacacttgaatcgtattgaatatccccagagtttagcatattttttggaacaaacgatcggggttgttgaacatggtttgtttttaaaaacggttgatgaagtgattatcggtggtaatcaaccaacattaatttctaatacgaagccataa

SEQ ID NO: 2464 - DNA, 696 bp, Leuconostoc mesenteroides
atgaatgaaaaaaatttccaaaaaaaacaagcagccctcgccgctttaaattatatccagaccgatatgattatcggactaggaactggttcaactgtttcttattttttagatgctttagctgcttctcaatataacgtcatcggcgtgaccacttcaacaattactagtcagcgatgcgcagaattaaatattccaattgtcgacattgatgccattgaccatattgatgttacagttgatggtgcagatgaagtcgattcctaccttaacggtataaaaggtggcggagctgccctactgatggagaaaatagtagctaaaaactcaaagaaaaatatctggatcgttgatcgcagtaaagtgcacaacacgctaggttctttcccgctgcccgtagaggttatcccctacggtagcggtcagttgttacgacaatttgccaataaaggtctgttcccaaagctacgtcgtcatcccggaaataaccagcccgttatcactgatgctggtcactacattattgattgccatatgaccacaattaacaatccatatgccctcgccgaatatcttgaaagccaagttggcgttgttgagcacggtttgtttttaaatatttgtgatcgaataattattggcgataacacagtagaaattaaagaacgacagcaagctcatgtggagataaactga

SEQ ID NO: 2465 - DNA, 708 bp, Leuconostoc mesenteroides
atgaggcttatcatgaatgaaaaaaatttccaaaaaaaacaagcagccctcgccgctttaaattatatccagaccgatatgattatcggactaggaactggttcaactgtttcttattttttagatgttttagctgcttctcaatataacgtcatcggcgtgaccacttcaacaattactagtcagcgatgcgcagaattaaatattccaattgtcgacattgatgccattgaccatattgacgttacagttgatggtgcagatgaagtcgattcctaccttaacggtataaaaggtggcggagctgccctactgatggagaaaatagtagctaaaaactcaaagaaaaatatctggatcgttgatcgcggtaaagtgcacaacacgctaggttctttcccgctccccgtagaggttatcccctacggtagcggtcaattgttacgacaatttgccaataaaggtctattccccaagctacgtcgtcatcccggaaataaccagcccgttatcactgatgctggtcactacattattgattgccacatgaccacaattaacaatccatatgccctcgccgaatatcttgaaagccaagttggcgttgttgagcacggtttgtttttaaatatttgtgatcgaataattattggcggtgacacagtagaaattaaagaacgacagcaagctcatgtggagataaactga

SEQ ID NO: 2466 - DNA, 678 bp, Weissella paramesenteroides
atgaatattaatttacagaaaaagagcgctgcacaagcagctgtcaactatattgatgaaggcatgatcgttggactaggtactggtagcacggcaaactactttattgaagctttaagtaaaaaaataaaagccgccaactggcacttaacttgtgtgacaacttctacaaagtcacgccaactcgctgaatccttaggcatacacgttgttagtattgatgatgttaatcacattgatgtaaccgtcgatggtgttgatgaattcgatccacaattaaatggtatcaaaggtggcggtgtagcacttttatttgaaaaaattgttgcacttagctctaacaagaatatatggatagttgatacctccaaaaaaagtgataaattgggtagctttttactccctgtagaaattataccatttggttctgtgcaactgtttacaaagctaagtcaaatgaacctaaaaccacaattcagagtggataatcaaaaccaaaaagtattaactgattccaaaaattatattatcgatgtcgacatcagtcatgtctccgatattcataaattggctgataccctcaagtcattgacaggtatcgtagaacacggtctattccttgatctttgtcatacagtgattattggcggcgaacatattgagaagattgacaggtaa

SEQ ID NO: 2467 - DNA, 693 bp, Lactobacillus helveticus
atggctaaaacagaacaagatcgcttgaaaaaagaagccgctgaaaaagcagctagcatggtaaaatctggcatgattttaggcgtgggtactggttcaacggtcgctttctttattgatgctctaggcaagcgcaaggataatgatggcttaaagttaaaggcaatcgttactaccagcaatagaagtaaaaaacaacttgaaggtctagggtttaaagttagcgaattagccgatgttgatcaagttgatttaaccgttgatggttctgaccgtgttgcggacaacttagacggaattaaaggcggcggtggtgccctaacccttgaaaagaatgttgccattaattctaagaagattatctggattgtggatgaatcaaaacttgtccacagattaggtggatttcctttaccagttgaagtattgccaatttcttgtgaacaaaactttaaacgttttaagcaagaaggattgaaacctcaatggcgaatggatagcgataagcgctacattactcactacggcaattacattatcgatttggctgccgatcctgttccagcaccacatggtttagccgattatcttgaccacaccgttggtgtagttgaacatggcctattccttgatatgtgtgatgaagtaatcattgcccatagcgatggcacaattgaagataaaattaaataa

SEQ ID NO: 2468 - DNA, 693 bp, Lactobacillus helveticus
atggctaaaacagaacaagatcgcttgaaaaaagaagccgctgaaaaagcagctagcatggtaaaatctggcatgattttaggcgtgggtactggttcaaccgtcgctttctttattgatgctctaggcaagcgcaaggataatgatggcttaaagttaaaggcaatcgttactaccagcaatagaagtaaaaaccaacttgaaggtctaggctttaaagttagcgaattagccgatgttgatcaagttgatttaaccgttgatggttctgaccgtgttgcggacaacttagacggaattaaaggcggcggtggtgccttaacccttgaaaagaatgttgccattaattctaagaagattatctggattgtggatgaatcaaaacttgtccacagattaggtggatttcctttaccagttgaagtattgccaatttcttgtgaacaaaactttaaacgttttaagcaagaaggattgaaacctcaatggcgaatggatagcgataagcgctacattactcactacggcaattacattattgatttggctgccgatcctgttccagcaccacatggtttagccgattatcttgaccacaccgttggtgtagttgaacatggcctattccttgatatgtgtgatgaagtaatcattgcccatagcgatggcacaattgaagataaaattaaataa

SEQ ID NO: 2469 - DNA, 693 bp, Lactobacillus crispatus
atgaacaagcaagaacaagatcgtttgaaaaaagaagcagcagaaaaagcagccgccatggttaaatcaggtatggtattgggcgttggtacaggttcaaccgttgcctttttcattgatgctttaggtaagcgcaaagatgaagacggcttaaaactgaaggctatcgtaactactagtaaccgtagtaaaaaacaacttgagggcttaggctttaaagttagtgaattggccgatattgatcaagctgatttaactgtagatggtgctgatcgggttgccgataacttggatggaatcaaaggcggcggtggtgcattaactttagaaaaaaatgtagcaatcaattctaagaagatcatttggatcgttgatgaatcaaaattagtgcatcgtttaagcggcttcccattaccagttgaagttttaccaatttcttgtgaacaaaactttaaacgttttgaacaagaaggattaaagcctcggtggcgtatggatggcaatcaacgttatgtgactcactatggaaattatattattgatttggctgcagatcctgttccagcacctcatggtttagctgattaccttgatcatactgttggcgtagttgaacatggcttgttcctggatatgtgtgacgaagtaattattgctcatagtgatggcaccatcgaagataagaaaaagtaa

SEQ ID NO: 2470 - DNA, 693 bp, Lactobacillus crispatus
atgaacaagcaagaacaagatcgtttgaaaaaagaagcagcagaaaaagcagctgccatggttaaatcaggtatggtattgggcgttggtacaggttcaaccgttgcctttttcattgatgctttaggtaagcgcaaagatgaagacggcttaaaactgaaggctatcgtaactactagtaaccgtagtaaaaaacaacttgagggcttaggctttaaagttagtgaattggccgatattgatcaagctgatttaactgtagatggtgctgatcgggttaccgataacttggatggaatcaaaggcggcggtggtgcattaactttagaaaaaaatgtagcaatcaattctaagaagatcatttggatcgttgatgaatcaaaattagtgcatcgtttaagcggcttcccattaccagttgaagttttaccaatttcttgtgaacaaaactttaaacgttttgaacaagaaggattaaagcctcggtggcgtatggatggcaatcaacgttatgtgactcactatggaaattatattattgatttggctgcagatcctgttccagcacctcatggtttagctgattaccttgatcatactgttggcgtagttgaacatggcttgttcctggatatgtgtgacgaagtaattattgctcatagtgatggcaccatcgaagataagaaaaagtaa

SEQ ID NO: 2471 - DNA, 693 bp, Lactobacillus crispatus
atgaacaagcaagaacaagatcgtttgaaaaaagaagcagcagaaaaagcagccgccatggttaaatcaggtatggtattgggcgttggtacaggttcaaccgttgcctttttcattgatgctttaggtaagcgcaaagatgaagacggcttaaaactgaaggctatcgtaactactagtaaccgtagtaaaaaacaacttgagggcttaggctttaaagttagtgaattggccgatattgatcaagctgatttaactgtagatggtgctgatcgggttgccgataacttggatggaatcaaaggcggcggtggtgcattaactttagaaaaaaatgtagcaatcaattctaagaagatcatttggatcgttgatgaatcaaaattagtgcatcgtttaagcggcttcccattaccagttgaagttttaccaatttcttgtgaacaaacctttaaacgttttgaacaagaaggattaaagcctcggtggcgtatggatggcaatcaacgttatgtgactcactatggaaattatattattgatttggctgcagatcctgttccagcacctcatggtttagctgattaccttgatcatactgttggcgtagttgaacatggcttgttcctggatatgtgtgacgaagtaattattgctcatagtgatggcaccatcgaagataagaaaaagtaa

SEQ ID NO: 2472 - DNA, 693 bp, Lactobacillus acidophilus
atggataaaaaagaacaagatcgtttgaaaaaagaagctgctgaaaaagcagcaaatatggttcaatccggcatgatcttaggtgtaggtaccggatctactgtagcctttttcattgatgctttaggtaagcgcaaagatgaagaagatttgaagttgaaggcgatcgtgaccaccagtaatagaagtaagaagcaacttgagagtttaggctttgaagttagcgaacttgctgatattgatcaagctgatttgactgtcgatggatcagatcgtgttgctgataacttagacggaattaaaggcggtggcggtgccttaactcttgaaaagaacgttgccattaactcaaagaagatcgtttggatcgttgatgaatctaagttggttcaccgtttgagcggattccctcttcctgttgaagtattaccaatctcttgtgagcaaaacttcagacgctttgaacaagagggcttgaagccacaatggcgtacggatggtgacaagcgttacatcactcactatggcaactacatcattgatttagcagttgatccaattcctgcccctcatggtttagcagactaccttgatcatactgttggtgtagttgaacatggtttgttccttgatatgtgtgatgaagtaattattgctcatagcgatggtacgattgaagataagattaaataa

SEQ ID NO: 2473 - DNA, 693 bp, Lactobacillus acidophilus
atggataaaaaagaacaagatcgtttgaaaaaagaagctgctgaaaaagcagcaaatatggttcaatccggcatgatcttaggtgtaggtaccggatctactgtagcctttttcattgatgctttaggtaagcgcaaagatgaagaagatttgaagttgaaggcgatcgtgaccaccagtaatagaagtaagaagcaacttgagagtttaggctttgaagttagcgaacttgctgatattgatcaagctgatttgactgtcgatggatcagatcgtgttgctgataacttagacggaattaaaggcggtggcggtgccttaactcttgaaaagaacgttgccattaactcaaagaagatcgtttggatcgttgatgaatctaagttggttcaccgtttgagcggattccctcttcctgttgaagtattaccaatctcttgtgagcaaaacttcagacgctttgaacaagagggcttgaagccacaatggcgtacggatggtgacaagcgttacatcactcactatggcaactacatcattgatttagcagttgatccaattcctgcccctcatggtttagcagactaccttgatcatactgttggtgtagttgaacatggtttgttccttgatatgtgtgatgaagtaattatttctcatagcgatggtacgattgaagataagattaaataa

SEQ ID NO: 2474 - DNA, 693 bp, Lactobacillus ultunensis DSM 16047
atggataaacaagaacaagatcgtttgaagaaagaagctgctaccaaagcagctgaaatggttgaatctgggatgaccctaggagtcggaacaggttccactgttgccttttttattgatgctttaggcaagcgtaaagatgaagagggcttgaagctgaaggctattgtcactactagcaatagaagcaaaaagcaattggaaagtttgggctttaaggttagtgaattagctgatatcgatcaagccgatttaaccgttgatggtgctgatcgtgttgccgataatcttgatgggattaaaggtggcggtggagccttaactctagaaaagaacgtagccattaattcgaagaagattatctggatcgttgatgagtctaagttggttcaccgtttgagtggcttcccattgccagtagaagttttgccaatttcttgtgaacaaaactttaaacgttttgaacaagaaggcttgaagcctcaatggcggatggatggtgacaaacgttacattactcactatggtaactacatcattgacttagccgttgatccaattcctgcacctcatggtttagctgattatcttgatcatactgtaggtgtggtcgaacatggtttgttcttagatatgtgtgatgaggtaattattgcgcatagcgacggtacaattgaagataagaaaaaatag

SEQ ID NO: 2475 - DNA, 699 bp, Lactobacillus gasseri
atggacaagagtgaacaagatcaattaaaaaaggaagcagccactaaagctgctatgatggtagaatctgattctgttttaggtgttggaactgggtcaacagttgctttctttattgatgcattaggtgaacgcaaagaaaaagagggttttagtcttaagcatattgttactacttctaatcgtagtaaaaagcaacttgaaggtttaggctttaaagttgatgagttagcagatattgaccaggcagatttaactgtagatggagcagatcgtgttgatgataatctagatggaatcaagggtggcggtggcgctttaactttagaaaagaatgtcgctattaactcaaagaagatcatttggattgttgatgaatctaaactggttcaccacctaagtggttttccgcttccagttgaggttttaccagtttcagctgaacaaaattttaaacgttttgaagtagaaggcttaaagccgcaatggcgtctagataataacggcaagcgttatgtaacgcattatggaaattacattattgacttagctgctgatccaactcctgtaccatatggcttagcagattacttagatcacacagttggtgttgttgaacatggattgttcttagatatgtgcgatgaagttattattgctcatagcgatggtacgattgaagataagaaaagaaaatag

SEQ ID NO: 2476 - DNA, 699 bp, Lactobacillus gasseri
atggataagagtgaacaagatcaattaaaaaaagaagcagccactaaagccgctatgatggtagaatctggttctgttttaggtgttggaaccggttcgacagttgcgttctttattgatgcattaggggaacgcaaagaaaaagagaattttagtcttaaacatattgttactacttctaaccgcagtaaaaagcaacttgaaggcctaggctttcaagttgatgaattagcggatattgatcaagctgatttgactgtagatggagcagatcgcgtcgatgataatttagatggaatcaaaggtggcggcggtgctttgactttagaaaagaatgtcgctattaactctaaaaaagtcatttggattgttgatgagtctaagcttgttcaccatttaagtggttttcctcttccagttgaagttctacctgtttctgcagaacaaaattttaagcgttttgaagaagaaggattaaagccgcaatggcgtcttgatgataacggcaaacgttatgtaacgcactatggaaattacattattgacttagcggctgatccaactcctgtaccacatggtttagcagattacttagatcatacagttggtgttgttgaacacgggttgttcttagatatgtgcgatgaagtgattattgctcatagcgatggtacgattgaagacaagaagagaaagtaa

SEQ ID NO: 2477 - DNA, 699 bp, Lactobacillus johnsonii
atgaataagacagagcaagatcaattaaaaaaagaagcggctactaaagcagctaagatggtagagcctaattctgttttaggagttggaacaggttcaacagttgcatttttcatcgatgcactaggtgaacgcaaagaaaaggaaggttttagtttaaagcatattgttactacttctaaccgtagtaagaagcaacttgaaggactgggctttaaggttgatgagttagcagatattgatcaagctgatttaacagtagatggcgctgatcgagtagacgataatttagatgggattaaaggcggcgggggtgccttaactctagaaaaaaatgtcgctatcaactcaaagaagattatttggattgttgatgaatcgaaacttgttcatcacttaagcggctttccgcttccagttgaagtattaccagtgtctgctgagcaaaactttaagcgttttgaagcagagggtttgaagcctcaatggcgtttagatgatgagggtaagcgttatgtaacgcattacggtaattacatcattgatttagctactgatccaactccagtaccacacggtttagctgattatctagaccacacagttggtgtagttgagcatggtttgtttttagacatgtgtgatgaagtcatcattgcacatagcgatggtacaattgaagataagaagagaaaataa

SEQ ID NO: 2478 - DNA, 699 bp, Lactobacillus johnsonii
atgaataagacagagcaagatcaattaaaaaaagaagcagctactaaagcagctaagatggtagagcctaattctgttttaggagttggaacaggctcaacagttgcgttttttatcgatgcattaggtgaacgcaaagaaagagaaggttttagtttaaagcatattgttactacttctaaccgtagtaagaagcaacttgaaggactaggctttaaggttgatgagttagcagatattgatcaagctgatttaacagtagatggcgctgatcgagtagacgataatttagatggaattaaaggcggcggtggtgccttaactttagaaaaaaatgttgccatcaactcgaagaagattatttggattgttgatgaatcaaaactggttcaccatctcagcggtttcccgcttccagttgaagtattaccagtatctgctgaacaaaactttaaacgttttgaagcagaaggtttgaagcctcaatggcgtttaaatgatgagggcaagcgttatgtgacgcattatggtaattacataattgatttagctgctgatccaactcccgtaccacacggtttagctgattatttggaccacactgttggtgtagttgagcacggtttgtttttagacatgtgtgatgaagtcatcattgcacatagtgatggtacaattgaagataagaagagaaaataa

SEQ ID NO: 2479 - DNA, 696 bp, Lactobacillus iners DSM 13335
atgcaaaaaactaagcaagatgaattaaagcaagaagcagctaaaaaagcagccttgatggttgagcctaattctgtgttaggtgttggcacaggttccacggtagcattttttattgatgagttggctaaaataaatagggaaaaagctttaaacttaaaagctattgttaccacttctaatcgctctcgtgctcaattagaaaagcaaggctttaaagttaatgagttatctgaagttgatcaaattgatttaactgttgatggtgccgatcgggttgatcttaaccttaatggtattaaaggtggaggaggtgccttaactttagaaaagaatgtagctgttaattctaaaaaaaatatatggattgttgatgaaactaaatttgttgatcgcttaaaaggctttgcattacctgttgaggtgttgcctatttcatgtgagcagaattttagaacctttagtcaagaaggattattgccaaaatatcgtttggatgacaatggaaaaagatatattacacattatggaaatttcataattgatctacatgttgatcctattccatttcctaatgtgttagcacattatttggatagcgtagttggtgttgttgaacatggcttatttttaaatatatgcaatgaagttattattgctcatagtgatggaaaaatagaaatcagaaaacgttag

SEQ ID NO: 2480 - DNA, 693 bp, Lactobacillus jensenii JV-V16
atggataaaaatacgcaagatgaactaaaaaaagaagcagctaaagtagcagctgacaaagttcaagctggttctgttttaggtgttggaaccggatctactgtaaagtttttcattgattggttaggtgagcgtaaagaaaaagaaggtctaactttgaagcatatagtaactacttctagtcgctcaaaaaagcaattagaaagttatggctttaaagtagatgaattagcagatgttgatgaagtagatttaactgttgatggggctgaccgtgttgacagccaactaaatggcatcaaaggtggcggagctgctttaacactagaaaaaaatgttgctgttaattctaaaaagaatatttggattgttgatgaaagcaaagtggttgaccacttatcaggatttaagttaccagttgaagtcttgcccgtttcttgcatgcaagtaaaaaagcgccttgaaaaagaaggcctaaatccagagtttagaatgaatggtaatcagaagttgactacacattatggcaactatattttagatttagatgttagcccaatacctgttccaactggtttggcagattatcttgatcatactgttggtgtggttgaacatggtttgttcttaaatatttgtgatgaagtaatcgttgctaaaagtaacggaacaattcaagaaattaagcgctaa

SEQ ID NO: 2481 - DNA, 693 bp, Lactobacillus jensenii 269-3
atggataaaaatatgcaagatgaactgaaaaaagaagctgctaaagttgcagctgacaaggttcaagctggttcggttttaggtgttggaactggttctacggtaaagttttttattgattggttaggtgaacgaaaagaaaaagaaggcctaactctgaaacatatagttactacttctagtcgttcaaaaaagcaattagaaagttatggctttaaagtagatgaattggcagatgttgatgaagtagatttaactgttgatggagctgaccgtgttgatagtcaattaaacggtattaaaggtggcggtgcagctttaacactcgaaaaaaatgttgctgtcaattcaaaaaagaatatttggattgttgatgaaagtaaagtagtagatcatttatctggattcaaattaccagttgaagtcttaccagtttcttgcatgcaagttaaaaagcgacttgagaaagaagggctaaatccagaatttagaatggatggcaataaaaaattaactacacattatggtaattatattttagatttaaatattagcccaattcctgttccaaatggtttggcagattacttagatcatactgttggcgttgttgagcatggcttatttttaggtatttgtgatgaagtaatcgtcgctaaaagtaatggaacaattcaagaaattaagcgttaa

SEQ ID NO: 2482 - DNA, 693 bp, Lactobacillus delbrueckii
atggaccaagcaaagcaagatgaattgaaaaaggcagctgccaagaaagcagctgccttggtggaagacgggatggttttaggcgtcggcaccgggtcaacggtgaagttcttcatcgatgaactgggcaagaagaaagcagcaggcttgactcttaaggcagtcgtgaccacctccagccgcagtcaaaagcagctggaaggctatggctttactgtcagccccctcagtgaagttgaccaggttgatttaacggttgacggggccgacagagtggacaagcagttaaacgggatcaagggaggcggggccgccttgaccttggaaaagaacgtggccgtcaactccaagaagaatgtctggatcgtagacgaaagcaaggtggttgaccacctcagcggctttgccctgccagtggaagttttgccgatctcctgcatgcaggtggaaaagcgcctggcagatgaagggcttaagccggaattccgtttaacggaagatggtcagcgccttaagacccactatggcaactacattctggacctcaagctggaccggattccggtgccaagtggtctggctgactacctggaccatacggtcggggtagttgagcacggcctctttttaaacatctgcgaccaggtcatcatcgcccgcgacaacggggagattgaagtccgcagccgctaa

SEQ ID NO: 2483 - DNA, 684 bp, Parachlamydia acanthamoebae str. Hall's coccus
atgtcaaatgctatttctctcgcaaaagaagcggctggtcgaacagctgcgcagtttatagaatcaggaatgttagtcggattaggaactggcacgaccactcattgctttattgaagccctaggaaaacgatgtcaagaaggactacgaattcaagcgcttgcttcatctgaacgctctgcgactctagcacgagaacaaaaaattcctctacttcagacagatcaggtcacttatttagatataactgtcgatggtgcagatcaaatcgacccacaaaaaagaatgattaaaggaggaggcggggcattactacgtgaaaaaattttggcttccatcagcaaagaaatggttgtcattgttgactcttctaaagtcgttgagcaatttggttcctttccgcttcccgtagagatggtaacatttgcctatcaagcaaccatcaaaaaattaaacgcacttggatatacaggaaagttgcgcgaaaaaggcgggatcccttatgtctcggataacgggaattacatttttgatatttcactgccgaagccttgcttaactccagaaaaagaaaaccaacaaattcgagccattccaggagttgttgaaacaggttttttctttggattagctggccgtgttttgattggatttccggacggacgtgttgaaattcgttcgtga

SEQ ID NO: 2484 - DNA, 699 bp, Candidatus Protochlamydia amoebophila UWE25
atgacacaaacaaacgattcgccatccattaaagcaaaaaaggcagctgcccttaaagctgtagaatttgttcaagatcaaatgattattggtttaggaacaggttccacaatagcctacttcattgaagctttgggtaagcgctgtcaagcaggcctaaaaataactgcaattgcctcttcagaacgatccatgcggcaggctcgattggttggcattcctattgtcgattcagacactattttagaattagatttaacaatcgatggagcggacgaaatagatcctctcaaacagatgattaaaggaggaggaggagctcttttacgagaaaaactcattgcctcagcaagtaaagaaatgatcgttgttatcgatgagactaaacttgtgaataaattaggaaaatttcccgtagctaccgagatttcaatatttacatttcgtcatatagtaaaaaaacttaaggatcacggttattgcggatcgttacgagttaatcaagatcagagtttgtatcgtacagataatggaaattatatttttgatatttgttttcctgaacctattgacaatcctatttttgaacataatcggcttaaaagttttgccggggttttagaaactggccttttttttaatttagcagggcgtgttatcattggataccaaaatggaatgactaaaattgttgcatga

SEQ ID NO: 2485 - DNA, 729 bp, Chlamydia trachomatis
atgtctaaacaacccgagaactctttttcttccgacaaatttttccctatcaagcagaaactagcgctagaggcagtagctttggtggagccaggaatgtgtgtggggttagggagcggctcgacggctagagagttcattttggctttaggagatcgtgttcggacagaacgtttggtaatcacagcggtagcctcttcaaggatatctcagctattagctgaagcagtggggattcctttattggatcattctttattgcaagatgtagacttggtcgtggatggagcggatgaagttgatccttgcttacgtatgatcaaaggaggagggggagctcttttccgagaaaaaattcttcttcagagcgggaagcgcaatgttattctagtagatgaaaggaaacttgttcccacattagggaagttttcattgcctatagagattgctccttttggttgctcttctgtacagaggatattgaataaacagggatactttggagaatggagagaaacttctgcaggagaacgttttatcacggataatggcaattatatttacgatgtgcgtacacccgattcctatgcgaatcccgaagaggatatgattagactattacaaattcgtggcattattgatgtcgggtttgttatagcaaaagccgaggtgtgggtaggttacgccgacggttctattgtccgaaaaaaagaacataatgaatattga

SEQ ID NO: 2486 - DNA, 729 bp, Chlamydia trachomatis
atgtctaaacaacccgagaactctttttcttccgacaaatttttccctatcaagcagaaactagcgctagaggcagtagctttggtggagccaggaatgtgtgtggggttagggagcggctcgacggctagagagttcattttggctttaggagatcgtgttcggacagaacgtttggtaatcacagcggtagcctcttcaaggatatctcagctattagctgaagcagtggggattcctttattggatcattctttattgcaagatgtagacttggtcgtggatggagcggatgaagttgatccttgcttacgtatgatcaaaggaggagggggagctcttttccgagaaaaaattcttcttcagagcgggaagcgcaatgttattctagtagatgaaaggaaacttgttcccacattagggaagttttcattgcctatagagattgctccttttggttgctcttctgtacagaggatattgaataaacaaggatactttggagaatggagagaaacttctgcaggagaacgttttatcacggataatggcaattatatttacgatgtgcgtacacccgattcctatgcgaatcccgaagaggatatgattagactattacaaattcgtggcattattgatgtcgggtttgttatagcaaaagccgaggtgtgggtaggttacgctgacggttctattgtccgaaaaaaaaaacataatgaatattga

SEQ ID NO: 2487 - DNA, 729 bp, Chlamydia trachomatis
atgtctaaacaacccgagaactctttttcttccgacaaatttttccctatcaagcagaaactagcgctagaggcagtagctttggtggagccaggaatgtgtgtggggttagggagcggctcgacggctagagagttcattttggctttaggagatcgtgttcggacagaacgtttggtaatcacagcggtagcctcttcaaggatatctcagctattagctgaagcagtggggattcctttatcggatcattctttattgcaagatgtagacttggtcgtggatggagcggatgaagttgatccttgcttacgtatgatcaaaggaggagggggagctcttttccgagaaaaaattcttcttcagagcgggaagcgcaatgttattctagtagatgaaaggaaacttgttcccacattagggaagttttcattgcctatagagattgctccttttggttgctcttctgtacagaggatattgaataaacagggatactttggagaatggagagaaacttctgcaggagaacgttttatcacggataatggcaattatatttacgatgtgcgtacacccgattcctatgcgaatcccgaagaggatatgattagactattacaaattcgtggcattattgatgtcgggtttgttatagcaaaagccgaggtgtgggtaggttacgccgacggttctattgtccgaaaaaaagaacataatgaatattga

SEQ ID NO: 2488 - DNA, 729 bp, Chlamydia trachomatis
atgtctaaacaacccgagaactctttttcttccgacaaatttttccctatcaagcagaaactagcgctagaggcagtagctttggtggagccaggaatgtgtgtggggttagggagcggctcgacggctagagagttcattttggctttaggagatcgtgttcggacagaacgtttggtaatcacagcggtagcctcttcaaggatatctcagctattagctgaagcagtggggattcctttattggatcattctttattgcaagatgtagacttggtcgtggatggagcggatgaagttgatccttgcttacgtatgatcaaaggaggagggggagctcttttccgagaaaaaattcttcttcagagcgggaagcgcaatgttattctagtagatgaaaggaaacttgttcccacattagggaagttttcattgcctatagagattgttccttttggttgctcttctgtacagaggatattgaataaacagggatactttggagaatggagagaaacttctgcaggagaacgttttatcacggataatggcaattatatttacgatgtgcgtacacccgattcctatgcgaatcccgaagaggatatgattagactattacaaattcgtggcattattgatgtcgggtttgttatagcaaaagccgaggtgtgggtaggttacgccgacggttctattgtccgaaaaaaagaacataatgaatattga

SEQ ID NO: 2489 - DNA, 720 bp, Chlamydia muridarum Nigg
atgtctaaacaagtagctcattctttttcttctgaagatttttcctttataaaacaaaaattagcgcgagaggctgtggctttggtagagcctggaatgcgtgtaggattgggaagtggatctacggcccgagaatttattttggccttaggggagcgtgttcggaatgagcggctagcaattacagctgttgcctcctcaagaatatcacatttgttagcccaagcgttagggattccttttctagatcctgcattatcccaggagttagatttggttgtggatggggctgatgaagtagatgctaatttgcgtatgattaaggggggaggaggagctcttttccgggaaaaaattcttctacaaagtggtaaacgaaatattattctagtagatgagcgcaagctcgtttctgtattagggacatttcctctccctatcgaaatttctccttttggttgttcatcggtggagaaagtacttaatcaacaagggtatattggagattggcgtaaaacttctcacggagaacgttttatcacagataacggcaattatatctatgatgtgagctctccagattcttatcctcatccagaagaagatctgattagattgttacaaattcgtggcattattgatgtcgggtttgttatagcaaaggccgaggtgtgggtaggttacgccgatggtactgtggttcggaaagaaattacgtaa

SEQ ID NO: 2490 - DNA, 696 bp, Chlamydophila pneumoniae LPCoLN
gtggaaaaagatcttcatcttcatgagaaaaaatgcctggcccatgaggctgctacacaagtaacttcaggcatgattcttggcttaggcagtggatctacagctaaggaatttatctttgcactcgcccatagaattcaaacagagtccttagcagttcatgctatagcttcttctcaaaattcttatgttctagcaaagcagcttgccatccccctcttaaacccagaaaaattctcttccctagatcttacggtagacggtgctgatgaagtcgaccctcaattgcggatgatcaaaggtggtggcggagccattttcagagaaaagattcttttaagagcagcaaaacgcagcattatccttgttgatgaaagtaaactggttccagtcctaggaaaatttcgtgttcctttagaaatcagtcgattcggtcgctcagcaattgttgaagaaatccgccatcttggatatgaaggagaatggcgcctacaagatactggtgacctatttattacagacagcggcaactacatttacgatattttttcccctaactcctacccaaatcctgaaaaggatttattaaagttaatacaaattcatggtgttattgaagtcgggtttgttatagagaaagtcgaagtgtggtctagcaatagccaaggtctaatcagcaaaaaatattctgtatga

SEQ ID NO: 2491 - DNA, 696 bp, Chlamydophila pneumoniae CWL029
gtggaaaaagatcttcatcttcatgagaaaaaatgcctggcccatgaggctgctacacaagtaacttcaggcatgattcttggcttaggcagtggatctacagctaaggaatttatctttgcactcgcccatagaattcaaacagagtccttagcagttcatgctatagcttcttctcaaaattcttatgctctagcaaagcagcttgccatccccctcttaaacccagaaaaattctcttccctagatcttacggtagacggtgctgatgaagtcgaccctcaattgcggatgatcaaaggtggtggcggagccattttcagagaaaagattcttttaagagcagcaaaacgcagcattatccttgttgatgaaagtaaactggttccagtcctaggaaaatttcgtgttcctttagaaatcagtcgattcggtcgctcagcaattattgaagaaatccgccatcttggatatgaaggagaatggcgcctacaagatactggtgacctatttattacagacagcagcaactacatttacgatattttttcccccaactcctacccaaatcctgaaaaggatttattaaagttaatacaaattcatggtgttattgaagtcgggtttgttatagagaaagtcgaagtgtggtctagcaatagccaaggtctaatcagcaaaaaatattctgtatga

SEQ ID NO: 2492 - DNA, 702 bp, Chlamydophila felis Fe/C-56
gtgaaagaagatccctatttagatgtgaaaaagcgtttagctcgtgaagcagcagctttagtaacttctggaatgcttgtgggactgggaagtggttctacatctagagaatttattaaagctattgctgaaaggttggcgaaggaaaacttagatatttgtgcggtagcttcttcgcaagagtcttattctttagcgagtagtttaggaattcccctgattgatgatgaaaattttacttctgtcgatcttgttgttgatggagccgatgagatagatccccaactgcgtatgattaaaggtggtggaggcgctatttttagagagaagattctgttgcaatcgagtcaacgacgtttgatacttgctgatgaaagtaaaagtgttaaggttttagggaaatttggtcttcccgtagagattagtccttatggtagatcttctattatagctgccttagaagctataggatatttgggaaatttaagaaagaattctcgagggggattttttatcaccaataatggaaattatatttacgatattcatacaccgaatatatatcctcatcccgaggaagatcttttgaagctgttacaaattcatggtattattgaggtcgggtttgttatagcgaatgttgaggtatggtttggttataccaatggtcagatttgcaaagagaacaccggcatagtatga

SEQ ID NO: 2493 - DNA, 702 bp, Chlamydophila caviae GPIC
gtgaaagaggatccctatttagaagtaaaaagacatttagctcgtgaagctgctgctttggtgacctccggaatgcttttaggattgggaagtggttcgacctctagagaattcatcaaagctgttgctgaaaggaaaaagcaggagaatttagatattcgtgctgtggcgtcttcgaaagagtcttattccctagcaagtagtttagggatccccttgattgatgatgaagaattcatcaacacggatcttgctgttgatggtgctgatgagatagatccccaactgcggatgatcaaaggtggcggtggagccatttttcgagagaagatactactgcaatcgagtcaacgacgtttgatacttgctgatgagagtaaaagcgttaaggttttagggaagtttggtcttcctgtggagattagtccttttggaagatcttctattattgctaccttggagaattttggatatctgggaaatttaagaaagaatcctcgtgggggattttttatcaccaataacgggaattatatttacgatattcatactccaaatgtatacccccatcccgaggaagatctcctcaagctattacaaattcatggtattattgaagcagggtttgttatagagaatgttgaggtatggttgggttataccaacggtcagattggcaaaaagaacaccggtggattatga

SEQ ID NO: 2494 - DNA, 702 bp, Chlamydophila abortus S26/3
gtgaaaaaagatccctatttagaagtaaaaaaacagttagctcttgaagcggcaaacttggtggagccaggaatgcttttgggattagggagtggctcgacatctagagaatttatcaaagctgttgctcacaagcataaacaagaaaatttagatattcgtgctgtggcttcttcaaaagagtcgcattctctagccaagagtctaggaattcctttggttgatgacgaagagttcacggaaatagatcttgctgttgatggtgcagatgaaatcgatcctcaattgcgcatgattaaaggtggaggtggagccatttttcgtgagaagatcttattacaatccagtcggcgacggttgatacttgcagatgaaagtaaacatgtgcaggttttagggaagtttggtcttcctatagaaattagtcctttcggtagatcttctattattgctactttgaaaaatttggggtatctaggaaatttaagaaaaaattctcatggaggattttttatcaccaataacagaaattatatttacgatattcatactccaaatgtatatcctcatcccgaggaagacctgctgaagctgctacaaattcatggtattattgaagtcgggtttgttatagcgagcgttgaagtatggtttggttatgccaacggtcagattggtaaaaagaacaccggtagagtatga

SEQ ID NO: 2495 - DNA, 657 bp, Picrophilus torridus DSM 9790
atgtttgaaaatgaaaaaaggatggccgccatggaggccctgaaatttgtcaggaacgatatgcgcataggtataggaacaggctcaacggcatactacttcattgagggtttatcagagcttgttaaaaatggcctgaggataaccggaattccaacatcgaagaagagcgaggaactctgcagatcattcaatataccggtcgattataatataaaggatatagacatagacttcgatggtgcagacgaattcgatccatatggaaatctaataaagggtggtggcggcgcacttgtgcgtgaaaagatcgttgcatacaacagcagggaattctacgttcttgtcgaccattcaaagtactctgaaaggcttcataagtttccgctgcccgtggaggtgcttccatttatgagtgaaaagacccttgaaaacatagagaggcttggatgcagggcatcattccgggatgataaaaaattcatcagcgacaatggcaattacataatagactgcgtttttagttatacagacccggagcttgaatcacagataaagatgatacctggagttgttgaggttggaatattcaggcatctttcaacaaagatattccagggaacaattgatggctgcagaataatagatgttaaataa

SEQ ID NO: 2496 - DNA, 669 bp, Ferroplasma acidarmanus fer1
atgtatgaaaatgaaaaaagaatttctgccatggaggcattgaaacatgtacatagcaatatgaaactcgggctcggaaccgggtcaacaacaaaatactttcttgatgggctcggggaacttgttaaatctggaaaaatcacagatataaccggtgtcccgacatcattgaggactgctgacctggccaagtcctatggaataaaaatagaaaacaaccttgaagggatagaaatagattttgacggggcagatgaatttgatggcagtggaaacttaataaagggtggtggaggtgcacttgtgcgtgaaaaaattgttgcttataacagtaaagaagtgtacataatggctgaccattcaaaattttcagaaaaactgcatagttttccattgcctgtggaggttttgccctttatggaggatgtgacaaagaaaaatattgaaaaaacggggtgcaaagctactttcagggatggaaaaaaatttaagagcgacaacggcaactatatactggactgcaggttcgattttacagatgttgtactggaaacagagataaagatgattcctggagttgttgaagtaggcatcttcagtgggattacaacaaaggtattcataggcgaaaatgagaaatgcagggttatggacttccagaaatcataa

SEQ ID NO: 2497 - DNA, 726 bp, Thermoplasma acidophilum
atggctgattatgaaaagcagaagatgaatgccgcaatcaaggctgctgaatatgtccgcagcggcatgatcgttgggcttggaactggcaccacctcgtactatctgataaatgaaataggaaggcgtgtcagggaagagggactgaaaatacgtgcagtatgcacctccagaaggaccgaggatcttgcgaaacagaacggcatcgaggtcattcagggcacgaaggatcagatagatctaaccatagatggcgcggatcaggtaggcatgtacggaacgctcatcaagggcggaggcggtgcacttcttcgggaaaagatagttgcctacaacagcaaggaaatgtacgttatcgtggacagcaggaagatagaagctgctcactttggaagctttccgctgcccgttgaaatagtgccctttatgcatatgagaacccttgagaatctcagagggatatgcacacagacagatctgaggatgaacgagaaaggcgaacctttcgttacggacaatggaaattacattgcagacatgcacatgggaatgatcgacgatcccatcaatcttgaaagatctctcaagtcaatacctggtgtggttgaggttggcttgttcaacggtatagcgaagaggatctttgaaggcacagacgaaggctgcaacatatacagtataacgaacagcggtatcaaaaaagaggaggtctattttgacccctga

SEQ ID NO: 2498 - DNA, 726 bp, Thermoplasma volcanium
atgccagattatgagaagcagaaaagaaacgctgctgttgaagccgcatcctatgtgaaaacagggatggttataggtatcggcacagggacaacggcccgctatttaattgaggaactaggtagaagagtttctgaagagaatttaaaaataaagggtgtttgtacatctaagaaatctgaagaactcgcaagagctgccggtatagaaatatctgaaaacccagaacagattatagatttaacaatcgatggtgcggatcaggttaatctccatggaacactcataaaaggcggtggaggtgctcttctgagggaaaagatagtcgcatacaacagcaaagagatgtacgttatagttgatagtagaaaaatagatgacgaaaacttcggcagctttcctctaccagtggaagttgtccctttccttcacaggatgacgctagagaatctcaggaagatatgcccatccaccgatctaagaaaaaacagcgatgggacgctcttcataacagacaatgggaactatatagctgatatgaaattcggaaggataagggaaactaatgagcttgaaaaaaagatcaaaagtatcccaggagttgtagatgttggcctcttcaataacatagcggataagatatttgaaggtaacgatgacggctgtaatatatacgtcgtttccgagaagggaagaatagaaaaagagaaaggccaattcaaataa

SEQ ID NO: 2499 - DNA, 678 bp, Candidatus Korarchaeum cryptofilum OPF8
atgatagagttcgagaagagattagtcgctagggaagcgctcaaattgataggtgatgtgaagctattgggcctcggctccggatctacagtcgctatatttgttgaggaattagcaaaatcggataaagcgggcaaaataaaagttataccatcatccaaacagatagaggaagtagctaggaatcagggacttgaggtgatctatcctgatggtgagaggccagagataacggtagatggtgcggatgagatagatagcaatttgaacttgctcaaggggggagggggcgctttactgagggaaaaagttctggcatacaacagttcaacttacgtcattatagcggatcacacgaaattagtggaaaagctctgctcaaagagggctctccccgttgaagtattaccttatggggtctcctggaccctcggtaatctaattaagagatttaattgcgatgcgaggatcaggattaaggatctctcacctttcataactgataacggtaatgtgatagtggacataaactgccctcccttggaggatcctgcttccatggagagcgaggtgaagggggtaccgggagtcgtcgaggtaggtatattcgtcggcctagcggacctggtcttaatagcgaggggaagcgaggtcaaggtcttacgccagggtttttaa

SEQ ID NO: 2500 - DNA, 666 bp, Methanobrevibacter smithii
atgaatcttaaaaaagaagcaggttataaagcagcagaatatgttacagacggagacattttaggacttggaaccggatctacaactcattatttcattgaagcagtaggcaaaagaatagctgatgaaggaataaatgtcatgggaattcctacttcattccagtcattactgcttgctaaacagtggaacataccggttaccagcttggaagagcatgacattgatttggctgttgacggtgcagacgaagtggataaaaaccttaaccttgttaaaggtggaggagcagctcacaccaaggaaaaaattgtggattactctgcaaaacaatttattgtaattgtagatgaatcaaaatatgttgaagaaattggaaactttccggtacctgtggaagtaattcctgatgcatcacgtgtggttatacaaactttagaggacatgggtgcagaatgtgaaataagaatgggtgagcgtaaggacggaccggttataacagataatggaaattttgtcattgatgccaaatttgaaaaaatagaaagccctatgcatttggaaatagatttaaattctattccaggtgttgttgaaaatggtatttttactcagatggttgataaagtcataattggtacttctgaaggtataaaagaattgtga

SEQ ID NO: 2501 - DNA, 681 bp, Methanothermobacter thermautotrophicus str. Delta H
atggaggtatttatgaatctcaagaagatggctgctttgagggcggttgacgaaatagatgatggggatgttgtaggtcttggaacaggttcaacaacccattacttcatagaggagcttggaagacgtgtcagggaggagggactggaggttatgggtgtacctacatcctaccagtcaatgttccttgcagcggagtcagggataaaggttacaagtctcgctgaacatgatgttgatgtggctgttgacggtgcagatgaggttgacccggacctcaaccttataaagggtggtggggccgcccacacccttgagaagatagttgactcatccgccgcgagtttcatagttattgtggacgaatcaaagcttgttgaaagactgggtgccttcccactacctgttgaagtcatacccgcagcttgcaggcctgtgaagctcaaactcgagtcaatgggggcttcagtgaatataaggtcctctgagggcaaggacggtcctgttgttactgataatggtaactttgtccttgacgcggcctttggtgttattgatgatcccggagccatggagtcccggctgaacaacataccgggtgttgttgagaacggcatattcgctggaattgcagatatggttatagcaggtacctctgagggtcttaagattctcaggtga

SEQ ID NO: 2502 - DNA, 696 bp, Methanosphaera stadtmanae
atggtaaatatggatatattaaaagataatgttggaaaaaaagcagctgatttaataaaggatggtcaaatagtaggtttaggcactggttctaccacacactactttataagatatcttggtgagagaattaaaaatgaagaattgaatattcttggaataccaacatcctatcagtctttaataaaagctagagaagctggaattaacacaacaactctagatgaatatgatattgatatagctgttgatggtgctgatgaagtaaatcctacacttgatttaattaaaggaggaggagcagcacacacactagaaaaattagttgatagttctgcaaaaaaatttgttgttattgtagatgaaagtaaagttgttgaagaattaggtaaattcccagttcctcttgaaattattccagaagcattacgtgttgttaaagatactcttgttgatttaggtggaaaaccagagttaagaatgggtattcaaaaagatgggcctgttataactgataatggtaattttattttagatactaaatttgataaaatcagaaatcctcataaattagaaaaggaattaaatattatccctggtgttttagaaaatggtatttttgcaggtcttgctgataaggtaattattggaaaaatgtctgctattgaagaaattgatagggaagatatattatag

SEQ ID NO: 2503 - DNA, 681 bp, Thermococcus gammatolerans EJ3
atggaggagttaaagaaggccgttgcgagggaggccctctctttcgttgacgatgatatggtcataggcctcgggacgggttcaaccactgcctacttcataaagttcctcggggagctcatcaaggaggaggaactggaggtttacggcatacccacttctcaccagtcgagactccttgccattgagagcggggtgcccgttgtgtccctcgacgaggcggacgcaatagacatagcggttgatggggcggacgaagttgatcccgcgttgaaccttatcaaggggcgcggggcggcactgacaatggagaagataatcgagtaccgtgccggcactttcatagttctcgtcgatgagagcaagcttgttaagcgccttggtgagaaaatgccagttccaattgaagtcatccccgcagcttggcgagccatcgcggaggaactggaagtattcaacgcaagggcagagctgaggatggcagtgaagaaagatggacctgtgatcacggacaacggaaacttcatactcgacgcccggtttgagcggatagacgatccccttgacatggagatagaactcaacacgatcccaggagtcgtggaaaacggcatattcgccgatatagctgatgtcgtgctcgttggaacacgggaaggtgttagaaagctcgaacgttaa

SEQ ID NO: 2504 - DNA, 681 bp, Thermococcus sp. AM4
atggaggaattaaagaaggccgtcgccagggaggcgctgtccttcgttgacgacgacatggttataggcctcggaaccggctccactaccgcctacttcataaagttccttggagagctcatcagggaggaggaactcgaaatttacggcatacccacctcccatcagtcaagactcttagcgattgagcacgggatacccctcctctccctagacgaggcggacgcaattgacatagcggttgatggggcggacgaggtcgatcccgctttgaacctcatcaaggggcgcggagcggcgctgaccatggagaagataatcgaataccgcgccggcaccttcgtagtcctcgtagacgagagcaagcttgtaaagcgcctcggcgagagaatgcccgttccgatcgaggtcattccggcagcgtggcgcgccatcgccgaggagctggaggtcttcaacgccagagcggagctgaggatggcggtaaagaaggacgggcccgtgatcacggacaacggaaacttcatactcgacgcccggttcgagaggatagacgatcccctcgacatggagatagagctcaacacgattccaggagtcgtggaaaacggcatattcgcggatatagccgacgttgtgctcgttgggacacgggaaggcgtcaaaaagcttgaacgttaa

SEQ ID NO: 2505 - DNA, 684 bp, Thermococcus sibiricus MM 739
atggaagagctgaaaaaactagctgcaaaagaggctttgcgatatatagatgatgacatgatcattggtttaggtacgggatcaactactgcctacttcattcagatgttaggaaagaagctgatgactgaagaacttgaagacgtttatgggatccccacttctcatcaatctagacttttggcccttgaaagtggtattccggtcgtaacccttgatgaggttgatgcaatagacattgctgttgatggagctgatgaagttgatccgcatcttaacctgattaaaggaagaggagcagcattaacaatggagaagattattgagtatagggccgggactttcatagttcttgttgatgagagcaaattagtggagtatctcggccaaagagtaccggtgccaattgaagtgatccccgccgcttggagggccatcaaagaagagttagaagtttttaacgcaacggctgagcttagaatgggagttaaaaaagatggcccggtgattacagataacgggaattttattctcgatgcgaaattcataaaaattgaagatcctctggacatggaaattgagctcaacaatattcccggggttgtggaaaacgggatctttgcagatattgctgatattattctggtaggcacaaaagagggtgtcaaaaagttagagagataa

SEQ ID NO: 2506 - DNA, 690 bp, Thermococcus barophilus
atgaacactgaagagatgaaaaagctggtcgcaaaggaggctttgaagtatattgaggatgatatgatagttgggttaggcactggttcgacaaccgcttactttatcaaaatgctgggcaagatgattatgaacgaggagctttttgatgtttatggactgccaacttcatatcaagcgagaattctggctttggagagtggagttccggttgttagtttagatgaagttgatgcaatagacatagccgttgacggggcagatgaggttgatccgcatttaaatctaattaaaggcaggggagcagctttaactatggagaaaattatcgagtacagagctggaacttttctcgttctcgttgatgggtccaagcttgtggaatatctcggacaaaaaatgcctgttccaattgaagtaattccagcagcctggagggtcataaaagaagaacttgaagttttcaatgccacagctgagctcagaatgggcgttaagaaagatggccctgtggttacggacaacggaaacttcatacttgatgccaagtttgaaaggattgaagaccctctggatttagagattgagcttaacaacattcccggcgtcgtggagaatggaatctttgctgatatagctgatattgtcttagttggcactaaagagggcgttaagaagttggaacgctga

SEQ ID NO: 2507 - DNA, 684 bp, Thermococcus onnurineus NA1
atggaagaactgaaaagagccgtcgcaaaggaggccctgaagttcatcgaggatgatatggtagtgggcctcggtaccggctcaacaaccgcctatttcatcgagtaccttggcaagctcatcatggaggaggagcttgaggacgtctacggtgttccaacctcttatcaggcacggcttctcgctctcgagtacggcgttccggtggtcaaccttgatgaagttgatgctatagacatagccgtcgacggcgctgatgaggttgacccgtacctcaatctcataaaggggcgcggtgcggctttgaccatggagaaaatcatcgagtaccgcgccggaaccttcctcgtcctcgttgatgagagcaagctcgtggagaggctcggccagaagatgccggttcccatagaggttattcctgccgcttggcgcgcaatagcagaggagctcgaggtcttcaacgccacggctgagctcaggatggcgagcaagaaggacggtccggtcgttacagagaacggtaacttcatcctcgacgcgaggttccacaggatagacgacccgctcgacctcgagatagagctaaacaacatccccggcgtcgtcgagaacggcatctttgctgacatagctgacattgtcctcgtcggtacgagggaaggagttaagaggatggagcgctga

SEQ ID NO: 2508 - DNA, 690 bp, Thermococcus kodakarensis KOD1
atgaacgttgaagaaatgaaaaaggccgtagccaaggaggccctcaagttcattgaggatgagatggtagttgggcttgggaccggctcaacgaccgcctactttatcaattacctcggaaagctcctcatggaaggggagcttgaggacgtttacggcgttccaacttctcaccaggccagacttcttgcccttgaggcgggaattcccgttgtgagccttgacgaagtggatgcaatagacatagccgtggacggggccgatgaagttgacccgcacatgaacctgataaaggggcgcggcgctgccctcactatggaaaaaatcatcgagtatagggccgggatgttcatcgtcctggtcgatgagagcaagctcgttgagtacctgggccagaagatgcccgtgccgattgaggtcatacctgccgcgtggagggcaatcgctgaggaacttgaggtcttcaacgcgacagcggagctcagaatggcggtgaaaaaggacggcccggtcgttactgacaacggcaacttcatactggacgccaagttcgcccgcatcgaggatccgctcgacctcgaaatcgagcttaacacaatacccggtgtggttgagaacggaatattcgccgacatcgccgacataatcctcgttgggactccagaaggcgttaagagaatggagaggtga

SEQ ID NO: 2509 - DNA, 690 bp, Pyrococcus abyssi
atgaacattgaggaaatgaagaaaattgctgccaaggaggcattaaagttcattgaggatgacatggtaatagggttaggaacgggttcaactactgcctactttataagactcctgggcgacatgataaagaagggagaagtaagcgatattgtaggcgttccaacttcttatcagtcaagattgcttgccatagagagcggaattccagttgctacgctggatcaagttgatgcaatagatgtagctgtggatggagcggatgaggttgatccaaatttaaacctaatcaagggcagaggtgcagcgcttacaatggaaaagataattgagtcgagggcaggcatgttcattgttttagttgatgagaggaaactcgttgattacctatgccaaaaaatgcccgttcctatagaggtgattcctcaagcgtggagggccatagtggaggagctcagcatattcaatgctgaagcgaagctcaggatgggagttaacaaggatggcccggtgataactgacaatggaaacttcataatagatgcgaagtttccgaggatagatgatccacttgacatggagatagaactgaacaccatacctggagttgtggaaaacggcatatttgcggatatagctgatatcgttatagtcggaaccaaggagggggttaaaacacttgaaaggtga

SEQ ID NO: 2510 - DNA, 690 bp, Pyrococcus furiosus
atgaatgtggaagaaatgaaaaaggccgtggcaagggcagcacttgagtttatagaggatgatatggtggttggactaggaacaggctccaccacagcatactttataagatatttaggagagatgatagaaaaaggaaaagtagaagatatctatggagtaccacctcctatcaagcaaaaattcttgcgtatggaaagtggggtgccagttctttcattggatcaagtagatgcaatagacatagcggtagatggtgctgatgaagtagatccaaatcttaacttaatcaaaggcaggggtgctgccctcacaatggaaaaaataatcgagtatagggctggaacattcatcgtgctggtggatgagtcaaagcttgtcgattatctctgccagaaaatgccagttccaattgaagttattccagctgcatggaaggcgattttagaagagttaagcatattcaatgcaaaggctgagctcaggatgggagttaaaaaggatggtccagttgttactgaaaatgggaactttatcattgatgcaaaatttccaagaatagatgatcccctcgacatggaaatcgaacttaacactatcccaggagtagttgaaaatggaatttttgccgatatagcggacatagtattagtagggacaaaagaaggagtaaaaagattagaaaggtaa

SEQ ID NO: 2511 - DNA, 681 bp, Methanocaldococcus sp. FS406-22
gtgtcaaatgaagatttaaagctaaaagtagctaaggaagccgtgaagttagttaaagatggaatggttgttggattaggaactggctcaacagcggctttatttataagagagcttgggaataggattaaagaggaagagctaacagtctttggaatccctacatcattcgaagctaaaatgttagccatgcagtatgaaatccccttagttaccttggatgagtatgatgttgatattgcatttgatggagctgatgaagttgaagaaaaaaccctatttttaataaaaggaggcggaggatgccatactcaagaaaaaatagttgattacaacgcagatgagtttgttgttttagttgatgagagcaaattagttaaaaagttgggagagaaattcccaattccagtagaggttattccttcagcctatagggttgtgatgagggcgttatcaaacatgggtggagaggcagtaattagattaggagatagaaaaagagggccagttataacggataacggcaacatgattatagatgtgtttatgaatatagatgatgccatagagcttgaaaaagaaataaataacatccccggagttgttgaaaatggaatatttacaagagtagataaagttttagttggaactaaaaaaggagtcaaaacactaaagaaataa

SEQ ID NO: 2512 - DNA, 681 bp, Methanocaldococcus fervens AG86
gtgtcaaacgaagatttaaagttaaaagtagctaaagaggctgtgaagttagttaaagatggaatggttgttggattggggacaggttcaacagcagctttatttatcagagagcttggaaatagaattcagggggaggaattaacggtctttggaatccctacatcatttgaggctaaaatgttggctatgcagtatggaataccattagtttctttggatgagtacgatgttgatattgcgtttgatggagcagatgaggttgaagaaaaaacgttatttttaataaagggaggaggaggttgccacacccaggagaaaatagttgattacaacgctaatgagttcgttgttttagttgatgaaagcaagttggttaaaaatttgggggaaaagtttccaatacctgtagaggttattccatcagcttatagagttgtgattagagctttgtcagaaatgggtggagaggcagttattaggttaggggagaggaaaagaggaccggttataactgacaatgggaatatgattatagatgtgtttatgaaagttgatgatgcagtagagcttgagaaggaaatcaacaacataccaggagttgttgagaatggaatctttacaaaggtagataaagttttagtagggacaaaaaaaggtgtaaaaaccttgaagaaataa

SEQ ID NO: 2513 - DNA, 681 bp, Methanocaldococcus vulcanius M7
gtgtcaagcgaagatctaaaactgaaagtagcgaaagaagcggtaaaattagttaaagatggaatggttataggtttaggaaccggttcaacatccgctctatttattcgagaacttggaaataggataaaagaagaagaattaacggtctttggtattccaacgtctttcgaagctaaaatgttggcaatgcaatatgaaatacctcttgttagcttagacgagtatgatattgatattgctttcgatggagctgatgaagtggaagaaaaaacgctattcttaataaagggcggaggaggatgccacactcaggaaaagatcgttgactataatgcaggagagttcgttgtattagttgatgaaggaaaacttgtaaaaaaattaggagagaaatttccgattccagtagaggtgattcctctctcctatagagttgttatgagggcattatcagaaatgggaggagatgcagttataaggttaggagaaagaaagagggggcccgttataaccgacaacggcaatatgatcttagatacatttatgaatatagaagatgccgtagaacttgaaaaagagataaataacatcccaggtgttgtggagaacggaatatttacgaaagttgataaggttttagtgggaacaaaaagaggagtgaaaacattaaaaaaatag

SEQ ID NO: 2514 - DNA, 666 bp, Methanocaldococcus infernus ME
atggatttaaagagagctgtagctaaggaagcagctaagttaatcaaagatggctctgttgttggcttgggaagtggatcaacagcagctttatttatagaagagcttgccaaaaggatggaaaatgaggatatagccatctttggagtgccaacctcttatgaggctaagcttttagcctctcactatggaatccctatagtaagtatagaggattatgatgttgacatagctgtagatggagctgatgaggttagaaaaaaagacttagccttaattaaaggaggaggaggatgccacacttgggagaagatagttgattacaatgctaaggaatttgttgttatagttgatgagagcaaggttaaagactctctctccttccctgtccctgttgaagtaattcctcactcttacagggttgtgatgaaaaggctaaaagagcttggtggagaatcagttataaggcttggggagaggaaaagggggccagtgataactgacaatgggaactttatcttagatgttaatataaaagttgagaatgctgaagagttagaggaaaagataaataatatccctggagttgtagagaatggaatcttcagtagagttgataaagttttagttggtacaaagaagggagttaaggctcttaaaaaataa

SEQ ID NO: 2515 - DNA, 720 bp, Methanococcus maripaludis
atggctaggactaaaaaagctaacgatgaagtacccacgaattctgattctttgaagttaaaagttgcaaaacaggctgcaaaacttgtaaaagatgaaatggttgtaggacttggttcaggctcaacagcaaatcttttcattcaggaacttggaaaaagaattgttgaagaagaattatacatttacggggttcctacttcattcgattcaagaatggtagcaagtactgccggaattccattaatttcacttgatcaatgtggtgaaattgacattgcagtagatggtgcagatgaagtttgcaaaagcactctttcactaataaagggtggcggtggatgccacacaatggaaaaaatcgtggactaccatgcaaaagagttcatcgttttggcagatgaaggaaaattagttgattcattaggtgataaaactccggttccattagaagtaattccatttgcttattccacagttttaaacaaacttttaaaaatgaatactgcacctgcaatcaggactggttctggaaaaatgggacctgtaattacagacagcggaaacatgattattgatgtattcatcagcattgatgatgcagaagaaaccgaaaacatgttaaataatattcctggagttttagagaacggggtattcagcaaatgtgataaagtacttgttggaacttccaaaaaagtagaaatactcaagaaataa

SEQ ID NO: 2516 - DNA, 720 bp, Methanococcus maripaludis
atggctaggactaaaaaagctaacgatgaagtgcccacagattctgattctttaaagttaaaagttgcaaaacaagcagcaaaacttgtaaaagacgaaatggtcgtgggacttggttcgggctcaacggcaaatcttttcattcaggaacttgggaaaagaattgttgaagaagaattatatatctacggggtacccacatcttttgattcaagaatggtggcaagtactgcgggaattcctttaatttcacttgatcaatgtggggaaatcgacatcgcagtggatggtgcagatgaagtctgtaaaagcactctttcactcataaaagggggtggcggatgtcacacaatggaaaaaattgtggattaccatgcaaaagagttcatcgtattggcagatgaaggaaaattagtcgattcattaggggataaaactccggtgcctttagaagtaattccatttgcttattctacaattttaaataaacttttaaagatgaatactgcacctgtaatcagaactggatctggaaaaatgggaccagtaattacagacaatggaaacatgattattgatgtattcatcagtatagacgatgcagaagaaactgaaatcatgttaaataatatccccggagttttagagaatggggtattcagcaaatgtgataaagtacttattggaacttccaaaaaagtagaaatactcaagaaataa

SEQ ID NO: 2517 - DNA, 720 bp, Methanococcus maripaludis
atggctaggactaaaaaagctaacgatgaagtgcccacagattccgattcgttgaagttaaaagttgcaaaacaggctgcaaaacttgtaaaagacgaaatggttgtgggacttggttcaggctcaacagcaaatcttttcattcaggaacttggaaaaaggattgttgaagaagaattatacatttacggagtacctacatcttttgattcaagaatggttgcaagcaccgctggaattcctttgatttcacttgatcagtgtggggaaattgaccttgcaatagatggtgcagatgaagtctgtaaaagtacccttgcactcataaaaggcggcggcggatgtcacacaatggaaaaaattgtggactactatgcaaaagaattcatcgttttagcagatgagggaaaattagtagattcattgggggataaaactccagtacctttagaagtaattccatttgcatattctacagttttaaacaaacttttaaaacttaacaccgcacctgcaatcagatcaggttctggaaaaatgggtcccgtaattacagacagtggaaacatgattattgatgtattcatgagtattgaagatgcagaagaaactgaaatcatgttaaacaatattcctggagttttagagaacggagtatttagtaaatgtgataaagtacttgttggaacttccaaaaaagtagaaatactcaagaaataa

SEQ ID NO: 2518 - DNA, 720 bp, Methanococcus maripaludis
atggctaggactaaaaaagctaatgacgaagtagccacagattccgattctttgaagttaaaagttgcaaaacaggctgcaaaacttgtaaaagatgaaatggttgtgggacttggttcgggttcaactgcaaatcttttcattcaggaacttggaaaaagggttgttgaagaagaattatatatttacggggtacctacatcttttgattcaagaatgatggcaagtaattctggaattccgttaatttctcttgaccagtgtggggaaattgacattgcaatagatggtgcagatgaagtctgtaaaaagactctttcacttataaaaggtggcggtggatgccacacaatggaaaaaattgtagattaccatgcaaaagagttcgttgtattggctgatgaaggaaaattagttgagtcattaggggacaaaacagcggtacctttagaagtaattccttttgcatattctacagttttaaacaaacttttggatatgaacactgcacctgcaattaggtcaggttctggaaaaatgggtccagtaattacagataatggaaacatgattattgatgtatttatcaatattgaggacgcagaagaaactgaaaccatgttaaacaatattcctggtgttttagagaatggaatatttagtaaatgtgataaagtgcttgttggaacttctaaaaaagtagaaatactcaaaaaataa

SEQ ID NO: 2519 - DNA, 720 bp, Methanococcus vannielii
atggcaaaacctaaaaaatctgacgaagaggtatcaatagattccgattcactaaagataaaagttgcaaaagaagctgcaaaacttataaaagatgagatggttgtaggacttggttctggttcaactgcaaatttattcattcaagaacttggaaaacgagttattgaagaagaactttatatttatggcgttccaacgtcatttgactcaagaatgatggcaaatcagtctggaattccattaatttcactggatcaatgtggtgaaattgatatagcaatagatggggcagacgaaattgataaaaagactttttcattaataaagggcgggggtggatgccatacaatggaaaaaattgttgattattatgcaaaagagtttgtagttttggcggatgaaagtaaaatggttgattcacttggtgaaaacacccctgttcctttagaagtaatccctttttcgtattcaactgttttaagtaaacttttaaaaattaatgcggcacctgcaataaggtcaggttctggaaagatgggccccgtaattactgacaatggaaacatgataatagatgtatttataaacattgaagatgcagaagaaaccgaaacaatgctaaacagtattccgggagttttggaaaacgggatatttacaaagtgcgataaagtacttattggaacttccaaaaaagttgaagttttaaagaaataa

SEQ ID NO: 2520 - DNA, 708 bp, Methanococcus voltae
atggctaagaaaaaatccgcagaaacacaagatgatttaaaattaaaagtagcacaagaagcatctaaattagtaaaagatgaaatggtaatcggtttaggttcaggttcaaccgcaaacatgtttatcaaagaattgggtaaaagaatcgtagatgaggaattatatatttacggagtacctacatcttttgatgctaaaatgttagcaagtcaatgtggtatacctttagtttcactcgaccaagctggacaaatcgaccttgcagttgatggtgctgatgaagtagaagaaggaagtttatcacttattaaaggtggtggtggttgccatacaatggaaaaagttatcgactactctgctaaagagtttgtagtgttagttgatgagagcaaagttgtagcttcattaggggaaaatacaccggtacctttagaagtattgccatttgcatattcaacagttttaaacacattattagaaatgaatacagcaccatccattagagtttcaggcggtaaaatgggtccagttattacagataatggaaatatgataattgatgtattcactaaaatagatgaagctgatgtaaaggaaaaagaattaaataacatcgtaggagttgtagaaaacggtattttctcaaaatgtgataaggtactcgtaggtaatgactctaaaaaagtaaaggttttaaaaaaataa

SEQ ID NO: 2521 - DNA, 705 bp, Methanococcus aeolicus
atggcaagaaaaaaagcagttaaagtagaagctgacccaagattaaatgcagtaaatgaggcccttaaatttataaaagatggaatgattgtaggattgggctcagggactacggcaaatttatttatcgcggaattgggcaaaaaaatatcggaagagggtttaaatgtatttggagttccaacatcattcgaatctcgaatgatggctattcagtatggcatcccattggtatctcttgacgaatatggagagttagatattgcggtggatggtgctgatgaagtgaataaagagacattaaatgttataaaaggtggcggtggttgccatactcaagaaaaaataattgattattgtgcaaaagagctcataattattgtggatgaaagtaagcttgtggattcattgggggaaaatacaccagttcctcttgaagttcttccatttgcatattcttccgtattaaatgaattattgaaaatgaattcagcaccttcaattaggatggcagataaaaaaatgggcccagtgattacagataatggaaatatgattattgatgtatttattgatttaaataatcccgaagaagttgaaaaacaattaaacaatattccaggggttgtcgaaaatggtatatttacaaaagttgataaagtgatagtaggaaaatctgataaggcagaaatattaaaaaaataa

SEQ ID NO: 2522 - DNA, 696 bp, Prochlorococcus marinus
atgaaacaaatagttgctgactcagctattgaagaagtagaagatggaatgatcttaggtttaggatctggatcaacagcagcacttatgataaaaagtcttgctgaaaaaatcagatcaggcaaattaaaaaatattaaaggagtcccgacttcctttcaatcagaggtgcttgcattagaactcaatatccctttaattgatttagcttcagttccttacattgatttagccattgatggagcggatgaagtagatcctgactttcaactcatcaagggtgggggagcttgccatgtccgagaaaaattggttgcatctaaagcaaataaattattaattgttattgatgaatcaaagttagtgcaaaatttaaaccaagttttccctctccctgtggaggttatgccttctgcgtggaagcaggtgaaggatataatttcagaaatgagtggagtttctaatttaaggatggcaacaaaaaaagcaggcccagttgtcacggatcaaggtaatttgattttggatgttttatttgatgctggcataagagatccaaaagatttagaaatgcgtattaataatattcctggagtcttggaaaatggattatttgttgatttagcagataaggttttggtgggtaaaattgaagatgacgttccagtattattttcaccttctaggagaagttaa

SEQ ID NO: 2523 - DNA, 696 bp, Prochlorococcus marinus
atgaaacaaatagttgctgatgcagctgttaaagaggtgaaagatggaatgatcgtaggtttagggtctggttcaactgcagcactcatgataaaaagccttgctgaacaaatcagattaggcaaattaaaaaatattaaaggagttccaacttcttttcagtctgaggttctttctctagaacttaagattccattaattgatttagcttcagtttcccaaattgatttagctattgatggggcagatgaagtggatcctgattttcagttaatcaagggaggtggagcctgccatgtccgagaaaaattggttgcatctaaagcaaataaattattaatagttgttgatgaaactaaattagtgcaacaattaaacttagtttttcctctacctgtagaggttctaccttctgcttggaagcaggtgaaggatataatttctgaaatgaatggagtttctgatttgaggatggcaacaaaaaaagcaggacctgttgtcacggatcaaggtaatttgattttggatgtcttatttaatactggtatcaaagatccaaaagatttagaaatgcgtattaataatattcctggagtattggaaaatggattgtttgttaatttaacagataaggttttggtgggtaagattgagaacaatgttccagtgttattttcaccttccaaggggagttaa

SEQ ID NO: 2524 - DNA, 696 bp, Prochlorococcus marinus
atgaaacaggtagttgctgatgcagcaataagggaagtaaagagtgacatgattcttggattaggttctggatctactgctgcgttaatgataaaaagccttgcggatgaaatgcgttctgggaaactccaaaatataagaggtgttgcaacttcttttcaatcagaagttttagcgcttgaattgaatatcccgcttatcgatttagcttctgtatctcaaattgatttagctattgatggagcagatgaagttgatccgggatttcaattaattaaaggaggaggagcatgccatgtcagagaaaaattagtagcatctaaatctgatcaattgttgattgttgttgatgaaactaaacttgtccaaaatttaaatctatcttttcctttacctgtagaagttcttccaaatgcttggaagcaagttcaggaagttatttcagaaatgaatggcagttcttctttaagaatggctaataaaaaagctggcccagttgttactgatcaaggcaacctagttctagatgttttatttaatgatggtattaagaatccaaaagacattgaaaaaactattaataatattccaggagttttagaaaatggattattcgtcgatcttacagacaaagttctagtgggtaaaattgaaaataatactccagtggtttactcaccctcaagagttagctaa

SEQ ID NO: 2525 - DNA, 696 bp, Prochlorococcus marinus
atgaaacaagttgttgctgatgcagcaataagggaagtaaaaagtgacatgattcttggattaggttctggatctacagctgcgttaatgataaaaagccttgcggatgaaatgcgttctgggaaactccaaaatataaaaggtgttgcaacttcttttcaatcagaagttttagcgcttgaactgaatatcccccttatcgatttagcttctgtatctcaaattgatttagctattgatggagcagatgaagttgatccaggatttcaattaattaaaggaggaggagcatgccatgtgagagaaaagttagtagcatctaaagctgatcaattgctgattgttgttgatgaaactaaacttgtacaaaatttaaatctatctttccctttacctgtagaagttcttccaaatgcttggaagcaagttcaggaagttatctcagagatgaaaggtagttctactttaagaatggctactaaaaaagctggcccagttgttactgatcaaggcaatctaattcttgatgtattatttgatgatggcattaataatccgaaagacattgaaatgaagattaataatattccaggagtattagaaaatggattattcgttgatcttacagataaagtattagttggtaaaattgaaaacaatactccagtggtttactcaccatcaagagctagctaa

SEQ ID NO: 2526 - DNA, 696 bp, Prochlorococcus marinus
atgaaaaaaatagttgcggatgcagcgataaaggaagttgagagtgacatgattcttggattaggatctggatctacagctgctcttatgataaaaagccttgcagatgaaatacgttctggaaaacttcaaaatataagaggtgttgcaacttcctttcaatcagaagtcttagcgctcgaacttgatatcccgcttatcgacttagcttcagtatcccaaatcgatttagctattgatggagcagatgaagttgatccgagatttcaattaataaaaggaggtggagcatgtcatgttagagaaaagttagtggcatctaaagctaatcgattattgattgttgttgacgaaactaaacttgttcaaaacttaaatcaaactttccctcttcctgtagaggtccttccaaatgcttggaaacaagtagaggaagtgatctcagagatgaaaggtagttctagtttaagaatggctactaaaaaagctggtccaattgttactgatcagggtaatttgattttagatgtgttttttgatggtggtattaagaatccaaaagatattgaattgagccttaataatattcctggcgtcttggaaaatggattatttgttgatcttacagataaagtattggttggtaagattgaaaataatattccagttgtttattctccttcaaaatttggctaa

SEQ ID NO: 2527 - DNA, 696 bp, Prochlorococcus marinus
atgaaaaaaatagttgcggatgcagcgataaaggaagttgagaatgacatgattcttggattaggatctggatctacagctgctcttatgataaaaagccttgcggatgaaatacgttctggaaaacttcaaaatataagaggtgttgcaacttcctttcaatcagaagtcttagccctcgaacttgatatcccacttatcgatttagcttcagtatcccaaatcgatttagctattgatggagcagatgaagttgatccgagatttcaattaataaaaggaggtggagcatgtcatgttagagaaaagttagtggcatctaaagctaatcgattattgattgttgttgacgaaactaaacttgttcaaaacttaaatcaatctttccctctacctgtagaggtccttccaaatgcttggaaacaagtagaggaagtgatctcagagatgaaaggtagttctagtttaagaatggctacaaaaaaagctggcccgattgttactgatcagggtaatttgattttagatgtgttttttgatggtggtattaagaatccaaaagatattgaattgagccttaataatattcctggcgtcttagaaaatggattatttgttgatcttacagataaagtattggttggtaagattgaaaataataatccagttgtttattctccttcaaaatttggctaa

SEQ ID NO: 2528 - DNA, 714 bp, Prochlorococcus marinus
ttgaattcacaaactcaaatgaaacaaatagttgctgaagcagcaattgaggaagtaaagagtgacatgattctcggattaggatctggttctacagctgtgcttatgataaaaagccttgctgatgcaattcgttctggaaaactgcaaaatataaaaggtgttgcaacttcctttcaatcagaagttttagcgctcgaactggatatcccacttattgatttggcttctgtttctcaaatcgatttagctattgatggagcagatgaagttgatccgggttttcaattaattaaagggggaggagcatgtcatgttagagaaaagttagtggcatctaaagctaatcaattgttgattgttgttgacgaaacgaaactcgtacgaaaattaaatcaatcttttcctttacctgtagaagttcttccaaatgcttggaaacaagttcaggaagtgatttcagaaatgaatggcatttctactttaagaatggcgactaaaaaagctggcccagttgttactgatcagggcaatctaatcctagatgtattgtttaatgatggtattaagaatccaaaagatattgaaaagagtattaataatattccaggagtattagaaaatggattattcattgaccttacagacaaagtattggttggtaaaattgaaaacaatattcctgttgcttactctcccgcaaaagttggctaa

SEQ ID NO: 2529 - DNA, 714 bp, Prochlorococcus marinus
atgacagatctgcaaacacaaatgaaaatagcggtagctcaagaggctatcggtgagataaaagacggaatgatccttggtcttggctcagggtctactgctgctttgatgattaagtctttaggtgaaaaacttaaagaaggttccctcaaagagataattggtgttccaacttctttccaaggcgaagtacttgcttctcagcttgggatacctttaagagctttttcagcagttagcaaaatcgatttagccatagatggtgctgatgaggtggatcctaattttcagctaattaagggaggaggggcttgccatgttcaagagaaacttgttgcttctattgcagatcgttttgttgtagtggttgattcaactaaaattgtagagaagttaaatctcgaatttaagcttcctgttgaggtgttacctgcggcttggaaattggtccaaaaggagctgaatgacttaggagcaaaatctgatcttcgaatggcggagaaaaaagctgggccaattgttactgatcaagggaacttagtccttgatgtgcaatttgcagatggaatttcagatcctcagaatcttgaaaaacaaataaataattttccaggagttttggagaatggtttatttgtcaatctgacagatgaagttttggttggtgaaattaaaaatggtgtatcgagtgttaatcgtctgaagaaggcttag

SEQ ID NO: 2530 - DNA, 714 bp, Prochlorococcus marinus
atggaagatttgcaaactcaaatgaaagaggctgttgctaaagcagctattgagcaaattcacgatgggatggttctaggacttggctcaggatcaaccgctgccttaatgattaaagccttaggggcaaagatctcgtcaggtcatctcaaagatattgttggagtgacaacttcgtttcaaggagaagtccttgcaactgaacttggcattcctttacaaggtctatcagctgtctcgcaaattgatttagcaatagatggtgctgatgaagttgattctaattttcaattaattaaaggcggtggtgcttgccatgttcaagaaaaacttgttgcttctttggctgagcgttttgtagtggttgttgattccagtaaaattgttaagactctaaatctcacttttaaactgcctgtagaagttttgccttcagcttggcaattggtgaaaaataagattcacgaaattggcggagtaagtcagcttcgaatggcgcaaaagaaagccggtccaattgtcacagatcaggggaatttggttttagatgtaacttttgcaggtggtataaacgaccctcaaacccttgaaaagcaaatcaataatatacctggtgtccttgaaaatggcttattcgttaatcttgcagatgaggtattagttggagaaattgtatctggaaccccaggtgttaaatctcttcagaagatttag

SEQ ID NO: 2531 - DNA, 711 bp, Prochlorococcus marinus
atggatctccaaaaccagatgaaaaaagcagttgctcaagctgctgtagatcaaattcaaaacggtatgattctaggccttggctctggttctacagcagctttgatgattgaagctcttgctataaaaataaaatcaggagaaattaaagatgttgttggagtgactacatcttttcagggtgaagttcttgcttctgaattaggcataccacttaaatctctttcatctgtttcagaaattgatcttgcaattgatggtgctgatgaagttgatcccaaatttcaattaatcaaaggaggaggagcttgccatgtgcaggaaaaacttgttgctgctttagctaaaaaatttatagttgttgttgactcaactaaacttgttgaaaaattgaaccttgatttcaaattacctgtagaggttcttccttctgcttggaaacaagtacaaaaaacattaataaatcttggaggagaagggaatctaaggatggctcagaaaaaggccggacctatagttactgatcagggaaacttgatactggatttaacctttaggaacggtattgatcaacctgaactattggaaactcaaatcaataatattccaggtgtccttgaaaatggactttttgtaaacctgactgatgaagtattggttgggaaagtagaaagtgatgttgtgggtgttgaatcacttaaaaagatttag

SEQ ID NO: 2532 - DNA, 711 bp, Prochlorococcus marinus
atggatctccaaaaccagatgaaaaaagcagttgctcaagctgctgtagatcaaattcaaaacggtatgattctaggccttggctctggttctacagcagctttgatgattgaagctcttgctataaaaataaaatcaggagaaattaaagatgttgttggagtgactacatcttttcagggtgaagttcttgcttctgaattaggcataccacttaaatctctttcatctgtttcagaaattgatcttgcaattgatggtgctgatgaagttaatcccaaatttcaattaatcaaaggaggaggagcttgtcatgtgcaggaaaaacttgttgctgctttagctaaaaaatttatagttgttgttgactcaactaaacttgttgaaaaattgaaccttgatttcaaattacctgtagaggttcttccttctgcttggaaacaagtacaaaaaacattaataaatcttggaggagaagggaatctaaggatggctcagaaaaaggctggacctatagttactgatcagggaaacttgatactggatttaacctttaggaacggtattgataaacctgaactattggaaagtcaaattaataatattcccggtgtccttgaaaatggactttttgtaaacctgactgatgaagtattggttgggaaagtagaaagtgatgttgttggtgttgaatcacttaaaaagatttag

SEQ ID NO: 2533 - DNA, 720 bp, Synechococcus sp. WH 8109
atggctgatctacagacccagatgaagcaggcggtagctgatgccgctgtggaacagatcaaagatggcatggtgctgggcctggggtcaggctccaccgccgccctgatgattcagggcctgggggccaagctcgctagcggagaactcaaagagatcgtcggtgtcaccacctccttccagggagaggtgctggccgctgagctcaacatccccctgctcagcctcaacgccgtaagccggattgatctggccatcgatggtgccgacgaagtcgaccctggcttccaattgatcaagggtggtggcgcttgccacgtgcaggaaaaactcgtggcggcacgggcggatcgttttgttgtggtcgtggactccaccaaactggttgaccgtctcaacctcggttttctgctgccggtggaagtgcttcccggggcctggcgacaggtgaagcagcagctggaagctctcgggggcagtgctgatctgcgcatggcccagcgcaaggccggccctgtggtcaccgatcagggcaacctggtgctggacgccaagctcgatggcggcatcagcgatccagtggccctggagcagacgatcaacaacatccccggtgttctggagaacggtctgttcgtcaacatcaccgatgaggtgttggtcggcgagatcaccgatggtgttgccggtgtccgcagcctggagaagcgcctcagctga

SEQ ID NO: 2534 - DNA, 720 bp, Synechococcus sp. CC9605
atggctgatctacagacccagatgaagcaggcggtggctgatgccgccgtggaacagatcaaggacggcatggttctgggcctggggtcaggctccaccgccgccctgatgattcagggcctgggggccaagctcgccagcggagaactcaaagacatcgtcggtgttaccacctctttccagggagaggtgctggccgctgagctcaacatccccctgctcagcctcaacgccgtcagccggattgatctggccatcgatggtgctgacgaagtcgaccctggcttccaattgatcaagggcggtggcgcttgccacgtgcaggaaaaactcgtggcggcacgggcggatcgttttgtagtggtggtggactccaccaaactggtggaccgtctcaacctcggttttctgctgccggtggaagtgctacccggggcctggcgccaggtgaagcagcagctggaagctctcgggggcagtgctgagctccgaatggcccagcgcaaggcaggccctgtggtcaccgatcagggcaacctggtgctggacgccaagctcgatggcggcatcagcgatccagtggccctggagcagacgatcaacaacattccaggtgtgctggagaacggcctgttcgtcaacatcaccgatgaggtgttggtcggtgaaatcactgatggcgttgcgggtgtccgcagtctgcagaagcgcctcagctga

SEQ ID NO: 2535 - DNA, 720 bp, Synechococcus sp. WH 8102
atggccgatctccagacccagatgaagcaagcggtggccgatgccgccgtcgagcagatcaaggacggcatggttctgggtctcgggtccggttccacggctgccctaatgatcaaagccctcggggcaaagctggccagtggtgagctgaaggacatcgttggtgtcaccacctccttccaaggtgaggttcttgccgctgagctcaacattcctctgctcagcctcaatgcggtggatcgcatcgatttggccattgatggcgccgatgaagtggatccaggctttcaactgatcaaaggcggcggtgcctgtcacgttcaggagaagctggtggcggctcgcgccgatcggttcgttgtggtggtggattccaccaagctcgtggagcggttgaacctgggatttctgttgccggtggaagtattacccggtgcctggcgtcaggttcagcagcagctggcagctctcggcggcaaagccgaactgcgcatggcccagcgcaaagctggtccggtggtgaccgatcagggcaatctcgttctcgatgtgacgatgaacggagggatttccgatccggcggcactggaatcaacggtgaacaacattcccggtgttctggagaacggcctgttcgttgatctcgttgatgaggtgctggttggtgagatcaccgatgggtctgcgggggttcgcagcctggagaagcggctcagctga

SEQ ID NO: 2536 - DNA, 720 bp, Synechococcus sp. CC9902
atggcggatcttcaaacgcaaatgaagcacgcggttgctgatgccgcggtcgagcagatcaaagacggcatggttctcggtcttggttccggatccactgcagcacttatgattcgcgctcttggagcgaagctcgcttcaggagaacttaaaaatattgtgggtgtgacaacttcctttcaaggggaggttttggccgccgaactgaacatccctttattgagtcttaacgctgttgatcggatcgatctggccatcgatggtgccgatgaggtggatccgagttttcagctcattaagggtggtggtgcatgccatgttcaggaaaaactggttgcagccatggctgatcgatttgtggtggtggtggactccacgaaactggtcgatcgtctcaacttggactttttattgccggtggaggtgttgccaggggcttggcggcagatccaaaagactttggccgcaatgggaggcagtgccgagcttcgtatggcccagcggaaggctggtccggtggtgaccgatcagggcaatcttgtgctcgatgtgaagctcgagggtggaatcaccgatccagcttctttagagaaggcaatcaacaacgttccaggcgtgttggaaaacgggttgttcgtcaatctcaccgatgaagttttggtgggtgaaatctcggatggtgttgcaggcgttcgcagccttgagcggcgccttagttga

SEQ ID NO: 2537 - DNA, 720 bp, Synechococcus sp. BL107
atggcggatcttcaaacccaaatgaagcaagcggttgcagatgccgcggttgagcaaattaaaaacggcatggttcttgggcttggttccggatccactgccgcactcatgattcgcgctcttggagccaagctcgcttctggggaattaaaaaatattgtcggtgtgacgacctcatttcaaggggaggttttggccgctgagttgaacatccctctgttgagtctcaacgcggttgatcggatcgatctggccatcgatggtgccgatgaggtggatcccagttttcagctcatcaaaggtggcggagcatgccacgttcaggaaaaactggttgcagccatggctgatcgatttgtggtggtggtggattccacgaaactggtcgaccgtctcaacttggatttcttgttgccagtggaggtgctgcctggggcttggcgccaagtccaaaagaccctggcatccatgggaggtagcgctgaactgcgcatggcccagcgaaaggctggcccagtggtgaccgatcagggcaatcttgtgctcgatgtgaagctcaacggtggaatcgacgatccagcctccttagagaagtcgattaacaacattccaggcgttttggaaaacggtttatttgtgaacctgaccgatgaggtgttggtgggtgaaatctccgatggtgttgctggcgttcgcagccttgatcgacgccctagctga

SEQ ID NO: 2538 - DNA, 714 bp, Synechococcus sp. RS9916
gtggatcttcagacccagatgaagcatgcagtggcagcggccgctgtggatcagatcaaagacggcatggtgcttggactcgggtccggctcaacggccgctttgatgatccagggcctgggcgccaagctcgcaagcggtgagctcaaggacatcgtcggcgtgaccacgtcgttccaaggtgaggttcttgcagccgagctgaacattcccctgctcagcctcaacgcggtggatcgaatcgatctggcgattgatggtgctgatgaggttgatcctggatttcagctgatcaaagggggtggtgcctgtcacgtgcaggagaagctcgtggcggcacgggctgaacgcttcgtggtggtcgtggattccaccaagttggtcgatcgcctcaaccttggtttcctgctcccagtggaggtgcttcccggtgcctggcgtcaggttcagcagcagcttgcagccatgggtggcacggccgaactgcggatggctcagcgcaaggcagggcccgtggtcaccgaccagggaaatctcgttcttgacgtgaagatgaacggtggcatcgccgatcccgcagctctcgagctggccatcaacaacatccccggtgtgctggaaaacggtttgttcgtgaacctggccgacgaggtgctcgttggtgaggtcaatggtgatgtcgccggggtgcggagccttgagcgtcgcgcctga

SEQ ID NO: 2539 - DNA, 717 bp, Prochlorococcus marinus
atggcggaccttcaaactcagatgaagcaagcggtggcggcagccgctgtggagcagatcaaagatggcatggttcttggtttgggttcaggctcgacggcagctctgatgatccaggctcttggtgccaagctggccagtggtgagcttcgggacattgttggcgttaccacctctttccaaggcgaagtgatggctgcggagttggggattcccttgcgcaacctcacggccgtggatcgcatcgacttggcgatcgatggagctgatgaagttgatccctcttttcagttaattaaaggtggcggggcctgccatgtgcaggagaagcttgtcgccagtagagcggatcgctttgtggttgttgttgattccacaaagattgttgatcggctcaaccttggttttttacttccggttgaggtcttgcctggtgcttggcgacaggtgcagggtcgcttggctgagttgggcggtattgctgatttgcgtatggctcagtgcaaggctggtcctgtggttaccgatcagggcaatctcgttttggatgtaagcatggccggaggtattggtgaccctgaggatctggagtgtcgaattaacaatcttccgggtgtcttagagaacggtttgttcgtcaatctcaccgatgaagttttggttggccagattagtgatggtgttgcgggagtgcgtcgtctacagcgccgtgagtag

SEQ ID NO: 2540 - DNA, 717 bp, Prochlorococcus marinus
atggcggaccttcaaactcagatgaagcaagcggtggcggcagccgctgtggagcagatcaaagatggcatggttcttggtttgggctcaggctcgacggcagctctgatgatccaggctcttggtgccaagctggccagtggtgagcttcgggagattgttggcgttaccacctctttccaaggcgaagtgatggctgcggagttggggattcccttgcgcaacctcacggccgtggatcgcatcgacttggcgatcgatggagctgatgaagttgatccctcttttcagttaattaaaggtggcggggcctgccatgtgcaggagaagcttgtcgccagtagagcggatcgctttgtggttgttgttgattccacaaagattgttgatcggctcaaccttggttttttacttccggttgaggtcttgcctggtgcttggcgacaggtgcagggtcgcttggctgagttgggcggtattgctgatttgcgtatggctcagtgcaaggctggtcctgtggtcaccgatcagggcaatctcgttttggatgtgagcatggccggagggattggtgaccctgaggatttggagtgtcgaattaacaatcttccgggtgtcttggagaacggtttgttcgtcaatctcaccgatgaagttttggttggccagattagtgatggtgttgcgggagtgcgtcgtctacagcgccgtgagtag

SEQ ID NO: 2541 - DNA, 714 bp, Synechococcus sp. RCC307
atggcagacctgcagacccagatgaagcaggccgttgccttggctgccaccgatcaggtcaagaacggcatggtgctgggtttgggttcaggctccacggcggccttgatgattcaggaggtgggcgctcggctgcgcgatggccgcctcaccgacatcgtcggcgtcacaacctcatttcaaggcgaggttctcgcggccgaactggggatcccgttgcaatccctcaatgccatcgatcggattgatttggccattgatggcgctgatgaggtggatcccgcttttgaactgatcaaagggggtggtgcttgccatgtgcaggagaagttggtggctcgccgcgctgagcgtttcgtggtggtggtcgacagcaccaagctggttgagcgcctcaaccttggcttcctcttgccggtggaggtgctggctggcgcttggcgccaagtgcaggctgagttgcagcaactgggtggtagcgctgaattgcgcatggcccagcgcaaagcaggtcctgtcgtcaccgatcagggcaatttggtgctggatgtgagctttgctggtgggatcaacgaccccgctggactggagaccaccatcaacaacatccctggcgtgttggagaacggtttgtttgtggggctagctgatcaggtgctggttggcgagatcaacgatggtgtggccggtgtgagggatctggtcaaatcttga

SEQ ID NO: 2542 - DNA, 717 bp, Synechococcus WH7803
atgtcggatcttcaaaaccagatgaagcaggccgttgctgatgcggctgtgcagcagttccgcgacggcatggtggttggtttggggtcaggctccacggcggcgctgatgatcaagggtttgggtgaacgccttgctgctggtcagctgagcgacatcgttggggtgaccacgtcgttccaaggcgaggttctcgctgcagagttgggaattcccctgcgcagtctcaacgccgtggaccggattgatctggcgatcgatggtgccgatgaagtggaccctgcgttccaattgatcaagggaggtggcgcttgccacgtgcaagagaagcttgttgcagcccgcgcagaccgtttcatcgtggtggtcgattccaccaagcttgtggagcgcctgaacctcgggtttttgcttcctgttgaggttctgcctggagcctgggttcagatcagccagcaactgaaagcgatgggcggtgacgccgaactgcgcatggccacgcgcaaggcgggtccggtggtgaccgatcagggcaatctggttctggatgtgcgatttgaaggcggtatcgctgaccccgcgtcgctcgagaaagagatcaacaacattcccggagtgcttgaaaacggccttttcgtcaatctggccgacgaggtgctggtcggccagatcgatggtggtgttgccagcgcgcgcagcctcgagaaggccggttga

SEQ ID NO: 2543 - DNA, 717 bp, Synechococcus WH7805
atgtcggaacttcagaatcagatgaagcaggccgtcgctgatgctgcagtggagcaattccaagacggcatggtggttgggcttgggtccggctcaacagcggccctcatgatcaagggattgggtgaacgccttgctgcaggtcaactgaacgacatcgtgggagtcacaacgtctttccagggtgaagttcttgcagctgaactagggattcctctccgcagcctcaatgcggtggaccgaatcgatctggcgatcgacggtgctgatgaggtcgacccttcgttccaactcattaagggtggtggtgcttgccatgtgcaggagaaacttgtcgctgctcgagctgaccgtttcatcgtggtggtcgattccaccaagctcgtggagcgtttgaatcttgggtttttgcttcccgtcgaggtcctgcccggtgcctgggtgcagattcgccagcaactgaatgccatgggtggcgaagccgaactgcgcatggccacccgcaaggccggtcctgtggtgaccgatcagggcaacctggttctggatgtgcgatttgagggtggcatcgctgatcccgtctctcttgaaaaggacatcaacaacattcccggcgtccttgagaacggtctgttcgtcaaccttgctgacgaggtcctcgttggacaggttgatgatggtgttgccagcgcacgcagccttgagagggcccgctga

SEQ ID NO: 2544 - DNA, 717 bp, Synechococcus sp. CC9311
atgtcggatctccaaactcaaatgaagcaagccgtcgcggaggcggctgttgcacagattcgtgatggcatggtggtgggcctcggttctgggtctactgccgctttgatgattgaaggcctcggggcccgactggcagcaggtcagcttcgtgacattgtcggcgtgaccacgtcgtttcaaggagaggtgcttgccgctgagttggggattcctttgcgtgctttgaacgccactgatcgcatcgatttagcgattgatggtgctgatgaagtggatccttcctttcaattgatcaaaggtggtggtgcctgccacgtccaagaaaagcttgttgctgaccgagcagaacgtttcattgtcgtggttgattccacgaagcttgttcggtgtttaaatctcgatttcttactaccagttgaagtgctcccaggagcatgggtgcaagttcaatccaggctcaaatcaatgggaggagttgcagaactgcggatggcaacccgtaaagctggcccggtggtgaccgaccagggcaaccttgttctagatgtgcgatttgagaatggaatctctgatccgattgccctcgagcgtgacatcaacaatcttccaggcgttttggagaacggcctcttcgtcaaccttgctgacgaagttctcgttggtgaaatcaaggatggcgttgctggagtccgcagcctggatcgtgtgggttaa

SEQ ID NO: 2545 - DNA, 696 bp, Synechococcus sp. RS9917
atgaagcaggccgtggccgccgccgccgtggatgcgatccaggacggcatggtgctcggcctgggatccggttccacggccgcactgatgatccagggtcttggcgccaagctggccgccggtgagctgcgcgacatcgtcggtgtcaccacgtcgtttcaaggcgaggtgttggcggctgagctgggaatcccgctgcgcagtctcaatgcggtggagcgcatcgacctggccatcgacggagccgatgaagtggacccggcgtttcaactgatcaagggcggcggtgcctgccacgtgcaggagaaactggttgccgctcgcgccgagcgtttcatcgttgtggtggatgccaccaaattggtggaccgcctcaacctgggctttctgctgcccgtggaggtgctcccgggagcctggaggcaggttcaggcgcgtctcgccagcctgggtggggcggcagagctgcggatggccacccgcaaagccggtcccgtggtgacggatcaggggaatctggtgctggatgtgcgcttcggcgaaggcattgctgacccccgcgctctggagcagacgatcaacaacattcccggcgtgctcgagaacggtttgtttgtggatctggccgatgaggtgctggtcggtgaggtcaccgatggggtggccggcgtccgccggctcgagcggcaaggctga

SEQ ID NO: 2546 - DNA, 714 bp, Synechococcus sp. WH 5701
atggccgagctgcaggaccggatgaagctggccgtggccacggccgccgtcgatcagatccgggacggcatggtgctcggcctgggctccggctccaccgccgccctgatgatccgggaactcggcgcccgcctgcggcggggtgagctctcagccatcaccggggtgaccacctcgttccagggggaggtgctcgccgctgagctgggcatccccctgcagagcctcaatgccgtctcccgcatcgacctggcgatcgatggcgccgatgaggtcgaccccgccttccagctgatcaaggggggtggggcttgccacgtgcaggagaagctggtggcccgccgggccgaccgcttcgtggtggtggtcgattccagcaagctggtgaagcgactcaacctggagttcctcctgccggtggaggtcctgcccggggcctggcgccaggtgaaggcggaactggaggcgatgggcgccaccgctgacttgcgcatggctgtgaagaaggcaggcccggtggtcaccgaccaggggaacctggtgctcgatctcaagttcgctggcggcatcaccgatccagcggccttggagcaggcgatcaacaacctgccaggggtgctggagaacgggctgttcgtgggcctcaccgaccaggtcctggtgggcgagatcgtcgacggggagccccgggtgcgggatctcgagcggatctga

SEQ ID NO: 2547 - DNA, 714 bp, Cyanobium sp. PCC 7001
atgtcagatctgcaggaccggatgaagcaggccgttgccctggcggccaccgagcagatccagagcggcatggtggtggggctgggttcgggctccaccgcggccctgatgatccaggccctcggcgcccggctgcgcagcggcgcgctcaccgacatcaccggcgtcaccacgtcgttccagggggaggtgctcgccgcggagctgggcattccgctcaagagcctcaatgccatctcccgcatcgacctggccatcgacggtgccgatgaggtggatccctccttccagctgatcaaggggggtggggcctgccacgtgcaggagaagctggtggcccgccgggccgaccggttcgtggtggtggtggatgccaccaagctggtggacacgctcaacctgggcttcctgctgccggtggaggtgctcccgggggcctggcgccaggtgcaggccgatttggaggccctcggcggcgaggcccagctgcggatggcggtccgcaaggccggccctgtggtgacggatcagggcaatctggtgctggatgcgcgctttgccggaggcatcaccgatcccgtggccttggagcagcagatcaacaacctgccgggggtgctggagaacgggctcttcgtcaacctcactgaccaggtgctggtgggggagatcgaggctgatcagccccgggtgcgggatctcgcccgtcgttga

SEQ ID NO: 2548 - DNA, 714 bp, Paulinella chromatophora
atgttatccttgcaagatcagatgaaacatgcagtggctgaggctgctgtagagcagattcgtgatggtatgatcctaggtttaggatcaggttccactgctgccttaatgatcaaaagtctaggtaagcgaatcaagaataaggagcttagagatattgtaggagttacaacctcatttcagggagaagtactcgcggctgaactaggtatcccactaaagagtcttaatgctataggacatattgatttagccattgatggtgcagatgaggtggatcctaactttcagttaattaaaggtggtggagcttgtcatgtacaagaaaagctagtagcagcaagagctaaccgctttgtagtagtagtagattcaactaagctagtaaatagactaaatttagcatttttattaccgatcgaagttttgccaggagcttggcatcaggtaaaaatagaattagaagcaatgggagccaaagctgagctacgtatggcacagcgtaaagcaggtcccatcgtaactgatcaaggtaacttaattattgatgctagcttcaaggatggtataattgatccgataaatctagaattgcaaatcaataatatacctggagtacttgagaatggcttattcgtaaatcttgttgatcaagtattggtaggggagataaataatgatgaagttagtgttcgagatttagttaaggcttaa

SEQ ID NO: 2549 - DNA, 711 bp, Thermosynechococcus elongatus BP-1
atgagtgatgatgcagtgaagcaaatgaagcaggtcgttgccaaagctgctgccgatcgcgtgcaatcaggaatggtggtgggcttgggcactggctccacaacggcctttgttattcagtttttgggcgatcgcctgcgcaagggcgaactgagcaatattgtcggtgtacccacctcatttcaagcctctgtccttgctaaaaagtacggcattcccttggtgaccctcgatgatgtggagaaactagacattgccattgatggtgctgatgaagtggaccccgccaaaaacctgatcaaagggggtggggctgcccatacccgtgaaaaaattgttgattccctagccgagcagttcttggtggtggtagacagcagcaaactggtgcagaaattgggctccaccttccctgtacctgtggaggtcttaccctttgccgtggcgccggtgactcgtgccctgaaagcgctggggggtgagcccgaactgcgcatgggcgtgaaaaaagatggcccagtggtgactgaccaaggcaacttcgtcctggatgtcagatttgatgatattcctgaccccgccgaactggagaaagcaattaacaacattcccggcgttgtcgaaaatgggctctttgtcaacgtcgccgacgtaattctcgttggggaaattgtggatggtcaaccccaggttcgggaaattttccactag

SEQ ID NO: 2550 - DNA, 714 bp, Cyanothece sp. PCC 7425
atgacaacggctcccgacccagtcaaactgatgaaacaggcagtggcccagacagcggcggcacgggtaacctccggggcagtggtcgggctgggaacaggttcaaccaccgctctgatgattcagtgcttgggggagcgcctggctaaaggggaactggcaaatatcaaaggggttcccacctcctttcaggcaagtgtgctggccaaacagtacggcattcccctggtcaccctggatgaggtggaaaaaattgatctggccattgacggtgccgatgaggttgatccccaaaaaaatctgatcaaagggggtggagcggcccacacccgcgaaaaggtggtggatgccctggccgacttatttatcgttgtggttgatagctcgaagctggtggatcaactcggttcgacctttccggtgccggtggaagtgctaccaatggcgttaaccccggtgatgcgggccgtgacccggttgggcggtgaaccccaactgcgcatgggtgtgaaaaaagacggtcctgtaattacggatcagggcaatatggttctggatgtgaaatttgctgccattcccgacccagcggagctggaaaaaacgctgaataacattcccggtgtggtggaaaacggcattttcgtcaatctggccaaggtcattctggtgggcgagttgaaggacggtcaaccctccgtacgggaaatcagctga

SEQ ID NO: 2551 - DNA, 711 bp, Lyngbya sp. PCC 8106
atgagcgaacaagatcctgttaaattaatgaaacagcaagtcggaaaagccgcagctgatcgcgtccagtccggttcaattgtgggtttgggtacgggttcaaccacagcctacacccttcagtatttaggagaacgtcttcaaagtggagaactcaaagatattaaaggcgttccgacctcatttcaatcctcggtactcgctaaacaatatggtattcccctaacaacattagatgaaattgatcacatggatattgccattgatggcgccgatgaagttgatcccaataagaatctaattaaaggtggaggtgccgcacatactcgtgaaaaaattgttgatagtttggccgatcaatttatcgtcgttgttgatagttctaaactcgttgataaacttggatcaacatttttactccccgtagaagtgattcctttagcaattactccggtgatgaacaaaatcgaaaaattagggggcaaaccaacccttcgcatgggtgtcaaaaaagcagggccagtgattactgatcaaggaaatatggtgattgatgtcaaatttgactccattgataaccccgcagaattagaaaaaaccctcaataatattcccggtgttttagaaaatggtttatttgtgggtgttgctgacgtgatcttagtcggagaaatcaaagacggaaaacccttaatccgcgaaatttcctaa

SEQ ID NO: 2552 - DNA, 714 bp, Arthrospira maxima CS-328
atgagtccagaacaagaccccgttaagttaatgaagcaacaggttggcaaagcggcagcagaccgggttaagtccggttccattgtcggactgggaacggggtcaaccacagcatacacaattcaatttttaggagaacgcctcaaaagtggggaaatcaaagatattaaaggcgttcccacctcattccaagcctctgtacttgccaaggaatatggcattcccctcaccactttagatgaaattgaccatattgatatcgccattgatggtgctgatgaggttgatcctcacaaaaatttaatcaaaggtggtggtgccgctcacactcgcgaaaaaattgtagactgtttagcagatcagtttattgtagttgtagatggttctaaaatcgtagatcgtctgggttctacatttttattacccgtggaagttatgccaatggcgatgactccggtaatggcagccattaccaaacttgggggtaaacctaccctgagaatgggagtcaaaaaagctggacctgtgattacagaccagggaaatatggtgattgatgtcaaatttgatgcgatcgataatcccgccgaattagaaaaaaccctcaacaatattcctggggttttagaaaatggtttgtttgtgggtgtggctgatgttatcctagtgggagaaatcaaagacggtcaacctgttgtccgcgagatttcctaa

SEQ ID NO: 2553 - DNA, 711 bp, Microcoleus chthonoplastes PCC 7420
atgagtgcagaaactgacccggttaaggtgatgaagcaagaagtcggtaaagcagcggcccaacgggtgcaatccgggacaattgttggcttaggtacaggctcaactacggcgtatgcgattcagtatatcggcgatcgcatcaaaaaaggtgatctgaaagatatcaagggaattcccacctcatttcaggcagaagtgttagctaaagagcatggtattcccttaaccagcttagatgcggtggatcatattgatgttgccattgatggggctgatgaagttgatccgcaaaagaatttgattaaaggtggtggtgcggcgcatactcgtgagaaagtggtggattctctcgccgatcaatttattgtggtggttgatagtggtaagctggttgagcgactgggttccacgtttaaactgccagtagaagtgattccgatggcgtatgccccagtgatgcgggcgatcgagaaattggggggcaaacccgaattacggatgggggtcaagaaagcgggacccgtggtaacggatcagggaaatatggtgattgatgttacctttgattcgattgataaccccggtgaattagaaaagacgattaataatattcctggtgttttagagaatggtttattcgtcggtgtggctaatgtggtgctagttggtgaagtgaaagatggtcaaccgctagtacgcgagatgtaa

SEQ ID NO: 2554 - DNA, 714 bp, Trichodesmium erythraeum
atggtaacagaacaagacccgaccacgttaatgaaacagcaagtcggcaaagctgctgctgaggaagtaaaatctggtatgatagtaggtttaggcacaggttcaactactgcctacatgattcaatttttaggagaactcctccaaagaggtgaactcaaagatatcaaaggtatccctacctccttccagtcaaccgtattagctaaaaagtatggtgtaccattaacaacccttgatgaagttgattatatggatattgccattgatggggcagatgaagttgacccacaaaaaaatctgattaaaggtggtggagccgctcatactcgtgagaaaattgtagactgtttagcagaaaagtttgttgtcgtagtagatagttctaaactagtagataaattgggttctacttttttattgcccgtagaagttatacccatggcaatgaatcctgtaattcgggcgatcgaaaaattgggtggtcaaccagaagtacggatgggagtgaaaaaggccggacctatagtcacagatcaaggtaatttggttattgatgtcaagtttgattccattgataaccctggggagctagaaaaaagtttaaataatattcctggagttttggaaaatggcttatttgtaggggttgcagatgtaattttagtaggagaaattgacaatggaaaaccaatagttaggacaatttcttaa

SEQ ID NO: 2555 - DNA, 711 bp, Cylindrospermopsis raciborskii CS-505
atgtccgtatcagcagacccagtcaagttgatgaagcaagaagtcggtaaagcggctgcatccctggtaaaatcaggttctattgtcggtttaggtacgggatcaactactgcttacactattcagtttttgggcgatcgcctgaaatcgggtgagcttaaggatattgttggtatccctacttccttccagtcggaagttttggcaaaacactatggagttcctcttactactttagacgctgttgaccatattgacatcgctattgatggtgctgatgaggttgatcctaataaaaacttaattaagggtggtggtgcagcacacactcgggaaaaggtagtagactatttagcaagtcaatttattgttgtggttgatagtggtaagttagtggaccatttgggttctacctttgctgtccccgtggaagtgatacctatggctatcacccctgtgattaacgctattaagaaactggggggaaatccggaattacgtatgggtgtgaaaaaggctggtcctgtgattacagatcaaggtaatatggtagttgatgtcagatttgactccattgaagatccagtgaatttggaaaaaaccctgaataatatccctggtgttctggaaaatggcatctttgtcaactgtgtggatttggtattaattggcgaagtaattgatggtaagccctctgtccgacaaatgtag

SEQ ID NO: 2556 - DNA, 711 bp, Raphidiopsis brookii D9
atgtccgtatcagcagacccagttaagttgatgaagcaagaagtcggtaaagcggccgcgtccctggtaaaatcaggttctattgtcggtttaggtacggggtcaactactgcttacactattcagtttttgggcgatcgcctgaaatctggtgagcttaaggatattgttggtatccccacttcctttcagtcggaagttttggcaaaacactatggagttcctcttaccactttagacgctgttgaccatattgacattgctattgatggtgctgatgaagttgatcctaataaaaatttaattaagggtggtggtgcagcacacactcgagaaaaggtagtagactatttagcaagtcaatttattgttgtagttgacagtggtaagttagtggaccatttgggttctacctttgctgttcccgtggaagtgatacctatggctattacccctgtggtcaacgctattaaaaaactgggcggaaatccggaattacgcatgggtgtgaaaaaagccggtcctgtgattacagatcaaggtaatatggtggttgatgtcaaatttgacaccattgaagatccggtaaatttggaaaaaaccctgaataatatccctggtattctggaaaatggcatctttgtcaactgtgtggatttggtattaattggcgaagtaattgatggtaagccctctgtccgacaaatgtag

SEQ ID NO: 2557 - DNA, 711 bp, Nostoc sp. PCC 7120
atgaccgttacagcagaccccgtgactttgatgaagcaagaagtaggcaaagccgccgccgccttggtaaagtccggctcaattgtaggcttaggtacagggtcaactacagcttacacaattcaatatttaggcgatcgcctcaagtctggtgaactaaccgatattgttggtattccgacctcatttcagtcagaagttttgtccaagcaatatggtgttcctctcacaaccttagacgctgtagatcatattgatatcgctattgatggggctgatgaagttgacccccacaaaaacttgattaaaggtggtggtgcagcccatacccgtgaaaaagtggttgattacttagccaatcaattcatcgtcgtagtagatagtggtaaattagtagaccgcttaggttcggtttttgctgtaccagtagaagtcatcccaatggcaatcacccccgtcaccaatgccattaagcaactaggtggcaaaccagaactgcgtatgggtgtaaaaaaagccgggccagtgatcaccgaccaaggtaactttgtcttagatgtccgatttgactctattgacgacccagttaacctcgaaaaaatattgaataatattcctggggttctagagaatggtatcttcgtcaactgtgcagacatagttttagttggtgaagtcaaagacggtcagccactagtcagacgactatag

SEQ ID NO: 2558 - DNA, 711 bp, Anabaena variabilis
atgaccgttacagcagaccccgtgactttgatgaagcaagaagtgggcaaagccgccgccgccttggtaaagtccggctcgattgtaggcttaggtacagggtcaactacagcttacacaattcaatatttaggcgatcgcctcaagtcgggtgaactaaccgatattgttgggattccgacctcatttcagtcagaagttttatccaagcaatacggcgttcctctcacaaccttagacgctgtagatcatattgatatcgctattgatggggctgatgaagttgacccccagaaaaacctgattaaaggtggtggtgcagcccatacccgcgaaaaagtagttgattacttagctaatcaattcatcgttgtagtagacagtggtaaattagtagaccgcttgggttcggtttttgccgtaccagtagaagtcatcccaatggcaatcacccccgttaccaatgccattaagcagctaggtggcaaaccagaattgcggatgggtgtaaaaaaagcagggccagtcatcactgaccagggcaactttgtcttagatgtcagatttgattccattgacgacccagttaacctcgaaaaaatattgaataatattcctggggttctggagaatggtatctttgtcaactgtgcagacatagttttagttggtgaagtcaaagacggccagccactagtcagacaactataa

SEQ ID NO: 2559 - DNA, 711 bp, Nodularia spumigena CCY9414
atgagcgcaacagcagacccagtaaagttaatgaagcaagaagttggcaaggcggcggcggctctggtaaaatcagggtcgattgtcggtttgggtacagggtcaactacagcttatacaattcagtttttaggcgatcgcatcaaatccggtgaacttaaagatatagtgggtattcctacctcttttcaatcagaagtgctggcgaaagaatacggcgtacctctgaccaccttagatgctgttgaccacattgatattgccattgatggggctgatgaagttgacccccagaagaatttaatcaaaggcggtggtgcggcacatacccgcgaaaaagtagtagattacttagcagagcaatttatcgtcgtggttgatagtggtaaattagtcgagcgcttgggttctacttttgccgtacctgtagaagtgatacctatggccattacccctgttaccaacgccattaaaaaactcggcggtaaaccagaactccgcatgggtgtgagaaaagccggtccagtaattaccgaccaaggtaactttgtattagatgtcagatttgactctattgatgaccctgttaacctagagaaaacactgaataatattcctggtgttttagaaaacggcatcttcgtcaattgtgtagatgtagttctagtaggcgaagttatagacggtcagcccttagtacgtcaactgtaa

SEQ ID NO: 2560 - DNA, 708 bp, Nostoc punctiforme PCC 73102
atgacaggaacagatcccgtaaagttgatgaagcaagaagttggcaaagccgctgccgccctagtaaaatcgggttctatcgtcgggttgggtacggggtcaactacagcatatacgattcagtttttaggcgatcgcctcaagtctggtgaactcaaagatatcattggcatacctacctcgtttcaatcagaagtgctggcgaaacagtatggtgtccctcttgctaccttggattctattgaccacatcgatattgccattgatggggcagatgaagttgatccgcagaagaatttgattaaaggcggtggtgcagcacatacccgcgagaaagtcgtagactacctggcagaacagtttatcgtcgtggtagatagtggtaaattagtagatcgcttgggttctagttttgctgtacccgtggaagtgattccaatggcaattactcctgtaaccaatgccattaaaaaactcggtgggaaacccgaactccgcatgggtgtcaaaaaagctggcccagtgatcactgaccaaggtaactttgtcttagatgtcagatttgactctattgaagatccagtcagcctagaaaaaacattgaataacattcccggtgttctggagaatggtatttttgttaactgtgtcgatttagttttgattggtgaagtcaaagatggtcagccattagtgcggcaactgtaa

SEQ ID NO: 2561 - DNA, 702 bp, Cyanothece ATCC51142
atgtcagatccgattgtgatgatgaaacaagaggtgggtaaagcagcagcagcccgtgttaaatcagattcgattgtgggtttaggaacagggtcaaccactgcctacgccatacaatatattggtgaacggttacaatcgggagaattaaagaatattgtcggcgttactacttcgtttcaagcagaggtcttggcgagaaagtataatatccccttaagcactctagatgtggttgatcgcattgacatcgccattgatggggctgatgaggttgatcctcaaaagaacttaatcaaaggtggcggtgcagcccatacccaagaaaaaattgttgatagtttagcagaacagtttattgtagtggttgatggcggtaaactggtggataagttggggtcaacttttttattacctgttgaggtaattcctaaagccgttgttcctgtgatgcgtaaattggagcaattgggaggcaaaccagaattacgaatgggagtcaaaaaggcaggtcctgtggtaacagaccaaggtaatttggttattgatgtgaagttcgacagtattgatgatcctgcaaccctggaaaaaaccattaataatatccctggtgtactagaaaatggcttattcgttggggttactgatgtggtgttagtgggtgaaattattgataataaacctgttgtccgagaaatttaa

SEQ ID NO: 2562 - DNA, 702 bp, Crocosphaera watsonii WH 8501
atgtcagatccggttgtcatgatgaaacaagaggtgggtaaagcagccgcagcccgcgttaagtcagattcgattgtgggtttaggcacaggctcaaccactgcctatgccatacaatatatcggtgaacgattacaatcgggagacttaaaaaatattattggtgttaccacctcgtttcaagcagaagtcttggcgagaaagtataatattcctttaagcaccctagatgtggtcgatcgcatcgatatagccatcgatggagccgatgaggttgatcctcagaagaatttaattaagggtggtggtgcagcacatacccaagaaaaaattgtcgatagtttagcagaacagtttattgttgtggttgatggcggtaaactggtggataagttgggttcaactttcctcttgccggtggaagtgattcccaaagccgttgttcctgtgatgcgcaagttggaacaattgggcggtaaaccagatttacgcatgggagttaaaaaagctggcccagtagttacggatcaaggcaacttggtggttgacgtgaagtttgacagtatcgatgaccctgctaccttagaaaaaaccattaataacattcctggtgtcctagaaaatggtttatttgttggggtcactgatgtggtattggtgggcgagattattgataataagcctgttgttcgagaaatttaa

SEQ ID NO: 2563 - DNA, 702 bp, Cyanothece sp. CCY0110
atgtcagatccgattgtgatgatgaaacaagaggtgggtaaagcagcagcagcccgtgttaaatcagattctattgttggtttaggaacaggatcaaccactgcctacgctatacaatacattggtgaacggttacaatcgggagacttaaaaaatattgtcggtgtgactacatcgtttcaagcagaagtcttagcaagaaagtataatatccctttaagcactttagatgtggttgatcgcatcgacatggctattgatggggctgatgaggttgatcctcaaaagaacttaattaagggtggtggtgcagcccatacccaagaaaaaattgtcgatagtttagcagaacagtttattgtggtagttgatggcggtaaactggtggataaattggggtcaacttttttattaccggttgaggtaattcctaaagccgttgttcctgtgatgcgaaaattagagcaattaggcggaaaaccagaattacgcatgggagtcaaaaaagcaggccccgtggtgacagaccaaggtaatttagtcgttgatgtcaagtttgacagtattgacgatcctgcaaccctagaaaaaaccattaataatattcccggtgtcctagaaaatggcttatttgttggagttaccgatatcgtgttagtaggtgaagttatcgataataagcctgttgttcgagaactttaa

SEQ ID NO: 2564 - DNA, 714 bp, Cyanothece sp. PCC 8801
atgacaatgacaaatgatcccgtagtgatcatgaaacaagaggtgggtaaggcggccgcgtctcgggtcaaatcggattcgattgttggcttagggacgggatcaaccacagcctatgccattgagtatattggggaacggctcaagtcaggcgacttaaagaatattgttggcgtgacaacctcttttcaagcagaagtcttggctagaaagtatggtattcctttaacgacccttgatgtcattgatcgtatcgatgtggctattgatggagccgatgaagttgatcctaacaaaaatttaattaagggaggtggggctgcccatacccaagaaaaaattgttgatagcttagctgaagtctttattgtcgttgtcgatagtaataaattggtggataagttggggtcaacgttcttgttacccgtcgaagtgatccccaaagcagttacccctgtgatgcgtcaattggaacaattgggaggaaaaccagaattacgcatgggagtgagaaaagccggtcccgtggtgacagatcagggcaatctggtgattgatgtcaaatttgaaggcattgatgatccagccaccctagaaaaaaccattaacaatattccaggggttctcgaaaacggcttgtttgtgggagtgaccgatattgtcttagtgggcgaaattatcgatggtaagccctctgtacgggaaatttgctaa

SEQ ID NO: 2565 - DNA, 714 bp, Cyanothece sp. PCC 7424
atgacagtaaccaacgatcctgtcgttttaatgaaacaagaagtcggcaaagcagccgcccagcgagttcactcggatacaatcataggattagggacgggatcaaccacagcttatgccattcagtatattggggaacgtatccagactggagagcttaaaaatgtggtgggtgttcccacctcttttggagcagaagtgttagccagaaaatatggagttcctttaacgactctcgatgtcattgataaaatggatctagctattgacggagcagatgaagtcgatcctcaaaaaaatttaattaaagggggcggtgcagcacacacccgtgagaaaatagttgatagtttggcagatgtatttatcgtcgttgtcgatagtggcaaattggtagataaattaggctctacttttttgttgccggttgaagtcattccgatggctgtaactccggttattaaagcgttagaaaagctaggaggcaaaactgatctgcgaatgggagtcaaaaaagccggcccagtcgtgaccgatcaaggtaatttagtgattgatgttaaatttgacaatatagaagatcctgcaaatttagaaaagacgattaataatattccaggggttttagaaaatggtctatttgtaggagttgctgatcttattttagtgggtgaaattatagacgggaaaccccgtgtcagagaaatttcttaa

SEQ ID NO: 2566 - DNA, 711 bp, Microcystis aeruginosa
atgacagcaatcgatccggtcattatcatgaaacaggaggtcggtaaggccgccgctaatctagttcaatctaattcggtcgtgggattgggaactggttcaacgacggcctacgcgatcgagtatctgggcgctagactgcaaagcggggaaatcagcaatattgtcggggttcctacttcttttcaagcgcaagttttggctaggaagtacggaattcccctcactaccctcgatgtcatcgcaaagatggatatcgctatcgatggggccgatgaggtggatccccagaaaaacctgattaaaggcggcggtgctgcccatactcaggagaaaattgtcgatagtctcgccgatatttttgtcgtggtagtggatggcaataagctggtggacaagttgggatcgacttttcttttgccggtggaagtgttacccatggccatgactccggtgatgcgaaaattggaggcactcggtggtaaaccttctctccgcatgggagtgaaaaaagctggccccgtggtgacagatcaaggcaatttagttatcgatgttaaatttgatagtatcgatgatccagctgatttggaaagaactattaataatatgccgggggttttagaaaatggtttatttgtcggggttgctgatctgattctcgtcggtgaaattattgacggtaagccggtagtgcgcgagattaggtag

SEQ ID NO: 2567 - DNA, 711 bp, Microcystis aeruginosa
atgacagcaatcgatccagtcattatcatgaaacaggaggtcggtaaggccgccgctaatctagttcaatctaattcggtcgtgggattgggaactggttcaacgacggcctacgcgatcgaatatctcggtgctagactgcaaagcggggaaatcagcaatattgtcggggttcccacttcttttcaagcgcaggttttggcgaggaagtacggaattcccctcactaccctcgatgtcatcgtgaagatggatatcgctatcgatggggccgatgaggtggatccccagaaaaacctgattaaaggtggcggtgctgcccatactcaggagaaaattgtcgatagtctcgccgatattttcgtcgtggtggtggatggcaataagctggtggataagttgggatcgacttttcttttgccggtggaagtgttacccatggccatgactccggtgatgctgaaattagaggccctcggtggtaaaccttccctgcgcatgggagtgaaaaaagccggccccgtggtgacagatcaaggcaatttagttatcgatgttaaatttgatagtatcgatgatccggctgatttggaaagaactattaataatatgccgggggttttagaaaatggtttatttgtcggggttgctgatctgattctcgtcggtgaaattatcgacggtaagccggtagtccgcgagattaagtag

SEQ ID NO: 2568 - DNA, 708 bp, Synechocystis PCC6803
atggctgagctagatgcggccaacttaatgaaacaggcagtgggtaaagccgccgctgaccgagttaaatccaacaccattgttggtttgggtaccggttccaccaccgcctacgccctggaattcattggcgatcgcctgaaaaaaggagaattggaaaatgtagtgggcattcccacttcctttcaggcggaagtattggcccgtaaatatggcattcccctaaccacgttggatgtggcggatcgcattgacattgccatcgatggagcggacgaagttgacccccagaaaaatttgatcaaagggggaggggccgcccacaccagggaaaaaattgttgacgccttggcggaaacttttctggtggtggtagacagtggcaaattggtggataaattgggttccacttttttactgccggtggaagtgattcccatggccctaactcctgtaatgcgagctttagctaaattaggtggtaaaccagaactacgcatgggggtgaaaaaagctggccccgttgtcactgaccaaggtaacctcgtcattgacgttaaatttgatgccattaccaacccagcggagttggaaaaaaccattaacaatctccccggtgtgttagaaaacggcctatttgtgggggtagcggacgtaattttggtaggggaaattattgacggccaacccacggtgcgggaattctag

SEQ ID NO: 2569 - DNA, 702 bp, Synechococcus PCC7002
atggatgccgtcacggtcatgaaacaagaagtgggcaaagtcgccgccgccctagtccagtccaactcagtggttggtttaggcactgggtcaaccaccgcctatgcaattcaatacatcggtgagcgtttagccgcaggtgaactagagaatattgtcgggattcccacctccttccaggcagaagttctcgcaaaacagtacaaaattcccctaagcagtttggatgccgttgatcatattgatgtggccattgatggggccgatgaggtcgatccccagaaaaatttaattaaagggggcggtgcggcccacacccgggaaaaagttgtggatgccctcgccaacaaattcgtcgtcgtggtagatagcggcaagctggttgatcgcttgggttcaacctttttattacccgtggaagtgattcccatggccattacgccagtgatgcgtcaactagaagcattgggtggtaagccagaactccgaatgggagtcaaaaaagctggccccgtggtgaccgatgaaggaaatttagtcgtggatcttaaatttgctggcatcgacgacccggcaaccctagagcaaaagattaataatatccctggcgtcctggaaaacggtctgtttgtcggggtggctgatgtgattttggtcggcgaaattattgacggacaaccccgcgtccgggaaattcagtag

SEQ ID NO: 2570 - DNA, 708 bp, Acaryochloris marina MBIC11017
atgagcgcagttgatcccgttaagttaatgaaacaacaggtgggtaaagccgctgccgatcgggttcagtctggctcaatcgtggggttaggcactgggtctaccaccgcctttgcgattcagtttttgggtgatcggattaagtcaggtgcattaacggatatcaaaggtattcccacttccttccaagcttctgtgttagcgaagcagtatggcattcccctcaccaccctagatgaagtggatcggattcatatcggcattgatggtgccgatgaagtggatccgcagaagaatttaatcaaaggtggtggcgcagctcatacccgcgaaaaggtcgtggattccctagctgagcagtttattgtggtggtcgatcaatccaaaattgtcgataaattagggtccactttcccggtcccggtggaagtattgccaatggcgatcgcaccagtcgtcaaagccttagagaagctcggtggtaagcccgaactgcggatgggtatcaaaaaagacggtcctgtgattaccgaccagggcaatatggtgctggacgtcacctttagcgatattcctaatccccccgaactggagaaaaccattaacaatattccaggagttctggaaaacggcatcttcgtgggcatgactgacattgttttaattggcgaaatcaaagatggcaatcccaccgtccgtgagatgtaa

SEQ ID NO: 2571 - DNA, 699 bp, Synechococcus sp. PCC 7335
atggaccccgttaagctaatgaaacaagaagtcggtcgcgctgcggctgcccaagtcaagtctggcacaatcgtcggactagggactggctcgacgaccgcctatgctattcagtttattggcgagcgcattgcctctggggaactgacagatattaaaggcattccaacttcttttcaggcctccgtactagccaagcaacatggcattcccctaacgactttagatgaagtagatcatattgacattgccatcgacggtgcagacgaggtggatcctcaaatgaacctaatcaaaggcggtggggcggcgcacactagagagaaagtggttgatggattagctgagcggttcgtggttgtggtggatagctctaaactaagtgacaaaattgggacgatttttgcgctgccagtagaagtattacccatggccgtttcgccagtgactagagcactagaaaagctaggcggcaaagtagagatgcgaatgggtattcaaaaagatggtccggtgattacagaccaaggcaatatggtactagatgttagatttggtggcatcgataatccagctgagatggaagttactatcaacaatattccgggcgtattagaaaacggattgtttgtagggctagcgagtgaagtgctagtgggtgaagtgaaggacggtgaagccacggttcggagtatgtaa

SEQ ID NO: 2572 - DNA, 726 bp, Synechococcus elongatus
atgttgttgaacacccgcaagcctgttatggatccagtcacccacatgaaacatgaagtcgcgaaagcagccgcgagtcgggtgcaatctggcatggtggtcgggctgggctcgggctctacagcagccctcatgattcagtacttgggcgatcgcgttcgcaatggcgaactcaccaatattcaggctgtacccacctcttttcagtcctcagtattggcgaatgaatacggcattccgctgacgaccctgaacgaagtcgatcgcattgatattgcaattgatggcgcggatgaagttgatccacaacgcaacctgatcaaaggcggtggcgcttgccatacccgcgagaaactagtggatgcgcgggctgagcaattcattgtcgtcgttgacagcagcaaactggtagaggcactcggaacaaccttcttactgcccgtggaagtgctgccggaagcttacattcaagtcggcaaagccttggaaaaattgggtggcaaaccagaactgcggatggcggtcaaaaaagcaggcccagtcgtgactgaccaaggcaacctcgttctcgatgtgaaattcgatcgcattgaccagcccgcagaactggagaaagcgattaacaacattccaggcgtgctggaaaacggtctgtttgttggcttgaccgatcttgtactcgttggtgaagttgacggcgatcgcgtttctgtgcgcgagttctag

SEQ ID NO: 2573 - DNA, 726 bp, Synechococcus elongatus; identical to SEQ ID NO: 2572

SEQ ID NO: 2574 - DNA, 681 bp, Physcomitrella patens
atggtggtggggttgggcactggcagcacctcgtccatggccatcgaggagctcgggaaacttgctcagaataagctcaaggatgtgcagtttgtggccaccagctaccagtcgcgcgtcttgtctcgccagtttggcgtcaagacgatggacttgaacgacgtgaatcacattgacattgccttcgatggcgctgacgaggtggattccaacatgaacttaatcaagggcggtggggcagcgcatacgatggagaaggtggtggactccatagccaagcactgcgtcatcctcgtcgacgaaactaaagtagtcaagactctgggcctcacttttcccgtcccggtggaggttctgcccttcgctcttgcgccagtgctgcgtgcattggccgctttgggagggcagccggagattcgcaccgcccttcgcaaagacggccccgtcatgtccgaccttggtaacatgattgtggacgtgaggtttcccgacggcgtgaagaacccggcagaattggagaggaagatcaatatgattcctggagtggtggagaacggcctcttcgtcaacgttgcgcacacggtgctggtgggcaccaaggatggcgaggaaacctctgtcgtgacattcgccgattttgtgcagactttgaggaattcagagctagaggtgtcatcttaa

SEQ ID NO: 2575 - DNA, 714 bp, Candidatus Methanoregula boonei 6A8
atggcaggcacagcagatgcagttgccgcggcaaaacgggcagcaggataccaggcagcagagatggtagaagacggcatggtgataggtcttgggaccggttccacggttttttatgcaatagaatgtctctcgggccggatccgcgacgggctctcggtggtgggcgtcccgacctcgtaccagaccgcgatgaaggcacgggagtacgggatcccgttaacaacacttgacgataacccggtacttgatcttgccattgacggtgcagatcaggcagacccgcagttccggctgatcaagggcaggggggcagcaattacccgggagaagtgcgtggcgtcggcagctttccggtttatcgtagttgttgatgaggcaaaaatggtaaaaaaacttgccggtgttgtcccggtcgaaactctcccgtttgccaccaagaccgcgttggcccagctgcggggccttgggtgccggccgtttatccgcgaagcggtcaaaaaggacggcccggttatcacggacaacgggaactttattgtggactgccagttcgaggagatccctgacccggctctgctcgaagcgggaatcgctgccattcccggcgtgatcgagagcggcctttttacccggcttacaggaaatacaacaataattgtggggaatgaaaaaaagtgctcggtccttacatcaccggatgtagtcccgtaa

SEQ ID NO: 2576 - DNA, 714 bp, Methanosphaerula palustris E1-9c
atggttgatgcatcagcacaggctgtaggaaagcgtgaggccgggtatcgtgccgccgatatggtcgcggatggaatggttgtcgggcttggaacgggctcgacggtcttctttgcgatggagcggctcgctgcacggatccgggaggggcttgttatcactggaatcccgacctcgttccagaccgcgatccgggcacggggttgtggaattcctctggcaacgctgaacgactatcctgtgatcgatctggccatcgatggagctgatcaggtcgaccctggttttgctttgatcaagggtcggggtgctgcccagacccaggagaagtgcgtggcctttgcggccaaatctctggttattgttgcggatccctccaaactaacccgaaaactggatgctgtggtcccgatcgaagttctctcctctgcttatgtgcccgtgatccgatacctcaaaacaattggtggtgtccctgtacttcgggaaggaattaaaaaagacgggcctgtcatcaccgacaatggcaatatggtgatcgactgtggctttggtactatcggtgaccccactgcccttgatatccacctctcatcgatccccggggttgtcacctgtggcctcttcactacttttgctgataagacgacagtggtcgtcggtgattcaaacgggtgtcaggtactctcacgaaacggtcagttccctctgtga

SEQ ID NO: 2577 - DNA, 684 bp, Methanoculleus marisnigri
atgagtgcagaaaagcggaacgcaggctaccgggcggcagaagaggtcgaggacgggatggtcgtcggactcggcaccgggtcgaccgtcttcttcgcgatggagcggctgggcaagcggatagcagaggaccggctctccattgccggcgtcccgacgtcctaccaggcggccatccgggcacgccggtacggcatccccctcacgagcctcgacgagtatcccgaactcgatatcgccatcgacggggccgaccaggtcgatccggctctctgcctgatcaaggggcgcggtgccgcgctcctccgggagaagtgcgtctgcgacgcggcacaaagagcggtcatcgtcgttgatgggacaaagatggtggaggccctgaacgcgcccgtgccggtcgaggtgctcccgttcgccgtggaggcggtctcgcgccggcttgcggcgctcggtgccgacccggtcctccgggaagcggtgaagaaagacgggccggtcgtcaccgacaacggcaacttcatcctcgactgcagtttcgggacgatcgcggaccccgggcgcctggagacggcgattgcctcgatccccggtacactggagtgcggcctgttctcggcctacacagaaaaaataacggttattgtcggtgaggagaagggttgcagcgtcgtatcactgcattga

SEQ ID NO: 2578 - DNA, 669 bp, Methanocorpusculum labreanum Z
atggatgctgtgactgaagcaaaaagaaatgccggatatcgtgcggctgatttggttaaggatgggatgatcgtgggtcttggtaccgggtctaccgtgttttttgcgatggaacgtctgggagagcgtattgcgtcagagggcatcaggatctttggtgttccgacctctaatcagactgcaatgcgtgccgaggagtacggcattccactgacgactctgtctctccacccggttttagacattgccattgatggggctgatcaggtgactccttcaaagcagatgatcaagggacgtggagcggcacacctccgagaaaagatcgtggccgatgcggcaaagcagtttgtcgtggtgatcgattcggcaaaggaggtatcggttttggatgctgccgtgccaatcgaaatactgccttttgcttatggaagtgtctgcaggaaacttgcttcacttggcggtgagcctgttatgcggaacggtgttaaaaaggacggccctgtgatctcggacaatggaaattatatttttgactgcgcgtttggaaaagttgacgatccttccgggctcgagtctgcaatcaatgcgattcccggcgtgctggaaaacggtatctttgcaaaaatgaccgaaaagacgcttatcatcgtcggtaaaagcgcctga

SEQ ID NO: 2579 - DNA, 708 bp, Methanospirillum hungatei
atgaatacgagcggattatccccccaggaacaggcaaaaaaacgggcaggctacaaggctgctgattatattactaatggcatgacggtcggtcttgggaccggatcaaccgttgcctttacgatggcacgactaaaagagcgaatgactgaagagggtctgttgattgtcgggatccccacatctatccagacaaccatgcgggcaggagctctcggaatcccactcatcggtcttgaacaggcagagaagattgatatcacggttgacggggcagatcagatagatcctgaaatgaggcttatcaagggccggggagctgctcatgtcagagaacggatagtagccgatgcctcaacccggctcatcatcgtcgctgacccgtcaaagatatgctcgcatctgaccggaccaataccgattgaaataatcccgttttcattcagccatgtcattcgccggctcaatgaaatgggtggaatggtgactgtcagggaaggggtaaaaaaggacgggccagttatatctgataacggtaatatcatccttgattatacgccggtcagcatcccggacccgtcggctctcgagactgccatcaatatgattcctggtgtagtaagttgtggcatttttgctgaattcacttcaaagacgacggtcatcatcggggaagagagcggtccccgtataatcggattaccataa

SEQ ID NO: 2580 - DNA, 711 bp, Rhodothermus marinus
atgcaggagacgctgtcggcggccgatcgggccaagaaggccgcgggcgaaaaggtagcggccatggtggagccgggcatgcggctgggactgggaacgggctcgacggctgcctgggccatccgggcgctggggcggcgcgtacgcgaagaagggcttcgcgtggtgggcgtgcccacgtcgtatgccgcggagcagctggcccgtgccgaaggcattccgctggtgacgctggcggacgtcgaggcgctggacctggccttcgacggggccgacgaggtcagtccggagctgaacctgatcaaaggccgcggggccgcccacacgcgggaaaaggtggtggcttcgctggcccggcggttcgtggtgctggtggacgagtcgaagctggtcgatcggctggggacgcgctggcccgtgcccatcgaggtgttgccgatggcggccgagccggtgttgcgacagctccgacgcatgggggccgagcccgtgctgcggatgggcaagtgcaaggacgggccggtggtaaccgatcagggcttctgggtgatcgacgcgcgctttcccggtggcatcgacgatccgcacgcgctggccgtcacgctctcgacgatgcccggcgtgctggaccacggcctgtttctgggactggccaccgacgtgctggtcgggcaggccgacggccaggtgcgtcacatccgtcgtccgtaa

SEQ ID NO: 2581 - DNA, 825 bp, Salinibacter ruber DSM 13855
ttgcgtggaccttcgacgcggcatgacgttcgggcggatcagggaccgcgccgacggtgccagaacgcaatcgacgggtgccccccacaacacatctccgatactctgccttccctcacacgctcttctatggatcgcgacaccgccaagcaggccgccgccgaggccgccgctcaactcgtccgcgacggcatgtgcgtaggccttggctccggctccaccaccgcctacgccctcgaatttctcggccgccgcattcaggccgaggacctcgacgtgcagggcgtccccacgtcgtttgccaccgagcgccgcgcccgcacccacggcatcccgctcacctcgctcgacgacacccccagcctcgaccttgcgctcgatggggccgacgaggtcgacgacgcctttcgcctcatcaagggcgccggcggggcgcacgcccgcgagaaggtggtggcccaccaggccgaccgattcgtggtgctggtcgacccgacgaaagaggtgagccggctcggcacccagttcccggtgcccgtggaggtgctccccatggccgcgacgccggtaatgaacgccctagacgcagcgggggcgacgccgacgctccgcacggccgacgccaaggacggcccggtggtcaccgaccagggcctgtggatcatcgacgcccggttccccgacggcatcgagaaccccgacgcccttaatcgaagactttgcgaccgccccggcgtgctcgaccacggcctgttcctggacatggcgaccgatgtcctcgtgggccgtcccgatgagtccgtagaccaccgttcggcgtcctag

SEQ ID NO: 2582 - DNA, 705 bp, Methanosarcina mazei Go1
atgacggaaagaaatacttctactgattctccggaaaaacgggcggcaggaattgctgcggcagggcttgtcagctcagggatggttgtagggctcggtacgggttcgacagttgcatatactataaaagagctggggcgcagggtaaaggaggaaggcctcgacatcctcggggttgttacctcctaccagtccgaaatgctggcaatagatgccgggataaggcttaccaccctttctcaggaccctgaactggatattgcaattgacggagctgaccagatagactccaacctttataccatcaaaggaggcggggctgctcatacaagggaaaagatcgtttccgtgtctgcaaaaaggtttgtagtagtagccgacgactctaaaaccagtacgcagcttgataagcctgtgcctgttgaagtccttccctttgcaaaagaacctgcagtgaacaggatccggaaacttgggggagaacccagactcaggtctgccgtaaaaaaagacggtcccgttataacggataatggaaactttgttcttgatgtcgaatttggcgttataaaagatcctgaggctcttgcccttcaattgtctgcggttccgggagttgttgaacacggaatttttagtaatgttgatgaactttacatagggaaaaaagacgggtccgtaaaaattatatccagacagaagtga

SEQ ID NO: 2583 - DNA, 705 bp, Methanosarcina acetivorans
atgacggaaagaaatacttctactgattctccagaaaaaagggcggcaggaattgctgcagcagggcttgtcagctccgggatgcttgtaggactcgggacaggttcaaccgttgcatacacaataaaagaacttgggcgcagggtgagggaggaggggctcgatatcctgggagtcgttacctcttatcagtccgagatgcttgcaatagaggccggaatcaggctgacgacccttgcccagcatccggaactggaccttgccattgacggggctgaccagatagattccgaactccgtgcgattaagggaggaggagcggctcatacaagggaaaagatcgtttccgtttctgcaagacggtttgtggttgtagccgacgagtcgaaaacgagcaagcagcttgataaactcgtacctgtggaagtcctgccttttgcaaaagaacctgtggtaaaaaagatccgggaactgggcggaaaaccccagctcaggtctgccgtaaaaaaagacgggcccgtaataaccgacaatggaaattttgtccttgatgtcgaatttggagttataaaagaccctgaagcgctcgcccttcaactatcttcaatccctggtgtcgttgagcatgggattttttgcaatgtgagcgagctttacatagggaataaagacggggctataaagattataacccgacagaaataa

SEQ ID NO: 2584 - DNA, 699 bp, Methanosarcina barkeri
atgacagaaagaaatatatctaccgattccccggaaaaacgtgcggctggcatcgctgcatctcggatggtagaatcgggaatggttgtgggacttggaacgggctcaacagttgcatatacgataaaagaactcggcaggcgggtcagggacgaaggtctcgaaattctgggtgttgttacctcataccagtctgaaacgcttgccatcgaagccggcatccctctgaccacccttgcccagcattcggaactggacatcgccattgatggagcagaccaggtcgattcgaagctgcacgcaatcaaaggtgggggagctgcccatacaagggaaaagatagtatcggcgtctgcaagacgttttctggtcgtagctgacgaatcaaaaacgagcacccagcttgataaacctataccggttgaggttcttccctttgcaaaaactcttgtgattaaaaaaataaagcaattgggaggaaagcctgagccgaggttagctctgagaaaagacggccctgtgataactgataatggaaactttgtacttgatgcaaatttcggcgtaataaacgatccagaaggtctggcccttcaactatcttcaattcctggagttgttgagcatggaatattttccaatgtggacgaactctatatcgggaaaaaagatggatcagtggagatagtcaagaagtga

SEQ ID NO: 2585 - DNA, 696 bp, Methanococcoides burtonii
atgaaagaaagaaatgcaaatgcatcaagctctgaaaaagaagctgcaggcaatgccgctgccagtcttgtggaagatggtatgataatcggtcttggtaccggttcaacaacggctttcgcaattgcagaagttggcagacgtgtacgtgaagaaggattgaatgtattagctgttgtcacctcatatcaggctgaaatgcttgccattgaagctggagtgccactgacaagccttgcagagcatccggttcttgatcttgcgatagatggtgctgaccaggtggatgcaaaactgaacgtcatcaaaggcggaggagctgcacatacacatgaaaaggttgttgcccattcagcaaaacgcttcattgtagtcgtagatgaatcaaagataagcgaagaacttgatcacttcgtaccaattgaagtgcttccatatgcaagggaacttgcaaagaaacaattcatcgaacttggtggtaaaccacagatacgcctggcttcccgcaaggatggtcctgtgatctccgataacggtaatgtcatcattgatgtcgaattcggtgtgatcgaagatgctgctgagctctcacaaaagctttccacttgcgtgggtgttgtagaacatggtatcttcctgaataccgacgaggtctatgttggtatgaaagacggttcagttaagataattaactga

SEQ ID NO: 2586 - DNA, 720 bp, unknown
  Uncultured archaeon GZfos1D1
atgaaggatcgaagcagccacgacaccgacggcagcaagagccgcgagaaggaggcgtctgccctatcagcagtaacgctggttgcagacgggatgattgtcggcatcggcacgggttcgaccgcggggtatgcgatagtagaactcgggcggctggttgcccgcgggattgatatcctgtgcgtgccgacctcgtaccagtcagagatgcttgcagcgcagcagaagataccgatcacgacgctttcagagcacccaaagctcgacatcgtgctcgatggtgcggaccagatcgaccgaaatctcgttgcgatcaagggagggggtgctgcgcacacgagagaaaaggtgatcgcgcacgctgcatcgagagtggtgctgatggcagatcacgaaaaagtcgtccccggactcgatcacgcggttccgatcgaggttctgccgtacgcaagaacgcttgtggaacgcgaggtgcgggcactcggcgggatacctgagcttcggatggcagcccggaaggacggtcccgtggtcaccgacaacggaaacttcgtaatcgacgccgactttggcgcgatcgacgatcccgcgcgattgagcggtgagttgagcgcactcgttggtgcaatcgagcacgggatattcttaaatgtggacgaggtgcatatcggcaccgcggatggggtcaaagtgctgaagcggcaagggttacgcaagtaa

SEQ ID NO: 2587 - DNA, 687 bp, unknown
  Uncultured archaeon
atgaaaggcgataataagagaagggaaaaggagaaagcagcggaatcggcatcttctttgatctctgatggtatggtggtgggtctcggcacagggtctacggcagaaattgtgataagggagataggcaatcgaataaagacagaggagtttgagatttttggtgtaccaacatctcttagaacagaaatggtggcaatagaatgcgggattcccattactactctttctgaacatccttctttggacatctgcattgatggcgcagaccaagtggattcagaactcaatttgattaaaggcggatggggctcgcatacgagagagaagatagtatcttacgccgcaaaaaagcttgttatctgtgttgaagaagagaaaataatggagcagttgactaaaccggttcctttagaagttttaccttacgctgtgaaaatagtggagaaacaagtgaaaaagcttggtggcgaacctgctttacggagtgaaggaaccaggggtgggtattccgtgacggagcacggtaatctggtaatagatgctgattttggcgttatacataatcccgaagaaatgagcactgctctctcttctgttgtcggctctctcgagcatgggatatttacaaatgctgctgaagtgcatgtaggcaacgaaaaaggagtaagggtattaaagcgataa

SEQ ID NO: 2588 - DNA, 693 bp, Methanocella paludicola SANAE
atgaaggaccattcgggcagcgaccttgcgaggaagaacgccgccgtaaaggcgtgcgagctggtggaggacgggatggcggtgggcctggggacgggctccacgacggcctacgcgatcagagagctgggcaggcgtgtggacgagggccttgacatcgtgggcgttccgacttcgtacgcgtccgaggcgctggccatcgagtgcaacattccgctttcgacgctcgccgagtgcccggagctggacatcgatatcgatggcgccgaccaggtggattcctcattgaacgtcatcaagggcggcggggcagcccacacgaaggaaaagatcgtctcatgctcttcgaagatgttcgccgttgtcatcgacggcaacaagctgaaggacgtcctcaaccggggcgtgcccatcgaagtgttaccgtacgcccgcaggctcgtcgagaagaagatcgccggcctgggcggcaaatgcacggtcaggacgggctccggtaaagatggccctactatctccgataacggcaacttcatcatggactgcgacttcggcgttattaataaaccggcggcgctggcggaagcgctggcgcagataccgggcctggtcgagcacggcattttcaccaacgccgacttcgtgtacgtgggatacgaggacagggtcgagcgcctggaaaggaaaaaataa

SEQ ID NO: 2589 - DNA, 705 bp, unknown
  Uncultured methanogenic archaeon RC-1
ttggcttcgatgaagaatctttccggtagtgacgcggcgaaaaagaacgccgcagaaaaggcctgcgagctggtgaccgacggcatgatcgtggggcttggcacaggctccacagtagcccattcgatccggctgctcggaaggtgggtgaaggaagaagggctgaacatcgtaggagtgccgacttcttactcgaccgaggctctggccatcgagtgcggcatacccctgaccagcctggcagcttcgcccgtgctggacatcgccatcgatggcgcggaccaggtcgacgcctcgctcaacgccatcaaaggcgggggagcggcacacacccgggaaaagatcgtcgcctcgtccgcaaagcagttcgtcatcgtcgctgacgacaagaagttcagcagcattctggacaggtcagtgcctaccgaagtgctcccgtacgccgtgaagctggtagagcgggagatcctgaagctcggcggcacctgcacggtcaggaccggcaccggcaaggacggcccgatcatcactgacaacggcaacttcgtgctggactgcgccttcgggcagatcaaagagccggcgctgctcggcgacaagctctcccgtatccctggcctggtggagcacggcatcttcaccaacgccgccatggtgtacgtggggtatgagaacagggtagaggtcctccggcgcaagatgtga

SEQ ID NO: 2590 - DNA, 621 bp, Methanosaeta thermophila PT
atggtcgttggcctaggcacaggctccactgttgcatggacgatcagggcgatcggaaggatggtggctgaggggctcgatattctcgccgttccaacatcctatcagtctgaggcgctggcgatagagtgcgggattccgcttacaacattatcgcaaaatccagtgctcgatctggccatagatggcgttgatcagattgatatcaggatgaacgccatcaagggcggaggcgcagcgcacaccagggagaaggtggtatcgatcgctgccaggcgcttcgtggtcgtggcagatggatcgaagcgtgtggaggtgttgaacagaccggtccctgtagaggtcctgccgtttgctgcaatggtcgtcgagcgcgagctggtcaggattggcgggtatcctgtggtccgtcaggcccggatgaaggacggcccggtgataacggacaacgggaactttgtgatggacgtatcatttggggagatccgcgatcctgcaactctcgctcaggagatatcgcagataccgggcgttgtcgatcacgggattttcacaaagatagatgagctgcacatcgcccacaacggaacggtggaggtgatcaggagaaatgatctctga

SEQ ID NO: 2591 - DNA, 678 bp, Natronomonas pharaonis DSM 2160
atgaagcagtccgggggtacggaggcacagaagcgtcgtgccgggaaacaggcggcggacgcggtcgaggacgggatggtcgtcggactcgggaccggctcgacggccgcggcatcgatacgcgaactcggccagcgggtcgaggaaggactcgacatccgcggcatcccgacctcctaccagtcccgacagctcgcacgggaggccgacattccgctcacgacgctggaggaggcgacccctgacgttgccatcgatggtgccgaccaagtcgccgccggagacctgataaagggcggcggcgcggcacacgccagagagaaactcgtcgatgcggccgcagaccggtttcttgtcgtcgccgacgagacgaagctgtcgccgacgctcgatatccccgtcccggtcgaagtgctgccggatgccgcgccggtcgtccagcgacaggtggcggccctcggcggcgagccgacgctccgggccgcagagcgaaaagacggcccggttgtgaccgacaacgggaacctcgtcatcgactgcgcgttcggcgagatagcggagccggcggcgctggccgaagagctatcggcgctgccgggggctgtcgagcacgggctcttcgttggcctcgccgacgagatactcgtcggcaccgacgacggcgtcgacgtacgatag

SEQ ID NO: 2592 - DNA, 753 bp, Natrialba magadii ATCC 43099
atgtacaacgtttttctcctcgccgctcgcctgacgaaccagaccatgaagaccgagggcgggagcgacacggcgaagcaacacgcaggcgagcgggcggccgacgccgtcgaggacggcaccgttgtcggccttggaaccggctcgacggccgcctacgcaatcgaagccatcggacaggccgtcgccgacggcctcgacgttcgggccatccccacgtcgttccagtcgcgccagttggcactcgagtacgacattccactgacgacactcgacgccgtcgacggcgtggatctcgcgatcgacggcgcggatcaggtggttgacgatcccgagtcggccgcacacggcgcactcatcaagggtggcgggggcgcacatgcccgcgagaaactcgtcgatgcggccgcggaccggttcctcgtcgtcgccgatccgtcgaagctcacgaccgacctcgaccggtcggttccactcgaagtgctccccgacgctcacaccgtcgtcaccgagcgcgttcgggcactggacggcgagccaacgcttcgcgacgccgagcacaaggacggtccagtcgtcaccgacaacggaaatctactcctcgactgtgagtttggcacaattgcagatccagacgcgctcgcgaccacactcgcttcgattccgggcgtcgtcgaacacggcctgttcgtcggactggctgacgttacctacatcggaacggccgatggtgtggacgttcggacgtactga

SEQ ID NO: 2593 - DNA, 687 bp, Halogeometricum borinquense DSM 11551
atgaagacgacgggcggtacagacgaccagaagcgtcgtgcggccgaacgcgccgccgacctcgtagaaacgggtgcgacggtcggcctcggaaccggaagcaccgccgcgttcgccatccgcgcactcggccgggcagtcgaagacgggctcgacatacgcggcgtcccgacctcctttgcctcccgcgaactcgcccgtgaggaagggattccgctcgtcgccgttgacgaggtagagacaatcgacgtggcgatcgacggcgcggaccaactcgacggcgacctgaatctgataaaaggtggcggggcggcccacgcccgcgagaagattgtagacgcgatggccgaccgcttcgtcgtcgttgccgacccctcgaaagtcaccgagacgctggagcgagcagtgccgctcgaagtccttcccgacgcgcgaaccgctgccgccgcgcgcgtcagtgaactcgacggggaggcgaccctgcgccgggccgaacggaaagacggtccagtcgttaccgacaacggcaacctcgttctcgactgcgagttcggacagatttccgaccccgagtcgcttgcggccgatctttcagcgacgccgggcgtcgtcgaacacggcctgttcgtcgggcttgcggacgaggcgtacatcggcaccgacgatggcgtggacgtacagagctaa

SEQ ID NO: 2594 - DNA, 723 bp, Halorubrum lacusprofundi
atgaaaacgagcggcgggagcgatgcggcgaagcgacgcgccggcgagtcggcggccgagacggtcactgacggcgaggtggtcggactcggcaccgggtcgacggcggcccacgcgatccggcggctcggcgatcgggtcgactccggcctcgatatccgaggcgtggcgacctccttcgcgagccgggaactcgcggcagagtgcgggattcccctgctcgacctcgacgaggcggtgggttcggatgcgaccgggatcgacatcgcgatcgacggggcggatcaggtcgcggtcggcgaaggggagagtgaggtcggtcccctcataaagggcggcggcgccgcccacgctcgcgagaagctggtcgacgcgtcggccgaccgctttctcgtcgtcgccgatccctcgaaggagacgccggtcctcaatcggtccgttccggttgaggtgctccccgccggccgctccgccgtcgccgaggcggtgcgagcggccggcggcgagccgaccctgcggcgcgcggagcgaaaggacgggccggtcgtcacggacaacgggaacctcgtgctcgactgcgcgttcggcgagatcgccgacccggacgcgctgtcgacgacgctgtcgacgacgcccggggtcgtcgaacacgggatcttcgtcggcctcgcggacgaggttcacgtcgggacggagacgggcgtgcgggtcgcgagacggtga

SEQ ID NO: 2595 - DNA, 687 bp, Haloarcula marismortui
atgaaacagggcggctccgacgcggcgaaacaggcagcgggggaatcagcggctgaagcggtcgaggacgccacggtcgttggcctcggcacggggtcaacggcagcctacgctatccgcgctatcggacaggcggtcgacgccggcctcgatgtcgtcggcgtccccacgtcgtttcagtcccgccagctggcccgtgactgtggcatcccgctggcggacctcgacgacgtgtcggtcgacctcgccatcgacggggccgacgaggtggccagcggcaacctgatcaaaggcggtggcgcggcgcacgcccgggagaagatagtcgacgcgagcgccgaccgcttcctcgtcgtcgctgatccgacgaaagaggcggccgtactctcatatcctgtccccgtcgaggtactcccgatggcccgctcgacagtcgtcacggcagtcgaagaattgggtggtgacccaacactccgccgtgcagaacgtaaggacggccccgtcgtcaccgacaacggaaatctcgtgctcgactgcgacttcaattccatccacgaccccgccgcactcgccagcgacctcgccgcgctgcccggtgttgtcgagcacgggctgttcgtcggtatggctgacgagattcacgtcggcactgctgatggcgtcaccgtccgaacgctttcgaaatag

SEQ ID NO: 2596 - DNA, 681 bp, Halomicrobium mukohataei DSM 12286
atgaaacagggcgggagcgacgacgcgaagcgtgcggcgggagaatcggccgccgaggccgtcgaagacgggatggtggtcgggctcgggaccggctccaccgcggcccacgcgatacgggccatcggcgcggccgtcgacgccgggctggacgtgaccggggttccgacctcgtttcagtcccgcgaactcgcgcgggaagcggggatcccgttgaccgacctcgacgccgccgagatcgatctcgcgatcgacggcgcggaccaggtcgctggcgggtgtctcgtcaagggcggcggcgcggcccacgcccgcgagaagatcgtcgacacggcggccgaccggctcctcgtcgtcgtcgatccgaccaaggaggcggacgtgctcgaccacccggtcccactcgaactgctgccggccgccagacggcccgtcgcggcggccgtcgagcgactcggcggggaacctgagcttcgccgcgccgagcgcaaggacgggccggtggtgaccgacaacggtaacctcgtgttcgactgtgcgttcggtgccatcgccgaccccgccgcgctggcggcggacctcgcgacgatccccggcgtcgtcgagcacggcctgttcgtcgacgtggccgacgagatccacggcgggacggctgacggcgtcaccgttaccgaactgtag

SEQ ID NO: 2597 - DNA, 687 bp, Halorhabdus utahensis DSM 12940
atggacgaacaaactcgtgacgcggcgaagcgacgggcaagcgagagtgcggttgaagccgtcagcgacggcgacgtcgtcggcctcggcagcggctccacggccgagcacgccatccgcatcctcggcgatcgggtcgaggaggggctggacatcgtcggcgtgacgacctcctttcaggctcgcgagatcgccatcgagaaggggatcgacctcacgacgctcgacgagacggacggccacatcgacgtcacgatcgacggcgctgaccagttcgccggctccgacctgatcaagggcggcggcgcggcccacgcccgcgagaagatcgtcgcgagcgcgaccgacagcctccagatcgtcgccgatccgaccaaggagaccgacgtgctggacactgtggtcccggtcgaggtcctccccgacgcccggacgacggtcgccaacgcgatccgcgagctgggcggcgagcccgaactccggtgggccaagcgcaagagcggcccggtcgtcaccgacaacgggaatcttctcttcgatgccgacttcggcgcgatcgacgatccagagaccctcgcgacggagatcgcgacgatccccagcgtggtcgaacacgggatcttccccggctacgctgacgccgttcacatggggactgaggacggcgtgaccgtcttcgagtactga

SEQ ID NO: 2598 - DNA, 678 bp, Halobacterium sp. NRC-1
atgaaacaggctggcgggagcgccgagcaaaagcggcgggccggggaggcggcggtggccgaggaagtgaccgagggggcggtcgtggggctcggaaccgggagcacggtggcgcacgcgatccgcgcgctgggtgcggaagcgtcggacgtgtcgggggtagcgacgtcgttcgagtcccgacggcgcgccgtcgacgccggagtgacggtaacgagtctagaggcggcgtcggtggacgtcgcgatcgacggcgccgatcaggtggccgacggcgtgctggtgaaaggtggcggggcggcccacacgcgcgagaaatacgtggcggccagcgccgaccgcttcgtggtggtcgccgatccgtccaaggagagcgacgtggtggacgtgccggtgccggtggcggtggtgcctgacgcctggccggtggtcgtcgatcgggttgaggcgctgggcgggacggcgacgctgcgggacgccgagcggaaggacgggccggtggttacggacaccgggagcctcgtggtggactgcgatttcggggccatcgagacccccgaggcggtggcggcgtcgctgtctgcggttccgggcgtcgtcgagcacgggctgttcgtggggatggctgacgccgtctacgtgggaaccgacgacggcgtccgcgtgcgggacccgtaa

SEQ ID NO: 2599 - DNA, 711 bp, Haloquadratum walsbyi DSM 16790
atgaaaacaacaggtggctcagaagaacaaaaacgacgggctggtgaaaaagcggttgaatatgttaatgacggtgatattgtcggccttgggactggaagcaccgctgccgcagcaatcgatgctcttggagatgcagtggcagcagggtatgatattcatggcgtaccgacatcctttgcaacacgtgatcgcgcaattgaggcaggaatcccactcactcgaattgaagccgtcgatcatattgatgttgcaatcgatggttctgatgaaattaacaataatttaacactaatcaaaggtggaggcgccgcacatgcccgtgagaaggtcattgatgcaaccgcagatcagtttattgttgttgctgatgagtcaaaattggttgaaacgctttcagagcccgttccagtatctactctcccgatggctcaaaaaccagttaaacaccggcttgactcactcggggcaacaactacacttcgatcggcaacaatgaaagacggaccagtaatcacagacaatggaaatattgtttttgattgtgcatttgggcatattgaaaatgccgaagcacttgcaaaatcactcgctgaaattccgggtaccgtggcacatggattatttgttaatcttgcagatgttgcctgcatcgggactgaaaacgggactaatgtatatcatggagatcaggaccaaggccagaactag

SEQ ID NO: 2600 - DNA, 675 bp, unknown
  Uncultured marine crenarchaeote HF4000_APKG3H9
ttgacatatgatgatgccattaaggcattatcaaatgatgcactcaaacttgtaaaaaatcaccaaacgataggattaggtagtggcagagctgccactgcgtttgtaaaatcattatcattgtttgtgaaaaaaaagaaactcagtataaaatgcattccaacttctttgcaaataaaattagaagcggagaagggaaaattacatcttatagatactgttctagataaaattgatattgtttttgatggggctgatcagattgacaaagggaaaaatttgataaagggcggtggaggtgcattactaagagaaaacattctgattaatgcagcgaaaaaagttgtaatcatggcagatgattcaaaatttgttacaaatttcaacagagatgttccagtcgaagttcatcatttagctagaaacacggtagccaaacatatttcaaaaattggtggcagatcacgtatcagaacgcttgataggggttatccattcattacagaaaatggaaacattattcttgattgtaattttggcgtgataaaaaaaccaaaattattacaggaaaagattaagaaaatttctggagttttagaggtaggtattttcaccagaaaaccggatattatctacaaagccagatcaactggcaagtttgatgtaatcaagtag

SEQ ID NO: 2601 - DNA, 675 bp, unknown
  Uncultured marine crenarchaeote HF4000_APKG7F11
ttgacatatgatgatgccattaaggcattatcaaacgatgcactcaaacttgtaaaaaatcaccaaacgataggattaggtagtggcagagctgccactgcgtttgtaaaatcattatcattgtttgtgaaaaaaaagaaactcagtataaaatgcattccaacttctttgcaaataaaattagaagcggagaagggaaaattacatcttatagatactgttctagataaaattgatattgtttttgatggggctgatcagattgacaaagggaaaaatttgataaagggcggtggaggtgcattactaagagaaaacattctgattaatgcagcgaaaaaagttgtaatcatggcagatgattcaaaatttgttacaaatttcaacagagatgttccagttgaagttcatcatttagctagaaacacggtagccaaacatattttaaaaattggtggcagatcacgtatcagaacgcttgataggggctatccattcattacagaaaatggaaacattattcttgattgtaattttggcgtgataaaaaaaccaaaattattacaggaaaagattaagaaaatttctggggttttagaggtaggtattttcaccagaaaaccggatattatctacaaagccagatcaactggcaagtttgatgtaatcaagtag

SEQ ID NO: 2602 - DNA, 675 bp, Nitrosopumilus maritimus SCM1
ttgtcatacgatggtgccatcacggcattatcaaataatgcattaaaatttgtaaaagatgattatgttgttggtttaggtagtggaagagcagctactgtacttgttaaatcacttggaaaattaatcaaactaaaaaattacaacatcaaaggagttccaacatcattacaaatcaaactaattgcagaaaaagttggaattccgttgatagaagctgatcaagtagaacatattgatgtagtatttgatggtgcagatcaaattgattctcaaaaatttgtaatcaaaggaggtggaggagctttacttagagagaatattttgttcagtcttgcaaaaaaagttgtagtaatggcagacaaaacaaaatttgtaaaaaactttacaagaactgttccagtagaagtacatccacttgcaagaaattctgtatcaaaatctatgaagaaattaggaggcaaagcagaattgcgttcacttgatagaggttatccattttttacagaaaatggaaacattatcttagattgtgattttggaacaataaaaaatccaaaggcattgacacaaaaaatcaaagcaactactggtgtcttagaatcaggaattttcctcagaaagccagatgtaatctatagagcaaaaactggcgaaaaattcgatattttatag

SEQ ID NO: 2603 - DNA, 678 bp, Cenarchaeum symbiosum
gtgacggcgctcgaggatgccttccgggcaatctcggcagacgcgctgaacatggtaaaagacggccaggtaataggcctgggcagcggcagggcggcggctgtactagtcagggagcttgcatcccgcgcacggtcggaaaggatgaacataacgggcgtgcccacttcattacagataaggctcgttgcagaagagtgcggcatttcgctgcgcgacccgggagatactgataaaatagatatcgtgtttgacggcgcagaccaggtggacaggcaaggaaacctgatcaaaggaggcggcggggctcttttaacagaatcgatactcataggcatggcagataaagtagtcatcattgcagacgagtcaaagtttgcagaacatctggatgcacctgttcccgtagaggtgcacccggcggccagacggtctgcagcagaatctgtaatgcgattaggcggcaagcccgtcttgcgccttttagacaggggctttccgctgttcaccgagaacagaaaccttgtgctcgactgctcctttggcactataaccgacccttctacactgcgggacaagctcaccgatataccgggggtcgcagaggcggggatcataacccgcaggccagatactacatacagggcaaaaacagacggcggcttcgacgcgatatag

SEQ ID NO: 2604 - DNA, 693 bp, unknown
  Uncultured crenarchaeote 31-F-01
atgaacaccataaccatgactaggatgcttgaatctgcagtatatgagcatgtaagggatggcatgataataggtcttggctctggtagaacagttgcagcacttctagatgtacttgcaaggatgagtagaagtatgggcatagatatggcaagtataaggttcataccaacatcgctccagataaagatgaaggctgaggaacttaagatgagtataggggatgagtcactcatcccttctgttgatcttgtattcgatggtgcagatcagatagatgctaatagtctagttatgataaaaggtggaggaggtgcactgcttagggagaaggtgctcatgtatgcagcaaagaaggttgtgatacttgcagatgagagcaagtacgttgataagctgacattgcccatacccatagaggttgtaccatatgcaagggcatacgttagcaatatgctaagaagcatgtatgcagaacctagtgttagagtcaatgatagaggctaccctatcatgactgagaatgggaatataataatagacactgtatttagtagcatagaagatccctataaccttgagcataggctgaagtgtataccaggagtagttgaggttgggttatttagcaaggctgcagatctatactataaggcaaggggagatgggaggttcgatgttataggtagatga

SEQ ID NO: 2605 - DNA, 789 bp, Ricinus communis
atggttattggattagggtctggacacgcttctggtatggctatacagtatttgggtcggcaacttcgtattggtgttttaaaagatattgtaggcatacccatgtcaatagcaagtgcaagtgaagcagcaaaggcaggcattcgtttggaccgataccaagatggttctcaaattgattttgcatttgacgatgctgatgttctggaagaagacacactaattgcagtcgttggtcgccaaaaaatgcaaggtgaggagtcattcatccaagagaagtcaattctaaatgcagccagtaggcatgttttcatgatctcagaaaagcagtataaaagccgtctagatggttccataccagttttaattcaacccctgagctggatggaaactgctgaacagatagatgatttgtttttaggtgatgcagagatatggagaagaccttctatagggcaagcaggtccgcttggaggtgacttccctcttgttactagagaaggtcacaatgttcttgatgtcatctttacatctccaatacaaagtcttgctgaagtggctgaaagccttgacaaagttgatggggttgtggatcatggaatcatttccaagttcccatgcactgcagtgattgcttctgatagtgggctatacattgtaaataatccctcaacagatgcagagacggttgtcttgatatggatgtctgataaggaaacatgtctgatatggattccactcagtccagcagctgtggctagcatttcacaacttgaaaactcggtgtaa

SEQ ID NO: 2606 - DNA, 699 bp, Physcomitrella patens
atgtctgtcggtcttggaacaggacacgcttctggcatggccattgcctacatcggcgaaaggcttagagatggcaccctcagagacattatttgtgtaccgatgtcaagtgcaagcgctgcagccgcagcccaggcaggtgtaccgttgacgacatttgaggaccaaccacagttggatgttgcattcgatgacgcagacatggtgcaagaaggtactctctttgcagttatcgggcgtaagggagtcgaaggccgccagtcaatcttaaaggagaaagctataatgcaagcagcgaagcagttagttttcatcattgacgagaaacaattcgtgggcaagttggagggtgcagtgcctgtccttattcaacaggaagactggttagatgtggcagaagaaatcgatgacatgtttctgggcgatgcagaggtctggagacggccaagctttggagaagcaggaccattgggtggtgataatccgctaatcacacctgaagggcactttttgctggacgtgatcttcacgactcctattactactgcagctgacgtggtagagaacttggagactgtaccaggagtcatgggacatggtcttgtgatggatgtagcgtatgctgcagctgtggcaagtcctacagggatgaaactcagaacatctttattcaaaactgcgttcactgcaatggagtga

SEQ ID NO: 2607 - DNA, 885 bp, Vitis vinifera
atggcctcatcggcgattcccttctcccacctaaacctgcatttgccgctctctcgcgcttctttggcgcgcgccgactgtctggccaccacgcgatgtcgctttccctctgttactcgctcatgtcttgctgatgcttcgtctgctctacttcaagctgccaaacacaccgtggatacttacatcaaaagtgggatggtgattggattaggatctggtcatgcttctgatatggccatacaatatttgggtcggcaacttcgtactggtgctttaaaagatataacaggaatacccatgtctgtcgcaagtgcaagtgaagcagcaaaagtaggaattccactgggccactaccaagattgttctcaaattgattttgcatttgatgatgctgacgttatagaagaaggaacacttgttgccatcattgggcgtcggagattgcaaggcaatgagtccataatccaagagaagtctattctaaaagcagcagacaagctcgtatttatcattcaggagaagcagtacaaatgtgatctagaaggtttaattccagttttagttcaatctttaaattggatggaaactgctgaagagattgatgacctatttctaggtgatgcagaggtatggaggagaccatccatagggcatgcaggcccactaggcggtgacttcccattagtcaccagtgaaggacacaatattctggatgtcatatttacatctcccatactaaaactggctgaagtggctgaaagccttgataaaattgatggagttgttgagcatggagtcatttccaaaatcccatgcatagcagtgattacttcagatagtggaatgtatactgttgacaatctgcaagcagtgagagaacgttga

SEQ ID NO: 2608 - DNA, 858 bp, unknown
  Populus trichocarpa x Populus deltoids
atggcatcattagcaacatcaacactcgtgtactctactcctgttagaatcaaaactagttcaaagccaaggtcaagttcaagaacttgcaagaaaacagtccctttccttgttactagagcagacagttcttctcttctcctccatgcagctaagcacactgttgataaacacatacaaagtggcatggttgttggtttagggtctggacaggcttctggtatggctatacagtatctgggtcggctactccgaactggggctttaaaagacatagttggagtacccatgtctgtaacaagtgcaagtgaagcagcaaaggctggcatcccattggacgtataccaagatagttctcaaattgattttgcatttgatgatgctgatattatagaagaagaaacacttgttgcaatcattggacgtcagaaatcacagagcgacgagtccatcattcaagagaagtcaatactcaaagcagccaataagcttgtattcatgattacagaaaaccagtacgtgggaggtcttgaaggttctattccagttttggttcaagctctcaactggatggaaactgctgaagagattgatgacctatttttaggtgatgcagaggtatggaggagatcatcgataggacaagctggtccgacggggggcgattaccctttcattacaagagaaggtcacaacgttcttgatgtcatcttcacatctccagtacaaagccttgctgaagtagctgaaagtcttgataaagttgatggcgttgttgatcatggagttttttccaagttcccatgcactgttgtgattgctgctgaaagtggaggtctgaacattgttgatagatag

SEQ ID NO: 2609 - DNA, 858 bp, Populus trichocarpa
atggcatcattagcaacatcaacactcgtgtactctactcctgttagaatcaaaactagttcaaagccaaggtcaagttcaagaacttgcaagaaaacagtccctttccttgttactagagcagacagttcttctcttctcctccatgcagctaagcacactgttgataaacacatacaaagtggcatggttgttggtttagggtctggacaggcttctggtttggctatacagtatctgggtcggctactccgaactggggctttaaaagatatagttggagtacccatgtctgtaacaagtgcaagtgaagcagcaaaggctggcatcccattggacgtataccaagatagttctcaaattgattttgcatttgatgatgctgatattatagaagaagaaacacttgttgcaatcattggacgtcagaaatcacagagcgacgagtccatcattcaagagaagtcaatactcaaagcagccaataagcttgtattcatgattacagaaaaccagtacgtgggaggtcttgaaggttctattccagttttggttcaagctctcaactggatggaaactgctgaagagattgatgacctatttttaggtgatgcagaggtatggaggagatcatcgataggacaagctggtccgacggggggcgattaccctttcattacaagagaaggtcacaacgttcttgatgtcatcttcacatctccagtacaaagccttgctgaagtagctgaaagtcttgataaagttgatggcgttgttgatcatggagttttttccaagttcccatgcactgttgtgattgctgctgaaagtggaggtctgaacattgttgatagatag

SEQ ID NO: 2610 - DNA, 675 bp, Oceanobacillus iheyensis HTE831
gtggaatacagtgataaacaaattgcagcacaagaagcggtaaggtatatcaaagatggtatggttattggaattggttctggatcaaccgtaaatgaatttctctattgtttagcagctagaatgagaaaagagagattacaagtagtagggatacctgcgtcgaaaaaatcagagcgattagcaacggagcttggaatccctttaactacttttgctacttatcaaaacgttgatattgcaattgacggaacagatgagatcgatgaccagctgtatttagttaaaggtgggggcggctcactagtaagagaaaaaatgatcgatttggttgctgaaacctttatcgtaattgctagtggtaaaaagaaaataaagaagctaggatcgttcccagtaccagttgaagtagtaccatttggatggcaggctaccgaacaaaggctgcaacaatttggatgtcagaccaatttgcggatggtggaagaagacatttttgtctcggacaatcagaactatattattgattgtgattttaaagaaatcgatgatgcagaagcattacatcgatcattaaaacaaattgtaggtgtaatcgaaactgggatttttataaatatggtagataaagcaattgttgcagataacggtgagttatccatattggaaaaataa

SEQ ID NO: 2611 - DNA, 696 bp, Candidatus Liberibacter asiaticus str. psy62
atggacgctcttcaaatgaagagaaatgctgctcgtcgagcaattcagtatgttgttgacgggatgactttgggaatggggacagggagtactgccaaagagtttatgattttgctcgctgacaagattgcgaatggctttcgtgttcaggttataccatcttcgcgaaatacagaaaatttctgtaaaatccatcatattcctttgcattcgccagaggatgtttcgtctgttgatttaagtatagatggatttgatgagatagattctcggttgcgccttattaaaggatatggaggggctcttctccgtgaaaagattattgcacacgctgcttctcgttttattgtcatcggggatgaaagtaaaagagttgattttttaggaaggggcatgctcccaatagaaattgaccaatttggtgtgaacaagacgctttctgcgctcaaagaggttgcatcttgttttggtttaaatgaagaactccgtctacggcgaaatggatctggcttatttgtcagtgatggaggaaattatattgttgatgctttttttggatttattccagatcctcaaattatttcaggagagctatgtaatataccaggagttatagagcatggtttgtttattaatatggtagactgtgcaattattggaacatctgatggagaatgtttagtcttacaaaaataa

SEQ ID NO: 2612 - DNA, 684 bp, Thermus thermophilus
atggagcgccccttggagagctacaagaaggaggcggcccacgccgccatcgcctacgtccaggacgggatggtggtgggcctgggcacgggctccacggcccgctacgccgtcctcgagctcgcccggcgccttcgggagggggagctgaagggcgtggtgggggtgcccacctcgagggccaccgaggagctcgccaagcgggagggcatccccctcgtggaccttccccctgagggggtggacctggccatagacggggcggacgagatcgccccgggccttgccctcatcaagggcatgggcggggccctcctccgggagaagatcgtggagcgcgcggccaaggagttcatcgtcatcgccgaccacaccaagaaggtgcccgtcctcggccggggcccggtgccggtggagatcgtccccttcggctaccgggcgaccctcaaggccatcgccgacctcgggggggagcccgagctccgcatggacggggacgagttctacttcaccgacggcggccacctcatcgccgactgccgcttcggccccatcggggaccccttgggcttgcaccgggccctcttggagatccccggggtggtggagacggggctcttcgtggggatggccacccgggccctggtggcggggccttttggggtggaggagcttctgccgtag

SEQ ID NO: 2613 - DNA, 684 bp, Thermus aquaticus
gtggagaggcccctcgaggcctacaagaaggaggccgcccacgccgccgtggcctacgtggaggacggcatggtggtgggcctgggcaccggctccaccgcccgctacgccgttctggagctggcccgccgcctccgggagggggagctcaaggcggtgcggggggtccccacctccgaggccacccgggacctggccctgaaggaggggattcccctcgtagacctgccgccggaaggggtggacctggccattgacggggccgacgagatcgcccccgacctctccctcatcaagggcctgggcggggcccttctccgggagaagatcgtggaggccacggccagggagttcatcgtggtggccgaccacaccaagaaggttcccgtcctgggccggggcgtggtgccggtggagatcgtccccttcggccaccaggccacccttagggccatcgcccacctggggggtgagcccgccttgcgcatggacggggacgagttttacttcaccgacaacggccacctcatcgccgactgccgcttcggccccatcggggaccccctgggcctgcacaaagccctcttggagattcccggcgtggtggaaacggggatcttcgtgggcctggccacccgggccctgatcggggggcccatgggggtggaggagctcttgccgtag

SEQ ID NO: 2614 - DNA, 693 bp, Meiothermus silvanus DSM 9946
atgaacgatctcgagacctacaagcgccaagccgccctcgaagcggttagacacgtccaatccggaatggtggtcggcctggggaccggctcgacggccaggtatgcagtgatggagctgggccgccggatccgagagggtgaagtgaagaacatccgggccgtgccgacctccgaggccaccgctctgctcgcccgcgacgccgggattgagcttttggagctgggcccggagggggtagacctggcgattgatggcgcggacgaggtagccccggatctggccctcatcaaagggctgggtggggcactgctacgggagaagatcgtcgagtccaacgcccggcgcttcctcgtagtggccgactataccaagcgggtcgagcaactcggacggggggtggttccggtcgagatcgtgcccttcggttaccgggcgacgctcgccaaactggcgcagctgggtgagcctagcttgcggatggcgggtgaggagcctttctacagcgatgggggcaacctgatcgctgatgttcgctttggccccatctctgatccccagggactcgaagcccgtctcaaatccatccccggcgtggtggagtccgggctatttgtagggatcgctaccgaagcggttttggcggggccggacggggtgcaggtgctgggcagaggaggggttggaggatag

SEQ ID NO: 2615 - DNA, 687 bp, Meiothermus ruber DSM 1279
atgaacgaccaagagaacttcaaacagcaagcggccctcgaggccgtcaagttcgtgcgttcggggatggtggtggggcttggtacgggctccaccgcccggtatgcggttttggagctaggccgccggttgcgcgagggcgagctttcggatgtggtggcggtgcctacttcggaggccacggcccggctggcccagagccaggggattcctctggtggagctcgaggcccggggtgttgacctggctattgatggcgccgacgaaatcgcccccgatctctccctcatcaaggggttgggcggggccctgctgcgcgagaaaattgtcgaggccaacgccaggcagttcatcgtgatcgccgaccatagcaaaaaggtgggccaactggggcggggggtggttccggtggagattgtgcgctttggctaccgtgccaccctgcaggccttggggcgaatggggaaggccaccttgcgcatgaacggagaagaattcttctatagcgacggaggcaacctaatcgcagatatcgacttcgggccaattccgaagcctggagacctcgaggtcgaactcaagcgcattcccggcgtggtggagagcggcttattcatcgggctggctacgctggcaatcgtggccgggccagagggcctggagtacctgggcaccccaccccagtag

SEQ ID NO: 2616 - DNA, 696 bp, Rubrobacter xylanophilus
gtgagcccggacgggatggagcggctcaagcgggccgccgcccgggaggcggtggaccgctacgtggagagcgggatggtggtggggctcgggaccgggacgaccgcctcctgggcggtccgcaggatcggggagcggctgctggaggggagcctgagcggggtgcggggggtgcccacctcggagtacacggcggcgctggcccgggagtgcggggtgccgctggtctccctctcggagcgccgcccggagctgaccatcgacggggcggacgagatcgccccggacctcagcgtgataaagggccggggcggggcgctgctgcgggagaagatcgtggcggccgcctcgcggcggggcgtggtgatcgtggcggacggctccaagcaggtgtcgctgctgggcaacgggccgctgccggtggaggtggagcccttcgggtgggaggccaccgcggaggcgctggccgcgctggggtgcgagccggagctgcgccgggtcaagacccagccgttcgtcacggacggcgggcactacacgctggactgccgctttccgggcatcccggacccccccgggctggcctgcaagataaagcgggtgcccggggcgctggagtgcgggctcttcgtggggctggcgcgggccgcggtgatcgcgcgcccggagggggtggaggtgctggaggccgcctag

SEQ ID NO: 2617 - DNA, 687 bp, Deinococcus deserti VCD115
atgagcgatctggaggcactgaaaaaagaggccgcggtgcgcgccgcagctctggtcgaaagcggcatgcgggtcggcctggggacgggcagcacggccaagtacgccatcgaggaactcggacgcaggatcgccagcggtgaactgaaggacatagtgggggtggcgaccagtgaggccagcgaccagctggcgcggcagctcggaattccggttgagccgcttgatcctcgtcccctggatattgccattgacggcgccgatgaaatagacccgaagctgaacctgatcaagggcctgggcggcgccctgctgcgcgagaagctgaccgaggttcaggcccggcgcttcattgtgattgctgaccacaccaagacggtcacgcacctgggcgagaaagctccagtgcctgtagaaatcgcaaagttcgggttcctgagcaccatcgagcgcctcagggccatggggctcggaggccggttgcgtcagcccggagcgcagccgtacgtgaccgataacggcaaccacatcttcgatgcgcagctgcctgagtccttcgacccggccaccctggaacggcagttgaaaggcacgctgggcgttgtggagaccgggttctttctgggcatggccgagcgcgccttcgtggcctcaccggatgaggtccgggaactgactccggtttaa

SEQ ID NO: 2618 - DNA, 687 bp, Deinococcus geothermalis DSM 11300
atgcctgacctggaagcgctgaaaaaggaagccgcgctgcgggccgtcacgctggtcagaagcggcatgcgcgtgggcctgggaacgggcagcaccgccaagtacgccatcctggcgatcggagagcggctcgcgtccggcgacctgcggggggtggtgggtgtggcgacgagtgatgcctcggaggtgctggcccgtcaggtcggcatcccggtcgagccacttgaccctcgtcccctcgacctcgccatcgacggtgcagatgagatcgacccggcgctgaatctcatcaagggcctgggcggggcgttgctgcgcgaaaagctgaccgaggtgcaggcgcggcagctggtgatcatcgccgaccacaccaagctggtcacgcgcttgggtgagcaagcgcccctgccggtcgagatcgcccgtttcggctttctgtccaccatcgagcggttgcgcgccctggtgcccggcggacggctgcggcaacccggtgcgcagccctttgtgaccgacaacggcaactatatctacgacgcccagctgccacagagctttgaccccgttgccctggaacggcagctgaaaggcacgctgggtgtggtggagaccggctttttcctgggtatggccgacctcgcctttgtggcggcaccggagggagtacgcgagttgcgccgcccctga

SEQ ID NO: 2619 - DNA, 681 bp, Deinococcus radiodurans
atggaccttgaagccctgaaaaaagaagccgctttgcgctccgtcgccctggtccagagcgggcagcgggtcggcctgggcaccggcagcaccgccaaatacgcgattgaagaactaggacgcaagctagcggcgggcgagctgagcggcatcgtgggcgtgtccaccagcgaggcgagcgaaaaactggcgcgcgaggtcggcattccgaccgagccgctcgacccgcgcccgctggacatcgctattgacggcgctgacgagattgcgcccaatctggacctcgtcaaggggctgggcggcgccctggtgcgcgagaagatgaccgaggtgcaggcgaagcggctgattatcatcgctgaccacaccaaactggtgacccggctgggcgagaaggcaccgctgcccatcgagattgtgcccttcggctttctctccaccatcgagcggctgcgcgaatttctgcccggtggccgtctgcggcagcccggcgcgcagccctacgtgaccgacaacggcaactacatcttcgacgcgcagttgcccgccgagtttgacgcccgcgaactggaacgccgcatcaagggcacgctcggggtggtggacaccgggttgttcctgggaatggccgagcgggccttcgtggccgcgccggacggggtgcaggagctgacgcgctga

SEQ ID NO: 2620 - DNA, 720 bp, Chloroflexus aurantiacus
atgaatacaacgtcaactgagacacgcaaagcaatggcggcagcggcggcggtagccctggtacggccagggatggtgatcgggttgggctttggcagtactgccgcctacgcaacacgcatgattgccgaacgtctgcaccagggtgatctgaacgacatcgttggtgtaccgtgtgccgagggcactgcccaactggctcgcgaactgggtattccgctcacaacgctcgacgaagtcgctgcggtggatttgaccattgacggcgctgacgaggttgatccgcaactatcgttaataaaaggaggcggcggagcactattgcgtgaaaagatggtcgcgcaggccagtcggcgggtcgcgattattgttgatgacagcaaactgtcaccagccctcggtacacgctttgccttaccgctcgaagtcgtcgattttggctggcgcgccactgcacgctggctggaggcacaaggcggaacggtgcagcttcgcctgcgggccgatggtcaacccttccgtaccgatcagggaaacctcattctcgattggaagtgcggcccactcaatgatccggcagcgctggcagctcagctatcagcgcgagccggcattgtcgaacacggtctgttcattggtctggcaaccgatctcttcgtagccggcccggacggtgtgcagcacgtgaccaccagcgattgcggtacaatagcctggtag

SEQ ID NO: 2621 - DNA, 714 bp, Chloroflexus aggregans DSM 9485
atgagttctgttgaaacgctgaaagcaatggcggcggcggcggccgtagcactgatccagccgggtatggtgatcgggttggggtttgggagtacggccgcgtatgcaacgcggatgatcggtgaacgcttggcaaatggcgaactccgcgagatcgtcggtgtaccgtgtgctgaagggaccgcagcactggcccgcgagctgggtattcccctcactacccttgatgatgtagagagggttgatataaccattgatggcgccgatgaagtcgatccatatatggccctgatcaagggtggtggtggtgcattgctccgtgaaaagatggttgctcaagccagtcgacgggtcgcgattatcgttgacgaaagtaagctctcaccggcccttgggacgcgcttcgcattgccgatcgaagtggttgatttcggctaccgagcaacggctcgctggttagctgcccaaggtgggagcgtgcgcttgcgccttcgctctgatgggcaaccgtttcgcaccgatcaaggtcatctgatcctcgattgggcatgtggcccgattgccgacccaacggtactggccgaccgcttagctgcacgagccggtatcgtcgagcatggcctgtttatcggcctggcaaccgatttgttcgttgccggagcaacaggcgtgcggcatattgttcgcccagattgcggtagaatagcgccataa

SEQ ID NO: 2622 - DNA, 711 bp, Myxococcus xanthus
atgagccagcagggcgacggcgcggcgacggcccgctacaaacaagcggccgccgaatgggcggtggacggcttcctccagccgggcatggtggtgggcctgggcacgggcagcaccgcggccttcgccgtccagcggctggccgcgctgcgcgcgcagggacggcttctggacatcgtgggcgtgcccacctcgcgcgccacggaggcgctggctcgctcgctgggcgtgcccgtgtcgacgttggacgcgcaccccgtgctggacgtcaccctcgacggcgcggacgaagtggcgccggacctgtcgctcatcaagggcggaggtggcgcgctgctgcgcgagaagatcgtcgcgcaagcaagccggcgcgtcgtcatcgtggtggacgcgggaaagctctcccccgtgctgggcacgcactggccggtgccggtggaggtgatgtccttcggttggcgctcccaggcgcggttcctcgaatcgcttggcgcgcgcgtcaccgtccggcagggcgctggcggcgagcccttcctcacggaccagggcaacctcgtgctcgactgcgccttcggccccatcgacgcgcccgcggcgctggccgcgagcctgggcgcgcgcgcgggaatcatgggccacggcttgttcctgaacctcgccacggacctggtggtggcggggccggagggcgtggagcaccgcgcgcgctga

SEQ ID NO: 2623 - DNA, 708 bp, Desulfovibrio magneticus RS-1
atgacgaacgccgacagcttcgacgcccgcaaacgggcggcggcccaggccgccgcgcacctggtcggcccgggcatggccgtgggcctggggcacggctccaccgccgtggccgtggtcccgtttctggccgcgcgcgctgggcgcggggaactggccggcacggcctttgtgccggcggcgcgctacatggcccaggcccttcgcgccgccggcctgcccgtggcctgtcttgatgattttccccggctggccctggccatcgacggagccgacgagatcgcccccaacctcgactgcatcaagggcggcggcggcgcacttctgtacgagaagatcgtggcccaggccgccgagcgcttcgtgctggtggctgacgacggcaagtgctcgccggcccttgggacgcgccatgccctgcccgtggaggtcacgcccttcgccctggcccccaccgtcgatttcctggcggccatcggcggcgcgccgacgctgcgccgtcgccctgacggcgaccccatgcgcacccagcgcggcaactgcatctgcgactgcgccttcggccccctggccgatccggccgggctggcggcgctgctcgacgcccgggccggcgtggccgggcacgggcttttcgtgggcctggcccaggcggcctttatcgccggcccggacggcgtgcaggagctttcccgaccggccggctga

SEQ ID NO: 2624 - DNA, 705 bp, Roseiflexus castenholzii DSM 13941
gtggacgaccatctctaccgtcggcgcgccgcggaacgcgcgctcgactatgttgagagcggcatggcaattggtctgggcaccggctcgacagcatcgtttatgctgcgaggacttgccgcgcgcctggctgacgggcgtctgcaacgggttgttggtgtgccgacatcggagcagactgcggtgctggcgcgtgaactgggcattccgctgacgacgctcgatcggcatccgtccctcgatctggcgctcgatggcgccgatgaaatcgacccgcacctgcggttgatcaaggggctgggtggggcgatgctgcgtgaaaagatcgtggcggcgtcagcggcacggttcgttgtcatggcaagcgtcagcaagcgggtcgaacgtctgggagaacgatcaccgctccccgtcgaagtggtgacgttcggcatgccgctctgtatacgccgccttgcggcgcttggcggggaaccggtgctgcgctgcgatcactccggtgcgccgtttgtgaccgatgagggcaacctgatcctcgactgccacttcggtgtcattgccgatccagaagcgcttgccgcagccatctgcgccatcccgggagttgtggcgcatgggctgttccttggcatggcgtcgctggcggtcattgcgggtcccgatgggatcgtggagttggagtgtcccgacgcttccagaagatga

SEQ ID NO: 2625 - DNA, 702 bp, Roseiflexus sp. RS-1
gtggacgacaatctctaccgtcagcgtgcagcagaacatgcgctcaggcatgtcgaaagcgggatgacgatcgggctgggaaccggctcaactgccacattcatgctgtacgggcttgcagcgcgtctggctgatggtcgcctgcaacgggtcaccggcgtgccgacatcggaagtgacggcggcgctggcgcgcgaactcggcatcccgctgacaacgctggatcgtcagccgcacctcgatctggcgctggatggcgctgatgagatcgatccgcaactgcggttgatcaagggattgggtggagcgatgctgcgcgagaaaattgtggcggcttccgcagcgcgcttcgtggtgatggcggctgtcagtaaatgtgtcgaacgcctgggagagcgctcgccgctccctgtcgaagtcgtggcgtttgggttgccgctctgtgcgcgtcgtctgaaggcgctcggcggtgcgccggcgctgcgccgtgaccgcagcggcgcaccgtttgtgaccgatgaggggaacctgatcctcgactgcaattttggcattattgccgatccggaagcgctcgcggcgtcgatctgcgctattccgggcgtcgtggcgcacgggttgtttctcggtatggcgtcactggcggtgatcgccggtcccgatgggattgtggagttgcacgctccatcggcgcgccaataa

SEQ ID NO: 2626 - DNA, 762 bp, Physcomitrella patens
atgaatgcaattgtgcctgacggatttgcttctgaatcggatgcaggtaccaagcttacacaggatgaactcaagaagattgctgccgagaaggctgtggaatatgtcaagagtggcatggtcttgggtttgggcacaggttctacagctgcatttgcagtggcaaagattggcgagcttttgaaggaaggaaagctgacggatattgttggagtgcctacctcaaagagaacggcagaacaggctgcgtcactgggcatccctctatctgttttggatgatcatcctaagattgatctagctatcgatggagctgatgaagtcgatcccgatctcaaccttgtgaaaggacggggtggtgctttacttcgtgagaagatggtggaggctgcttcagcaaagtttgtagtgattgttgatgaaaccaagttagtgaagggccttggaggcagcaagctggccatgcctgtggaggttgtccagttttgctggaagtataatgccgagcgcttgaagaaccttccagaacttgctggttgcgaggttaaacttcgcatggatggcgacaagccctatgtgactgacaattcgaattacatcatcgacctttacttcgaggagcctattgtagacgccaacgctgcagctcaggctatctccgcattagaaggtgtggtggaccatgggcttttcttgaacatggccagcgctgttatcattgcaggttctgatggtgttactgtccaaactaaggacacttag

SEQ ID NO: 2627 - DNA, 888 bp, Picea sitchensis
atggccaagccgattgcagcgggcgctgcactttccacgctaccctcgctctcctcctcctgctcagaattgaataaatggaagcctttgaattcaaatacccatttccacttcaattgcaacaggagcctaaacaccgccagattatcagtgagagctatgtcctcgtcgaccagcgtcctgacgcaggatcagctgaagaaattggccgcagagaaagctgtggaatatgtggagagcgggatggtgttgggtttgggcacgggctccaccgctgcctttgccgtggccagaatcggggagctcatgaaggctggggagctgaaggacatcgtgggcgtccccacctccaagcgcaccgccgagcaggccgagtctctgggcattccactctcggtgcttgacgagcaccccaaaatcgacctcgccatcgacggcgccgacgaggtcgacccggagctcaatcttgtcaagggccgcggcggcgcattgctccgagagaagatggtggaggccgcctccgccaagttcgtggtcatcgtcgacgaatcgaagcttgttaatggcctcggcggcagcgggctggcgatgcccgtggaggtggtgcccttctgctggaagtacaacgcgtcgaggctgcagtcgctctttcaggccgagggctgcgaggcgaagctcaggatggacggtgacggggacaagccctacattacggataacgccaattacattgtggatttgtatttcaagactccgatcaaggattcgagggccgcggccaaagccattctgggtttcgagggcgtggtcgagcacgggctcttcttggacatggccacggctgtcatcattgctggggctgaaggcgttagagtcacgaccaagtga

SEQ ID NO: 2628 - DNA, 888 bp, Picea sitchensis
atggccatgccgattgcagcgggcgctgcactttccacgctaccctcgctctcctcctcctgctcagaattgaataaatggaagcctttgaattcaaatacccatttccacttcaattgcaacaggagcctaaacaccgccagattatcagtgagagctatgtcctcgtcgaccagcgtcctgacgcaggatcagctgaagaaattggccgcagagaaagctgtggaatatgtggagagcgggatggtgttgggtttgggcacgggctccaccgctgcctttgccgtggccagaatcggggagctcatgaaggctggggagctgaaggacatcgtgggcgtccccacctccaagcgcaccgccgagcaggccgagtctctgggcattccactctcggtgcttgacgagcaccccaaaatcgacctcgccatcgacggcgccgacgaggtcgacccggagctcaatcttgtcaagggccgcggcggcgcattgctccgagagaagatggtggaggccgcctccgccaagttcgtggtcatcgtcgacgaatcgaagcttgttaatggcctcggcggcagcgggctggcgatgcccgtggaggtggtgcccttctgctggaagtacaacgcgtcgaggctgcagtcgctctttcaggccgagggctgcgaggcgaagctcaggatggacggtgacggggacaagccctacattacggataacgccaattacatcgtggatttgtatttcaagactccgatcaaggattcgagggccgcggccaaagccattctgggtttcgagggcgtggtcgagcacgggctcttcttggacatggccacggctgtcatcattgctggggctgaaggcgttagagtcacgaccaagtga

SEQ ID NO: 2629 - DNA, 864 bp, Populus trichocarpa
atggcctccttatccttcctctcccctccttcctcctcctctctttcctccctccacaacaccaccccttcctcctcccgcctcttcttacgcacaccctcccttaacctccgcgccccaaccaaaatcttctcccttaaagcccaatccgccccagtcctcacccaagacgaacttaaaaagatcgcagccgacaaagccgtcgagtatgtcaaatccggcatggtcctcggccttggaaccggctctaccgccgccttcgtggtagccaaactcggcgagctcttaaaaaccggtgaactgacaaatatcattggagtcccaacttcaaaacgcacagaagaacaggctcgttctcttaacatccctctttcaatactcgatgaccacccccacattgatcttgccattgacggggctgatgaggtggacccactacttaatttagtgaagggtcgcggcggagcccttttaagagagaaaatggttgaagcagcatcagatgagtttgttgttgttgctgatgagactaagcttgttgatggtcttggtggaagtaaactggcaatgccagttgaagtagtgcaattttgttggaaatttaatttggtgaggttacaagagttgtttaaagatgaaggggttgaggctaaattgagagttggtgaagatgggaagccctatgtgaccgataattttaattatattgttgatttgtattttgagaatccgattaaagatggatatgcggccggaaaggagatttcggggcttgaaggtgttgtggaacatgggttgtttttggatatggcgaccgcggttattattgctgggaagactggagttgaggttaaaagcaagtga

SEQ ID NO: 2630 - DNA, 873 bp, Populus trichocarpa
atggcttcgttatccttgctcccctctccttcctcctcctcctcctcctctctttcctccctccaccacaccaccccttcctcatcccgcctcaccctatgcaccccgtcccttaacgtccgcacccgcaccaaaatctcctccatcaaagcccaatccgctccagtcctcacccaggacgaccttaaaaaacttgctgccgacaaagccgtagagtatgtcaaatccggcatggtcctcggccttggtaccggctccaccgccgccttcgtggtagccaaactcggcgagctcttaaagaccggggaactgaaagacatcattggagtcccaacttctaaacgcacagaagaacaagctcgttctcttaacattcccctttcggtcctggatgaccatccccacattgatcttgccattgatggagctgatgaggtagacccacttcttaatttagtaaagggtcggggtggagcccttttgagagagaaaatggttgaagctgcatcggatgagtttgttgttgtcgctgatgacactaaggttgtggatggtcttggtggaagtaagctggcaatgccagttgaagtagtgcaattttgttggaaatataacttgttgaggttacaagaaatgtttaaagatgaaggggttgaggctaaattgagagctggtgaagatgggaagccttatgtgaccgataattttaactatattgttgatttgtactttgagaatcccattaaagatgggtatgccgcggggaaggagatttcggggcttgaaggtgtcgtggaacatggtttgtttttggatatggcgaccgcggttattattgctgggaagacaggagttgaggttaaaagcaagtga

SEQ ID NO: 2631 - DNA, 855 bp, Ricinus communis
atggtttccttatcctccaccactacctccacttccctatcctccctccaccaccgcagcgcctccttccatattaacctgcgcacccgctcccttagcctacggacccccaccaaaactttctcaatcaaagcccaatctgcccctgttctcacccaagatgacctcaagaaactcgcggccgacaaagccgtagattacgtaaaatccggcatgattcttggcctcggaaccggctccactgccgcctttgtcgtcgctaaaatcggagaactccttaagtccggcgaattaaaagatatcatcggcatacccacatcaaaacgcaccgaagaacaagcattatcgctaggaattccactatcagttcttgatgaacacccaaaacttgatcttgcaattgatggtgcagatgaagtagacccagatcttaatttagtgaaaggtcgcggtggggcccttctgagagagaaaatggtggaagctgcaagtgataagtttgttgttgttgctgatgagactaaattagttgatggtcttggtggaagcaagcttgcaatgcctgttgaagttgttcaattttgttggaagtataatttgataaggttaaaagaattgtttaaagatgaaggtgttgatgctaagctaagattgaatgaagatgggaagccttatgttactgataattctaattatattgttgatttgtattttgagaatcctattaaagatgggtatgctgctggtaaagaaatttcaagtcttgaaggtgttgtggaacatgggttgtttttggatatggccactgctgttattattgctggaaagactggaattgatgtcaagaccaagtga

SEQ ID NO: 2632 - DNA, 852 bp, Vitis vinifera
atggccaccctatccctcctctctccacccaagtcccactccctctcctccctccaccaccgtaatgccctttccctccgcacctcctccacccttaccccccgcacccgcccccttctctctatcagagccttctctgcacctgccctcacccaagacgacctcaagaagctcgccgctgataaggccgtagactacgtcaaaagcggcatggtcctcggcctcggcaccggctccaccgccgcctttgtcgtcgccaagctcggccacctcctcaaaaccggccaactctctgacatcgtcggcgttcccacttccaagcgcaccgaagagcaagccctctctctcggcatccctctctccgtgctcgaccaccaccccagcattgacctcgccatcgacggcgctgacgaggtggacccggatctcaacctcgtcaagggacgcggcggcgccctcctccgcgagaaaatggtggaggccgcctcggataagtttgttgtggtggtggatgacaccaaattggttaatggccttggtgggagcggcttagcaatgccagttgaagttgtgcagttttgctggaaatacaatttggttaggttgcaggagctgtttaaggaagaggggtgtgaagcgaagctgagattgaacccggatgggaagccctatgtgaccgataattcaaattacatagtggatttgtatttcaagacgccgataaaagactcaattgcggcagggaaggagatttcatcctttgaaggggtggtggagcacgggttgtttctggacatggccactgcagtgattattgctgggaaggatggagtgacagtgaagaccaagtga

SEQ ID NO: 2633 - DNA, 846 bp, Glycine max
atggcttccttatccctctcctctcccccatctctctcttccgcacaccacaacgcctccacgcgccttattctacgcacccctaactcccttaaactgcgcactccaccccactccctccccgccatccgcgccatcaccctcacccaggacgacctcaagagactcgccgccgacaaggccgtggagtccgtcaagagcggcatggtcctcggcctgggcaccggctccactgctgccttcgtcgtcgccaagcttggcgcccttctcgcctccggccaactctccgacatcgtcggtgtccccacctccaaacgcacggaggagcaggcccgctccctcggcatccccctctccgtcctcgacgacaacccccgcctcgatctcgccatcgacggcgccgacgaggtcgaccccgacctcaacctcgtcaaaggccgcggcggcgccctcctccgcgagaagatggtcgaggccgcctccgacaagttcgtcgtggtcgtcgacgacaccaagctcgtggacggcctcggcggaagcgagctggccatgccggtggaggtggtccagttctgctggaagtacaatctggatcggcttcaggagcttttcaaggaagaaggtgtggaagcaaaattgagattggaggagagtgggaaaccctacgtcaccgataattccaattacatcgtggatttgtacttcaagactccaattagggatgcattggccgcaggcgctgaaatttccgctctggaaggcgtcgtcgagcatggcttgttcctcaacatggccacttctgtcatcatcgctggcaaatctggcgttgaagtcaaggccaagtga

SEQ ID NO: 2634 - DNA, 843 bp, Oryza sativa
atggccgccgccaccgtctccgtccgcttccacccggccgcatccgccgcgcgctgcggcggcggctcgcgccggagcaggcgcctgtccggggtcatcagggcgcagtcggcgccggcttcggcggcggcggcggcgctgacgcaggacgacctgaagaggctggcggcggtgcgcgcggtggagcaggtggagagcgggatggtgctggggctggggaccgggtcgacggcggccttcgccgtcgcggagatcggggcgctgctggcgtccgggaagctgagcggcatcgtcggggtgcccacctccaagcgcacgttcgagcaggcgcagtcgctcggcatcccgctctccaccctcgacgaccacccccgcatcgacctcgccatcgacggcgccgacgaggtcgatccagaccttaaccttgtgaaagggagaggtggtgcccttctccgggagaagatggttgaggcagcatcagacaagttcatcgttgttgttgacgagacaaagctagttaccggcttaggagggagtggtctagccatgcctgtggaggttgtgcagttctgctggaagtacaaccaagtgagattgcaggatctgtttaacgatgaaggatgcgaggcgaagctgagattggatgaaggcggcaaaccctacgttaccgacaactcaaactacatcgttgatttatacttcaagacgccgatcaaggatgcgttggcagcagggaaggagatctcagctttggaaggcgtcgttgagcatgggctgttcctggacatggcgacttcggtgatcatcgctggaacagatggcgtcagtgtcaaaacaaagtga

SEQ ID NO: 2635 - DNA, 777 bp, Oryza sativa
atggccgccgccaccgtctccgtccgcttccacccggccgcatccgccgcgcgttcggcggcggcggcggcgctgacgcaggacgacctgaagaggctggcggcggtgcgcgcggtggagcaggtggagagcgggatggtgctggggctggggaccgggtcgacggcggccttcgccgtcgcggagatcggggcgctgctggcgtccgggaagctgagcggcatcgtcggggtgcccacctccaagcgcacgttcgagcaggcgcagtcgctcggcatcccgctctccaccctcgacgaccacccccgcatcgacctcgccatcgacggcgccgacgaggtcgatccagaccttaaccttgtgaaagggagaggtggtgcccttctccgggagaagatggttgaggcagcatcagacaagttcatcgttgttgttgacgagacaaagctagttaccggcttaggagggagtggtctagccatgcctgtggaggttgtgcagttctgctggaagtacaaccaagtgagattgcaggatctgtttaacgatgaaggatgcgaggcgaagctgagattggatgaaggcggcaaaccctacgttaccgacaactcaaactacatcgttgatttatacttcaagacgccgatcaaggatgcgttggcagcagggaaggagatctcagctttggaaggcgtcgttgagcatgggctgttcctggacatggcgacttcggtgatcatcgctggaacagatggcgtcagtgtcaaaacaaagtga

SEQ ID NO: 2636 - DNA, 825 bp, Zea mays
atggccgccaccgcgatctcagtccgcctccacccaaccgccgcgcgccatgtggcctccgcccgccgcgcccgcctcggggccgtccgcgcgcagtccgcgccggcggcggcggcggcggcgctgacgcaggacgacctcaagcggctggcggcggtgcgcgccgtcgagcaggtgaagagcgggatggtgctcgggctcgggacgggctccacggccgccttcgccgtcgccgagatcggcgcgctcctggccgcgggcaagctcgagaagatcgtcggcgtgcccacatccaagcgcaccttcgagcaggcgcagtcgctcggcatcccgctctccacgctcgacgacaacccgctcatcgacctcgccatcgacggtgccgacgaggttgaccctgacctcaaccttgtgaaagggcggggtggtgctcttcttcgtgagaagatggttgaggcagcatcggacaagtttattgttattgttgacgagacaaaactagttgatgggttaggaggtagtggtctagccatgccagtggaagttgtgcagttctgctggaagtacaaccttgtaagattgcaggaactgtttaaggaggaaggagtcgaggcaaagctaaggtttgaaggcgacaagccctatgttactgacaactcaaactacatcgtcgatttatacttcaagacgccaatcaaggatgcgttggcagcaggacaggaaattgcagctctggaaggagttgttgaccatgggttgttcttgaacatggcgagttcagtgatcattgctggaacggacggtgtcagtgtcaaaacgaagtga

SEQ ID NO: 2637 - DNA, 831 bp, Arabidopsis thaliana
atggcttccttatccttcgtttcctcttctcaccttacgctacgcactccttctattgccctacgcagcactggctcttctcctcgaacctccgtttcattctccgtcaaggctcaatccgtcgcgctttcacaggacgatttgaagaagctcgcggcggagaaagctgtggaggcaattaaacctgggatggttctagggctcggaaccggatccaccgcagctttcgctgttgatcagatcgggaaactactctcttccggtgaactctacgatattgtcggtatcccaacgtcgaaacgaacggaggaacaagcacggtcgttagggattcctcttgttgggttagatacacatccgagaatcgatctcgctattgacggagcagacgaggtagatccgaatcttgatttagtcaaaggtcgtggaggtgctcttctccgtgagaaaatggtggaagctgtggctgacaagtttattgttgtggctgatgataccaaactcgttacaggactcggtggaagtggattagctatgccggtggaagttgttcaattctgctggaactttaatttgattagattgcaagacctcttcaaggaatttggatgtgaatcaaagcttagagttgatggtgatggcaagccttatgtgactgataacagtaattacattattgatttgtattttaagactcctttgaaggatggattcgctgcggctaaagagattgggaagtttcaaggagtggtggagcatggtctgtttctcggaatggctacttctgtcattatcgctggaaagaatggcgttgaagttatgaccaagtga

SEQ ID NO: 2638 - DNA, 831 bp, Arabidopsis thaliana
atggcttccttatccttcgtttcctcttctcaccttacgctacgcactccttctattgccctacgcagcactggctcttctcctcgaacctccgtttcattctccgtcaaggctcaatccgtcgcgctttcacaggacgatttgaagaagctcgcggcggagaaagctgtggaggcaattaaacctgggatggttctagggctcggaaccggatccaccgcagctttcgctgttgatcagatcgggaaactactctcttccggtgaactctacgatattgtcggtatcccaacgtcgaaacgaacggaggaacaagcacggtcgttagggattcctcttgttgggttagatacacatccgagaatcgatctcgctattgacggagcagacgaggtagatccgaatcttgatttagtcaaaggtcgtggaggtgctcttctccgtgagaaaatggtggaagctgtggctgacaagtttattgttgtggctgatgataccaaactcgttacaggactcggtggaagtggattagctatgccggtggaagttgttcaattctgctggaactttaatttgattagattgcaagagctcttcaaggaatttggatgtgaatcaaagcttagagttgatggtgatggcaagccttatgtgactgataacagtaattacattattgatttgtattttaagactcctttgaaggatggattcgctgcggctaaagagattgggaagtttcaaggagtggtggagcatggtctgtttctcggaatggctacttctgtcattatcgctggaaagaatggcgttgaagttatgaccaagtga

SEQ ID NO: 2639 - DNA, 798 bp, Populus trichocarpa
atggctatcccctgtccatctatttttggatcagaaatggtacccattgagtcaggagccatgtctcctcctccttccccattaattctaacccaagacgagctcaaaaaaatcgccgcctacaaagccgtcgagtttgtccaatccggtatggtcctcggcctaggcaccggctccactgccaaacacgccgtcgaccgtatcgccgatctcctacaccaaggcaaattgaagaacattataggcatacccacctctaaaaaaacccaccagcaagccgtgtcccttggcatccctttatccgatctcgattcgcatcccatcgttgatcttgcaatagacggtgctgatgaggtggactcgaatctcaatttggttaaggggcgtggtgggtctttgcttagagagaaaatgatcgagagtgcttgcaagaagtttattgttattgttgacgagtctaaattggtgcctcatgttggtgcttgtggtgccatgcctgttgaagttgtgccattttgttggaaatttactcaagataagctacaaagtttgtttgattacgcggggtgtgttgcgaaattgaggtctaataatgggggtgaagatggcgagatttttgttactgataatgggaactatatcgtggatttgtttttcaagaaggatgtcggggatttaaagattgctagtgatgctattctgaggctagctggggctgtggagcatggaatgtttcttgatatggcaactactgttatagttgcaggcgagcttggaatcactatcaagaataagtag

SEQ ID NO: 2640 - DNA, 795 bp, Populus trichocarpa
atggctataccttgtccaccctttattggatcagaaaagctatctatagagtcaggagctatgtctccttcatctccttccccgttaatcctaacccaagacgagctcaaaaaaatcgccgcctataaagccgtcgagtttgtccaatctggcatggtcctcggcttaggcactggctctaccgctaaacacgccgtcgaccgtatcgccgatctcttacaccaaggaaaattaaagaacattataggaatacctacctccacaaaaacccaccaacaagccgtgtctcttggcatccctttatccgatcttgattcgcatcccgtcgttgatcttgccatcgacggtgctgatgaggtggactcgaatctcaatttggtcaaggggcgtggtggatctttgctcagagagaagatgattgagagtgcctgcaagaagttcattgttattgttgaccagtctaagttggtggctcatgttggtgctagtggtgctatgcccgttgaagttgtgccgttttgttggaaattttctcaagataggctgcaaaatttgttcgattacgcggggtgcgttgccaaattgaggaccgataatgggggcgaaaagatttttgttactgataatgggaattatatcgtggatttgttttttaagaaggatattggggatttaaaggttgctagtgatgctattttgaggctagctggggttgttgagcatgggatgtttcttgatatggcaaccactgttattgttgcaggtgagcttgggatcactatcaaggataagtag

SEQ ID NO: 2641 - DNA, 795 bp, Ricinus communis
atggcaattccatgccctccttttattgcatcagaaaagcttgcatcaatggaatcatctcctttatcgccaccacttctctctcaagacgagctcaaaaaaatcgcagcttataaagccgtagaatttgtccaatccggcatggttcttggcctcggcactggctccaccgccaaacacgccgttgaccgtattgccgatctcttgcaccagggcaagttaaccaacattgtaggaatacccacttccaaaaagactcaaaaacaagctttatctcttgggattcctttatctgatcttgattctcacccggttgttgatcttgcgatagatggtgctgatgaagttgattcgcaccttaatttagttaaaggaagaggtgggtctttgctcagggagaaaatgattgaaagtgcttgtaaaaagtttattgttattgttgatgagactaaattagtccctcatattggtgctaatggtggtgctatgcctgtcgaagttgttcctttttgttggaagtttactcaagaaaagcttcaatctttgtttgattatgctggttgtgttgctaagttgaggactgataatggcggtaaagaagagccttttgttactgataatgggaattatattgtggacttgttttttaagaaggagattggtgatttggaggttgccagtgacaaaattttgaggttagctggtgttgttgaacatggtatgtttcttgatatggctactactgttatcgttgctggtgaactgggtatcactatcaagaataagtttgattga

SEQ ID NO: 2642 - DNA, 810 bp, Vitis vinifera
atggctattgcttatcctcattttattgggtctgagaaatctgcaatggagacagggataatattgtctccgtcttcgccatctccgtccctgcctcatgtgattctaacccaagatgagttgaagaaaatcgcggcgtacaaagctgtggagtacgttgagtccggtatggttcttggtctcggaaccgggtcgacggcgaagcacgctgtggaccgaataggcgagcttttgcggcaagggaagctgaagaacattgtgggaatacccacgtcgaagaagacccacgaacaagcggtttctttggggattcccttgtcggatctggactcgcatccgattttggatcttgctatcgacggtgcagatgaggtggacccgtatctgaatttggtgaaggggcggggtgggtcactgctgagggagaagatggtggagggcgcttgtaagaaatttattgtgattgttgatgagtccaaattggtcaaccatttagggggtagtgggctagccatgccggttgagattgtgccgttttgctggaaatttactgctcaaaggttgcaaatgttcttcgaggaatcgggttgtgttgcaaagcttaggacatacgagaatggggaaccttttgtgacagataacaggaattatgtcgtggacttatatttcaagagagaaataggggatttgaaggttgccagtgatgccattctgcggcttgctggtgttgtcgagcatgggatgtttcttggcatggcaacaactcttattgtcgcaggggagtgtggtgtagtggtgaaggataagtag

SEQ ID NO: 2643 - DNA, 816 bp, Populus trichocarpa
atggccattccttatcatcatttcaatcttgttacttctgagaaaccagatatggagatgctttttccatctcctgtggttttgacccaagatgagcttaaaagaatagcagcttacaaagctgtggagatggtggaatcaggcatggttgtcggtcttggtactggttcaacagcgaagcatgctgtggatagaattggggagcttttgcatcaagggaagttgaaaaacattataggtatacctacttcaacaaaaacacatgaacaagctttgtctttaggtattcctttgtcagatcttgattcacaccctgttcttgatattgcaattgatggggctgatgagattgatccaaatcttaatttagttaaaggtagaggtgggtctttgctgagagagaaaatggtggagggtgtttgtaagaagttcgtggttattgttgacgagtctaaattggttaagtatattgggggtagtggtttggctatgcctgttgagattgtgcctttttgttggaaatttactgctaagaggttgcaggaattgtttgaatatgcaggttgtgtggcaaagttgaggacttttgctagttgtaatggaatggagaatggtgggttgccctttgttactgataatgggaattatgttgtggatttgtattttaagagagatattggggatttgaaggctgcaagtgatgcaattttgaggttagctggcgtggttgagcatggaatgtttcttgatatggcgactactgttattgttgcaggggaccttggggtcaccatcaagaataagattataaagtag

SEQ ID NO: 2644 - DNA, 804 bp, Arabidopsis thaliana
atgggttctgcattcgatccccttgtcacggccactgaggatctcgccgccgtcaactcggcgccgccactctcaaacctcacgcaagaagaactcaagaaaatcgccgcttataaagccgtcgaattcgtcgaatctggaatggttatcggtctcggcactggctccaccgcgaaacacgccgtggctcgtatcagcgagcttctccgagaaggaaaactcaaggatataatcggaatccctacttcaaccacaacgcatgagcaagcggtgtctctagggataccattatccgatctagattcgcatccggtggtggatctatcaatcgatggcgccgacgaagtcgatccggctcttaatctggtgaaaggacgcggcggatcgttattgagagagaagatgattgaaggagcatctaagaagttcgttgtgattgttgatgaatcgaagcttgtcaagtatatcggaggaagcggactcgctgttccggtggaggttgttccgttctgctgcgatttcacaagggggaaactggaagagctatttagagattcgggatgtgttgcgaagctgaggatgaaaatcggatctaacggcgaagaggcggcgccggctgtgacggataataggaattatgtggtggatttgtatttggagagagatattggagatttagaggtggcgagtgaggcgatattgaggtttcctggagtagtgaagcatgggatgtttctgggaatggcgactacgttgatcgtcgccggcaaatttggtgttaccgtcaaggataggtttggataa

SEQ ID NO: 2645 - DNA, 804 bp, Arabidopsis thaliana
atgggttctgcattcgatccccttgtcacggccactgaggatctcgccgccgtcaactcggcgccgccactctcaaacctcacgcaagaagaactcaagaaaatcgccgcttataaagccgtcgaattcgtcgaatctggaatggttatcggtctcggcactggctccaccgcgaaacacgccgtggctcgtatcagcgagcttctccgagaaggaaaactcaaggatataatcggaatccctacttcaaccacaacgcatgagcaagcggtgtctctagggataccattatccgatctagattcgcatccggtggtggatctatcaatcgatggcgccgacgaagtcgatccggctcttaatctggtgaaaggacgcggcggatcgttattgagagagaagatgattgaaggagcatctaagaagttcgttgtgattgttgatgaatcgaagcttgtcaagtatatcggaggaagcggactcgctgttccggtggaggttgttccgttctgctgcgatttcacaagggggaaactggaagagctatttagagattcgggatgtgttgcgaagctgaggatgaaaatcggatctaacggcgaagaggcggcgccggctgtgacggataatgggaattatgtggtggatttgtatttggagagagatattggagatttagaggtggcgagtgaggcgatattgaggtttcctggagtagtggagcatgggatgtttctgggaatggcgactacgttgatcgtcgccggaaaatttggtgttaccgtcaaggataggtttggataa

SEQ ID NO: 2646 - DNA, 780 bp, Zea mays
atgggcagcgccgccacctctccgcagccgtctgggaatctgacgcaggacgagctcaagcgcgtggcggcgcaccgcgcgttggagttcgtggagtccggcatgacgctgggcctgggcacgggttccacggccgcgcacgcgctggaccgcctgggcgacctcctccgcgcgggcgcgctgcccggggtcgccggcgttcccacctccctcaagacggaggcccacgccgcccgcgtcgggatcccgctgcttccgctcgacgccgcctcgggcgccagcatccgcctctccatcgacggcgccgacgaggtcgacccggacctcaacctcgtcaagggccgcggcgggtcgctgctccgggagaagatgatcgagggcgccggcgatcggttcgtcgtcatcgtcgacgagtccaagctcgtgccgaggctcggctgcacgggcgccgtccccgtcgaggtcatccccttcggcgcaccccacacgctcggcctcatccgcaaggtgttcgatggagtgcctggcttccacgccaggctgaggacggtccccgccgccaatggggaggactcggacgcgccgttcctcaccgacaacggcaactacatcgtggagatgttcttcgaggacggtatccgcggcgacctgctggacatcagcgatcgtctgctccggatcaccggcgtcatcgagcatggcatgtttcttggcatggccactacagtcatcgtcgctaacaaggacggcaccgtcacagtcatcaacaagaagaagtaa

SEQ ID NO: 2647 - DNA, 786 bp, Sorghum bicolor
atgggcagcgctgccgccgacgcctcgccgccaccgccgtcggggaatctgacgcaggacgagctgaagcgcgtggcggcgcaccgcgcggtggagttcgtggagcccggcatgacgctgggcctgggcacggggtccacggcggcgcacgcgctggaccgcctgggggacctcctccgcgcgggcgcgcttccgggggtcgccggcgtgcccacctccctcaagacggaggcccacgccgcccgcgtcgggatcccgctgctcccgctcgcgggcgccggcatccgcctctccatcgacggcgccgacgaggtcgacccggacctcaacctcgtcaagggccgcggcgggtcgctgctccgggagaagatggtcgagggcgccggggaccggttcgtcgtcatcgtcgacgagtccaagctcgtgcctaggctcgggtgcacgggcgccgtccccgtcgaggtcatccccttcggcgcgtcccacacgctgggactcatccgcaaggtgttcgacggagtgcccggcttccacgccaggctcaggaccgtccccgccgccgccaagggggacggtgacggctcggacgcgccgttccgaaccgacaacggcaactacatcgtggagatgttcttcgaggacggtatccgcggcgacctgagggacatcagcgaccgcctgctccggatcaccggtgtcgtcgagcacggcatgtttcttggcttggccactaccgtcatcgtcgccaacaaagacggcactgtcacagtcatcaacaagaagtaa

SEQ ID NO: 2648 - DNA, 792 bp, Zea mays
atgggcagcgccgccgcctcgccgccgccgtccgggaagctgacgcaggaagagctgaagcgcgtggcggcgcaccgcgcggtggagttcgtggagcccggcatgacgctgggcctgggcacgggctccacggcggcgcacgcgctggaccgcctgggcgacytcctccgcgcgggcgcgctgccgggggtggccggcgtgcccacctccctcaagacggaggcccacgcggcgcgcgccgggatcccgctgctcccgctcccgggcgccaggatcgcgctctccatcgacggcgccgacgaggtcgacccggacctcaacctcgtcaagggccgcggcggctcgctgctccgcgagaagatgatcgagggcgccggcgcccgcttcgtcgtcatcgtcgacgagtccaagctcgtgccgcgcctcggctgcacgggcgccatccccgtcgaggtcatccccttcggcgcgctccacacgctgggcctcatccgcggcctcttcgacggattgcctggattccacgccaggctgaggactgtccccgccgctcccgccaaggggggagaagactcggactcggagtcggagcagcccttcgtcaccgacaacggcaactacatcgtcgagatgttcttcgaggacggcatccgcggcgacctgcgcgacatcagtgaccgcctgctccggatcaccggcgtcgtagagcacggcatgttcctgggcatggccaccaccgtcatcgtcgccaacaaggacggcacggtgtcagtcatggacaggaagaagtag

SEQ ID NO: 2649 - DNA, 792 bp, Zea mays
atgggcagcgccgccgcctcgccgccgccgtccgggaagctgacgcaggaagagctgaagcgcgtggcggcgcaccgcgcggtggagttcgtggagcccggcatgacgctgggcctgggcacgggctccacggcggcgcacgcgctggaccgcctgggcgacctcctccgcgcgggcgcgctgccgggggtggccggcgtgcccacctccctcaagacggaggcccacgcggcgcgcgccgggatcccgctgctcccgctcccgggcgccaggatcgcgctctccatcgacggcgccgacgaggtcgacccggacctcaacctcgtcaagggccgcggcggctcgctgctccgcgagaagatgatcgagggcgccggcgcccgcttcgtcgtcatcgtcgacgagtccaagctcgtgccgcgcctcggctgcacgggcgccatccccgtcgaggtcatccccttcggcgcgctccacacgctgggcctcatccgcggcctcttcgacggattgcctggattccacgccaggctgaggactgtccccgccgctcccgccaaggggggagaagactcggactcggagtcggagcagcccttcgtcaccgacaacggcaactacatcgtcgagatgttcttcgaggacggcatccgcggcgacctgcgcgacatcagtgaccgcctgctccggatcaccggcgtcgtagagcacggcatgttcctgggcatggccaccaccgtcatcgtcgccaacaaggacggcacggtgtcagtcatggacaggaagaagtag

SEQ ID NO: 2650 - DNA, 783 bp, Sorghum bicolor
atgggcagcgccgccgccacctcgccgccgccgtctgggaagctcacgcaggacgagctgaagcgcgtggcggcgcaccgcgcggtggagttcgtggagcccggcatgacgctgggcctgggcacggggtccacggcggcgcacgcgctggaccgcctcggggacctcctccgcgcgggcgcgctcccgggcgtggccggggtgcccacctccctcaagacggaggcccacgcgtccgccgtcgggatcccgctgctcccgctcgacgccgcctcgggcgccaggatcgcgctctccatcgacggcgccgacgaggtcgacccggacctcaacctcgtcaagggacgcggcgggtcgctgctccgcgagaagatgatcgagggcgccggggaccggttcgtcgtcatcgtcgacgagtccaagctcgtcccccgtctcggatgcacgggcgccatccccgtcgaggtcatccctttcggcgcgccccacacgctgggactcatccgcaacctgttcgacggcgtgtccggcttccacgccaggctcaggaccgcccccgccgccaagggggaagacttggaggcgccctttgtcaccgacaacggcaactacatcgtcgagatgttcttcgaggacggcatccgcggcgacctgcgcgacatcagcgaccgcctgctccggatcaccggcgtcgtcgagcacggcatgttcctgggcatggccaccaccgtcattgtcgccaacaaggacggcaccgtcgcagtcatgggcaggaagaagtag

SEQ ID NO: 2651 - DNA, 774 bp, Zea mays
atggtcagcgcsgccgcctcgccgccgccgtccgggaagccgacgcaggacgagctgaagcgcttggcggcgcaccgcgcggtggagctcgtggagccctgcatgacgctgggcctgggcacgggctccacggcggcgcacgcgctggaccgcctgggcgacctcctccgcgcgggcgcgctgccgggggtgtccggcgtgccgacctcgctcaagacggaggcgcacgcggcgcgcgtcggcatcccgctgctcccgctcgacgccgccagcatcgcgctgtccatcgacggcgccgacgaggtcgacccggacctcaacctcgtcaagggccgcggcggctcgctgctccgcgagaagatggtcgagggcgccggcgcccgcttcgccgtcatcgtcgacgagtccaagctcgtgccgcgcctcggctgcaccggcgccgtccccgtcgaggtcgtcccgttcggcgcgccccacacgctgggcctcatccgcggcctcttccacggcctgcccggcttccacgccaggctcaggaccaccaccgtccccgagggggagcaaggctccgagcagcagcccttcgtcaccgacaacggcaactacatcgtcgagatgttcttcgacggcggcatccgcggcgacctgcgcgacatcagcgaccgcctgctccgcataaccggcgtcgtcgagcacggcatgttcctgggcatggccaccgtcgccattgtcgccaagaaggacggcacggtcgcagtcatggaaaggaagtag

SEQ ID NO: 2652 - DNA, 828 bp, Oryza sativa
atgggcagcttcgcctcccccctcgacgccgcccccgcccctcccaccgccaagccctcccctccgccggcgccggcgccggccaacgggctggtgacccaggaggagctgaagcgggtggcggcgcaccgggccgtggagatggtggagcccgggatgacgctgggcctcggcacgggctccaccgcggcccacgcgctggaccgcctcggcgacctcctccggtccggggagctcgccgcggtggccggcgtcccgacctcgctcaagacggaggcgcacgccgccagggtggggatcccgatgctgccgctcggggaggcgggcgggatcgatctgtccatcgacggcgccgacgaggtcgacccggagctgaacctcgtgaaggggcggggtgggtcgctgctcagggagaagatgatcgaggggtccgggggaaggttcgtcgtcatcgtcgatgagtccaagctcgtcccgcggctcggctgtacgggcgccgtccccgtcgaggttgtccccttcgggtgcgaccacactctgggcctcgtccgcaaggtgttcgacggattgcctggcttcagcgcgaggctcaggacggtcgcctccaaggacggcgaggggaaggaggagatgttcgtcaccgacaacggcaactacatcgtcgagatgttcttcgaggatggcatacgcggcgacctcaacgagatcagcgaccgcctcctacggatcaccggcgtcgtcgagcacggcatgttcctcggcatggccacctcggtggtcgtcgccaagaaggacggcaccgtcgccctgctccacaagaagaagtaa

SEQ ID NO: 2653 - DNA, 648 bp, Populus trichocarpa
atggtcctcggcctaggcaccggctccactgccaaacacgccgtcgaccgtatcgccgatctcctacaccaaggcaaattgaagaacattataggcatacccacctctaaaaaaacccaccagcaagccgtgtcccttggcatccctttatccgatctcgattcgcatcccatcgttgatcttgcaatcgacggtgctgatgaggtggactcgaatctcaatttggttaaggggcgtggtgggtctttgcttagagagaaaatgatcgagagtgcttgcaagaagtttattgttattgttgacgagtctaaattggtgcctcatgttggtgctagtggtgccatgcctgttgaagttgtgccattttgttggaaatttactcaagataagctacaaagtttgtttgattacgcggggtgtgttgcgaaattgaggtctaataatgggggtgaagatggtgagatttttgttactgataatgggaactatatcgtggatttgtttttcaagaaggatgtcggggatttaaagattgctagtgatgctattctgaggctagctggggttgtggagcatggaatgtttcttgatatggcaactactgttatagttgcaggcgagcttggaatcactatcaagaataagtag

SEQ ID NO: 2654 - DNA, 729 bp, Thalassiosira pseudonana
atgacatctcaagaagaactgaagaaacagaccgggtacaaggcgatcgacgattatgttacatctggcatgaaggtcggtctcggcacaggctccactgcctactacgccgtcgaaaggctcggacaaaagctcaaatccggagagctcagggatatcgttgccgttcctacttctattagaaccaaggaacaggccgaatcgttgggaatacctctcgtcacccttaacgagcattcaaagcttgatgttgcgattgatggagctgacaatgtagatccagagttcaacctcgtgaagggaggcgggggagccttgttgagggagaagatggtagaattggcagctgataagtttatcgttattgttgacgaatctaaactgtgcgaaggaatgggacctggattcccaatccctgtggagattactcccttttgtatgaaccatactatccgtactatcgaagcgttgccatcgtgtgcaggatgcaagcccgtattgcgaatgggatcaagttctaataacaaagttgacggggacgagattgcagtgacagataacggaaactacattgtggatttgcactttacagagaacatcaaagatgtaccgaaaatggcttcagatttgaaagcaacttgtggagtggtagatcatggattgttctgtggaatgacaactgcatgtatcattgctggagcagatggaattgtcgtcaaggaggcttaa

SEQ ID NO: 2655 - DNA, 831 bp, Thalassiosira pseudonana
atgaaattcattgccgccgccttcgctgcagtcgcaacccagaatgttgctgccttcgcccctatgacccaacgcagcagggtctccacctctatccgcatggccttgtctcaagatgagttgaagaagatggtcggctacaagtcagtggacgactacgtaaagtccggaatggtcgttggccttggaactggttccactgcttattttgccgttgagcgacttggagagaagctcaagtctggagagctcaaggatattgtggccatcccaacttctgtgcggaccaaggagcaggcagaggaacttggtatcccacttgtgactcttgatactcattccaagcttgatgttgctattgatggagctgatgaggtcgatcctgatcttaaccttgttaagggaggtggaggagctctccttcgagaaaagatggtggaggtttgtgctgataagttcatcgtcatcgtcgatgagtccaagctttgcgacggactaggacctggtttccctcttccagtagagattactcccttttgtcatattcacaccctgaataccattgccgcattgccttcgtgcgctggatgcaaggctgttcttcgtatggggtcaagctcaaccaacaaacctgatggagacgagattgctgtgactgacaacggaaactacatcgttgacctgcacttcactgagcctatcaaagacgcaccaaccatggcaaaggagcttaagaacactgtgggagttgttgatcatggacttttctgcggaatgaccactgctgtcatcattgctggatctgatggaatctctgtgaaggaggcttaa

SEQ ID NO: 2656 - DNA, 864 bp, Phaeodactylum tricornutum
atgcgtctcacagccggtgcttctattcttctggcgtcttctgctcacgcctttaccaaccctgccttttttcctcgcacagcgaccttcgcatcgactagttcttacaccagtgctctgattttaaaaatgggagttgaccaggacgagttaaaaaagcaggtaggctacaaggccgtcgatgactatgtcaaatccggaatggttgtgggtttggggactggttccaccgcatactatgctgtggaacgcgtcggcgaaaagctcaagtccggcgagctgaaagatgtcctcgccattcctacatcgattcggacgaaggaacaagcggaatctttaggcattcccctcgtcactttggacacccatagcaaactggacgtggcgattgacggtgccgacggagttgaccctgaactcaatttgaccaagggaggtggcggtgccctatttcgtgaaaaaattgtcgagatttgtgccgacaagtttatcgtgattgtggacgagtccaagctttgcgacggactgggacccggctttcctattccggtggaaattttgccattctgccacgaacatactatgcgtgtgattggtgagttaccttcgtgcaagggatgcaaaccggtcttgcgcatgggttcatcgacgaacaatcaggtggatggtgatgaaattgccatttcggacaatggtaattacctcgtggatttgcactttgaagatcctatcaaagatccggcaaagatggctcaggaactcaaaaatgtggttggtgtcgttgagcacggtcttttttgcggcatgtccacagcggtaatcattgctggagcggatggtatcagtgtcaaagaagcgaagtaa

SEQ ID NO: 2657 - DNA, 836 bp, Pavlova lutheri isolate 3028
gcacgaggctcgtcttgacgagtgcgctcttcgccttctccccgcagtcggtcacgagcaggctgaaccgcagcgcgctccgcacgccggcgcagcaggtggtgatggcgacgcaggacgagctgaagaagctcgcgggctacaaggccgtcgacgactacgtgaggtctggcatggtcgtcggccttggcacgggctcgaccgctgcgtttgccgtcgagcgcgtcggcatgaagctcaaatcgggcgagctgaaggacatcatcgccatcccgacgtcggtgcgaaccaaggagcaggctgaggcgctcggcatcccgctcgtcacgctcggcacccactctgatcttgacgtcgcgatcgacggcgcggacgctgtcgatccgcgcctcaacctcatcaagggcggcggcggcgcgctgctgcgcgagaagatggtcgaggtgtgcgcgaagaagttcatcgttattgtcgacgacaccaagctctgcgccggccttggccccagctttcccttgcccgtcgagatcacgccgttctgctgggagcacacgctccgcaaggtggccgcgtgcccggccgccgccggctgcgaagccaagctgcgccttggctcggcggcgacgggttcgaaggtggatgggactgatcccgccgtcaccgacaacgacaattacatcgtcgacctcttcttcaagcagccgatcgccgacccggtcgcgctcgccgcgcagctcaaggcgacggtcggcgtcgtcgaccacggcctcttctgcggcatgacgacggcgtgcatcatcgcgggcaaggacggcatcagcgtgcagacgccctga

SEQ ID NO: 2658 - DNA, 897 bp, Ostreococcus tauri
atgcgcgcgacgtcgtcggtgacgcgcggtacgttcgtcccgcgcgcgcgaacgctcggaaagggtcgtggaggcgcgcgtcggacgcgatcgcgggtgatgtcgacgcgggcggcgatgacgcaggatgaattaaaaaagctcgtcggatataaatccgtggacgatcacgtcgagagcggtatggtggtcggtctcggtacgggatcgacggcgtacttcgcggtcgagcgcgtcgggcaaaagctggcgagcggggagctgaagaatgtgatctgcatcccgacgagcgagcgcacgcgcgagcaggcggaatcgctgaagattccgttgtgcacgctgaacgagaagtcggaactcgatgtcgcgatcgatggcgcggatgaggtggatccggcgttggcgttggtcaagggcggcggcggcgcgctgttgcgcgagaagatggtggaggtgatggcgaagaagtttgtcgtcatcgtcgacgagtccaagctctgcaagggactcggaccgggattcccgttgccggtggagatcacgccgttctgccacatgcacacgctgcgtacgatcgcaaagttgcccgcgctcgcgggttgcgaggccatcctccgcatgggatcctcgtcgaacaacaagatcgacggcgataacatcgcggttacggataacggcaactacatcgtcgacttgcacttcaagtccccgatcaaggatccggtcgcggccgcgagccagctcaagaactgcgtcggcgtcgttgatcacggtttgttcgtcgacatggcttaccaagtcatcgttgcgggcagcgatggcatccgcgtcgccggcacggatggcgagaagccgtggtgtttattaatacgaaataacgatgaatccacatcatag

SEQ ID NO: 2659 - DNA, 753 bp, Ostreococcus lucimarinus CCE9901
atggcgctgagccaagacgaactgaagaaactcgtcggatacaagtccgtggacgaccacgtgacgagcggtatggtcgtcggcctcggtacgggatccacggcgtactacgcggtcgaacgcgtcggacaaaagctggcgagcggggagctcaaggatgtgatttgcatcccgacgagcgagcgcacgcgcgagcaagccgagtcgctgaacattccgttgtgcacgctgaatgaaaagagcgaattggacgtcgcgatcgatggtgcggatgaggttgatccggcgttggcgctcgtgaagggcggcggtggtgcgctgctgcgagaaaagatggttgaggtcatggcgaagaagtttgtcgtcatcgtggacgagtccaagctttgcaagggtctcggaccgggtttccctttgccggtggaaatcacgccgttttgccacatgcacacgctgcgaacgatcggtaagcttccggcgttggctgggtgcgaaccgatcttgcgcatggggtcgtcgtcgaacaataagaacgacggcgataacatcgcggtgacggataacggcaactacatcgtggatttgcacttcaagacgccgctcgcggacccggtggctgcggcgaaccagttgaagaacaccgtcggcgttgtcgatcacggtttgttcgttggcatggcgtaccaagtcatcgtcgccggaagcgacggtatccgcgtggcgggtaccgacggcgaaaaggcgtggtggtag

SEQ ID NO: 2660 - DNA, 753 bp, Micromonas pusilla
atggcgcccacgcaggacgagctcaagaagctcgtcggatacaagtcggtggacgaccacgtcgagtccggcatggtcgtcggcctcggcacgggcagcaccgcgtacttcgcggtcgagcgcctcgggcagaagatcgcgtccggagagctcacggacatcgtcgcgatcccgacgtccgtgaggacgaaggagcaggcggagtcgctgaagatcccgctgtgcacgctcaacgaaaagtccatcctcgacgtcgcgatcgacggcgcggacgaggtcgacccggacctcgcgctcgtgaagggcggcggcggcgcgctcctccgcgagaagatggtcgaggtcatggcgaagaagttcgtcgtcatcgtggacgagtccaagctctgcaaggggctcggtccggggttcccgctcccggtggagatcacgccgttctgccacatgcacacgcttcgcacgatcgcggacctcccctccgtgaagggctgcgaggccgtgcttcgcatggggtcgtcgtccacgaacaaacccgacggcgacgagatcgcggtgacggacaacggcaactacatcgtggacttgcacttcaaggagccgatcaaggacgtgaacgcggcggcgagcgagttgaagaacaccgtcggcgtcgtcgaccacggcttgttcgtcgggatgtcgtaccaggtcatcgtcgcggggtccgacgggatcaaggtcgcgggcaccggcggtgagaaggcgtggtggtga

SEQ ID NO: 2661 - DNA, 681 bp, Micromonas sp. RCC299
atggtcgtcggcctcggcacaggctccaccgcgtacttcgccgtcgagcgcctcggcgagaagctcaagtccggcgagctgaaggacatcatcgcgatccccacctccgagcgcaccagggagcaggccgagtcccttggcatccccctctgcaccctcaacgagaagtccgtgctcgatgtcgccatcgacggcgccgacgaggtcgatcccgacctcgctctcgtcaagggtggcggtggtgccctcctccgcgagaagatggtcgaggtcatggcgaagaagttcgtggtcattgtcgacgagtctaagctgtgcaagggcctcggccccggcttccccctccccgtggagatcactccgttctgccacatgcacaccctccgcaccatcgccgcgctcccctccgtcgcgggctgcgaggccgtcctccgcatgggctcctcctccaccaacaagcccgacggcgataacatcgcggtcaccgacaacggcaactacatcgtcgacctccacttcaaggagcccatcaaggacgtcaacaaggcggccgaggagctcaagaacaccgtcggcgtcgtggatcacggcctgtttgtcggcatgtcctaccaggtcatcgtcgcgggcaaggacggcatcaaggtcgcgggcaccgacggcgagcccgcctggtggtaa

SEQ ID NO: 2662 - DNA, 787 bp, Oxyrrhis marina
ccgcaaggcggtgttcccggcttgcttcacagtgccatggctgcgtgtcgatctcgaagcattgaagaagcagactggctaccgggctgtggatgactttgtcaagtcgggcatgattgtcggcctggggacgggctccaccgcgaagtacgcagtagaccgtgttgcggagaagttgaaaagtggggagctgaaggatgttgtgggcattccaacatctgagcgcaccaagcagcaggccgaggagttgggtgtcccattgacgaccttgaatgatattacgtcccaagtcgacgttgctatcgacggagctgacgcggtggacccagggtttaatcttgtcaaaggagggggcggtgctcatttgcgggagaagctggttgaggcctttgccaagcagtttgtggttatcgttgatcaaacaaaagttcaggaagggctaggaccatcgtttccgctgcctgtggagattgtgccgtttggttcggagcatatcatgaggcaggttgcccagctcccggctttcaaggatacggggtgtcgagcacagcttcggaaaggctccgcgagcaccgggtccaaggaggatgggcctgatgttgccgtcactgacaatggcaactacattgttgatctctttttcgagaagtatattccggacccgggggctgcagctcagcagttgcagggggtcgtcggtgtcgttgaacatgggttgttttgcggaatggctacggatgttctggtagcctacccggatggtgttcgtccactgaagcgagtttag

SEQ ID NO: 2663 - DNA, 780 bp, Toxoplasma gondii
atgaatcctcaggacaaagcaaagcaagccgtgggctacttcgctgtcgatacttatgtacgaagcggcatgaaggtcggtctcgggaccggaacgacagcgaagttcgttgtcgagagaatcggccaacgcatgcaggaagggtctttgaaggatctgctctgcgtcccgactagcgaggccactcggaaacaggcagagagtttgggaattcctctgacaactctcgacggcattgcagactgtctcgatgtagccatcgacggagctgacgaaattcttccgcccaccctcggactcgtgaaaggacggggtggcgccctgctgcgcgaaaaaatgatcgctgcagctgccaagacattcatcgtggctgcggatgaaacgaaactcgtctccaacggcataggctccacgggagctcttcctgttgaagtagtcgtcttttccggctcccacacaaagcgcttgctttccgcgttgccttcggtgaaacgccatggcggtcgggcggagtttcgcaagagagctggcgccgcgaccggagaaaagaacggtggccaggaagatatccgggaagaagaccgatttgtgacagacaacggaaactacatcgtcgacctctacttcacagagactgtgcccgatcttcatgaaatggacaaagaactcaaaagcatccctggcgttgtcgagaccggcttttttctcgacctggcctccgtgtgcctgatcggcaaggccgacggctctgtcgcaacgttgactgcagagcgcaaatga

SEQ ID NO: 2664 - DNA, 780 bp, Toxoplasma gondii
atgaatcctcaggacaaagcaaagcaagccgtgggctacttcgctgtcgatacttatgtacgaagcggcatgaaggtcggtctcgggaccggaacgacagcgaagttcgttgtcgagagaatcggccaacgcatgcaggaagggtctttgaaggatctgctctgcgtcccgactagcgaggccactcggaaacaggcagagagtttgggaattcctctgacaactctcgacggcattgcagactgtctcgatgtagccatcgacggagctgacgaaattcttccgcccaccctcggactcgtgaaaggacggggtggcgccctgctgcgcgaaaaaatgatcgctgcagctgccaagacattcatcgtggctgcggatgaaacgaaactcgtctccaacggcataggctccacgggagctcttcctgttgaagtagtcgtcttttccagctcccacacaaagcgcttgctttccgcgttgccttcggtgaaacgccatggcggtcgggcggagtttcgcaagagagctggcgccgcgaccggagaaaagaacggtggccaggaagatatccgggaagaagaccgatttgtgacagacaacggaaactacatcgtcgacctctacttcacagagactgtgcccgatcttcatgaaatggacaaagaactcaaaagcatccctggcgttgtcgagaccggcttttttctcgacctggcctccgtgtgcctgatcggcaaggccgacggctctgtcgcaacgttgactgcagagcgcaaatga

SEQ ID NO: 2665 - DNA, 780 bp, Toxoplasma gondii
atgaatcctcaggacaaagcaaagcaagccgtgggctacttcgctgtcgatacttatgtacgaagcggcatgaaggtcggtctcgggaccggaacgacagcgaagttcgttgtcgagagaatcggccaacgcatgcaggaagggtctttgaaggatctgctctgcgtcccgactagcgaggccactcgcaaacaggcagagagtttgggaattcctctgacaactctcgacggcattgcagactgtctcgatgtagccatcgacggagctgacgaaattcttccgccaacccttggactcgtgaaaggacggggtggcgccctgctgcgcgaaaaaatgatcgctgcagctgccaagacattcatcgtggctgcggatgaaacgaaactcgtctccaacggcataggctccacgggagctcttcctgttgaagtagtcgtcttttccagctcccacacaaagcgcttgctttccgcgttgccttcggtgaaacgccatggcggtcgggcggagtttcgcaagagagctggcgccgcgaccggagaaaagaacggtggccaggaagatatcccggaagaagaccgatttgtgacagacaacggaaactacatcgtcgacctctacttcacagagactgtgcccgatcttcatgaaatggacaaagaactcaaaagcatccctggcgttgtcgagaccggcttttttctcgacctggcctccgtgtgcctgatcggcaaggccgacggctctgtcgcaacattgactgcagagcgcaaatga

SEQ ID NO: 2666 - DNA, 714 bp, Plasmodium knowlesi
atggacgacctgaaaaggcgcgtggcctacaaagcggtcgacgactacgtccagtccaacatgacaatcgggcttgggactggtaccactgtattctatgtacttgagaggatcgagaatttaatgcgaaatgggaaaatcaaggatgtggtgtgcatccccaccagtatcgacacggagataaaggcccaaaaattaggcatccccctaacgacgctggaaaaaaattcccacatagatatagccatagatggtgctgacgaaattgatatggacctaaatttagttaaaggtcgaggcggggccctcgtgagggagaagttggttgcctcctgtgcatccttccttataattattgctgacgaatccaaactttgcacgaatggattgggcacgaagggatcagtaccaattgaaatcctctcctttggacatgagaagattatccagagtttgctaaaaatttcttcactcaaaaactgcaaatataatttgcgccagaagaatggggaagtgtacataacggacaataaaaactacatcgtcgacttttacttcagcaacccgatccaggatttacgagacacttgcgacaagataaagatgatcaccggcgttgtagaccacgggattttcgtaaacatgacgagcgtggcgctgataagcaaacaggatgggacggttctgaagttggacaaaaacgcaaacagttga

SEQ ID NO: 2667 - DNA, 714 bp, Plasmodium vivax
atggacgacctgaaaaggcgcgtggcctacaaagcggtcgacgactacgtgcagtctaatatgaccatcgggcttggcaccggcaccaccgtgttttacgtgcttgagcggatcgagaagttaatgcgaaacgggaagataacaaatgtggtgtgcatccccaccagcatcgacacggagataaaggcccgaaatttaggcatccccctgacgacgctgaagaagaactcccacattgacattgccatagacggagcagacgaaattgacatggacctaaatttggttaaaggacgcggcggggccctcgtgagggagaagttggttgccgccagtgcctccgtttttataattattgtggacgaatccaagctgtgcacgaacggcctgggcacaacaggagcggtgccgattgaaatcctcgcctttggccacgagaagataattcagaatttgctcaaaatttcctcccttgaaaactgccagtataagttgcgggagaagaacggggaggtgtacataacggacaacaaaaactacatcgtggatttttacttcgccaacccgatcgaggatttgcaggacacctgccacaagataaagatgaccacgggcgttgtggaccacggcattttcgtaaacatgacgagcgtggcgctgataagcaagcacgacgggacggtgctgaagctggacaagcacgcgggcagttga

SEQ ID NO: 2668 - DNA, 717 bp, Plasmodium yoelii
atggacagtctaaaaaaaatagtggcatataaagcagttgatgaatatgtccaatctaatatgacaattggacttggaacaggatccactgttttttatgttattgaaagaattgatgcattaatgaaaagtgggaaaataaaaaatctaatatgtgttccaactagtatagatacagaaattaaggcaaaaagcttaggaattcctttgacaagcttaacaaaaaatttaaaaattgatattgcaatagatggagctgatgaaatagactccgacttaaatttaataaaaggacgggggggtgcactagttcgtgaaaagctagttgcaggaaatgcctcatgctttataataattgttgatgaatcgaaaatgtgcgaagatgggctagggacaacaggagctgttccaatcgaaattctatcttttggttatgaaataataattgaaaatttactaaaaatatcagctcttaaaaattgtatatatagattaagagaaaaaaatggagaaatttttataactgataataataattatattgttgattttttttttgataatccgattgaaaacttggcacaaacttgtgaacaaattaaaatgacaacgggagtaatagatcatggaatttttgttaacatggcgagtatcgctttaataagcaaaataaatggaacaattttgacactaaaaaaaaataaaggaataaattaa

SEQ ID NO: 2669 - DNA, 714 bp, Plasmodium berghei
atggacagtctaaaaaaaatagtggcatataaagcagtcgatgaatatgttcaatctaacatgacaattggacttggaacaggatccactgttttttatgttattgaaagaattgaagcattaatgaaaagtgggaaaataaaaaatttaatatgtgttccaactagtatagatacagaaatgaaggcaaaaagcttaggaatccctttggcgggtttaacaaaaaatttaaaaattgacatagcaatagatggcgctgacgaaatagacgccgatttaaatttaataaaaggaagagggggagcacttgttcgggaaaaactagttgcagcaaatgcctcatgttttataattattgttgacgaatctaaaatgtgcaaagatggactaggaacaactggagctgttcccattgaaattttatcttttggttatgaaatgataattgaaaatttactaaaaatatcagctcttaaaaattgcatatatttaagagagaaaaatggagaaatttttataactgataataataattatattgttgattttttttttgataatccgattgaaaatttggtacaaacttgtgaacaaattaaaatgacaactggagtcatagatcatggaatttttgttaacatggcaagcatcgctttaataagcaaaataaatggaacaattttaacactaaaaaaaaataaaggaataaattaa

SEQ ID NO: 2670 - DNA, 684 bp, Plasmodium chabaudi
gcatacaaagcagtcgacgagtatgtccaatctaacacgacaattggacttggaacagggtccaccgttttttatgtccttgaaagaattgaaacattaatgaaaagtgggaagataaaaaatttagtatgtgttccaaccagtatagatacagaaatgaaggcaaaaagcttaggaattcctttgaccggcttaacaaaaaatttaaagattgatatagcaatagatggtgctgatgaagtagactccgacttaaatttaataaagggacgaggtggtgcacttgttcgggaaaaactagttgcagcaaataccgcttgctttatagttatcgttgacgaatcaaaaatgtgcgaagacggattaggaacaacgggagctgtgcccatcgaaattctgtcttttggttatgaaatgataattgaaagcttattaaaaatatcagctcttaaaaattgtacatataaattaagagagaaagatggagaaatatttataactgataatcataattatattgtcgattttttttttgaaactccgattgaaaatttggttaaaacctgtgagcaaattaaaatgacgactggagttgtagaccacgggatttttgccaacatggcgagcatcgccttaataagcaaatcaaacggaacaattttaacactaaacaagaataaataa

SEQ ID NO: 2671 - DNA, 723 bp, Theileria annulata
atgagtgggactaatcagcttagtctaatgaaattagtggctgaaaaggccgtcgatacttatgttaaaagtaattcaatcatcgcactgggaactggaaggaccagcacgttttcccttgaaagactagctgaacgtattaaaacaaaggcaataactaacgtttttggtattccaacgagtcaaagtactcatcttaaagccgaggaacttgaaatacctttgttaactttggatgatttgatttctactggacgtaaaataaacattgcaattgatggagcagattccgttgactcgaatttgaaccttatcaaaggaggtggtggagctttattcacagaattcatggttgaacaattttcagatcaactcatcattatgatagatgagtcaaaattgtgtaatgggcacttgttagaatcacattatttgccaattgaaatagtcaaaggctgtcatttaaccacctgcaaccaaatttattcaaagtttaaatctcaaatcgttaattggaacgtaaggaaaaattcagatgggtcactcttcttaactgataatggcaatcttataattattcaattatttgtactaattaatttaatgtgtaaattaatttatcatcagatacatggagtagtttgttcagggctctttttaaatatggccaccaaatgccttgtagcaaaatccgataacaccatcgtaacacttgaacgctaa

SEQ ID NO: 2672 - DNA, 723 bp, Babesia bovis
atggacagacaggagtgcatgcgtcgtgcggcggaatttgctgtagacacctatattcagaatggcatgatagttgggcttggcaccggttctacagccagttatgctgtaagatacttagctaagcaactttctgctgcgaaattgcgtgatgtgactgctgtagctaccagtgtggctacttttagattaatgtctgagttgggtattccatcacttgagtttgatgattctgtgtctatagacgttgccattgacggtgctgatgccatagacggtgatttaaatttaattaagggtggaggaggggcacttttccgtgagaagctcgtggagctaggtgctcgcaaagtgataattatagctgacggcaccaaaaaggtcaagggtcaccttctgcaggcattccacgtgccggtagagattgtacagttcggccatgttgttacaattagtcgcattttgagtcgtgtaggacctcatgtacgtagttggactaaacgtatgaatgccgatggttctctttacttaactgacaataacaacgtcattatggacattgaattcggccctactgacttaccgaatctggactttgagttgcgatcggttcacggggtagtttgtacgggcctttttcttggtattgcttccactgtggtgatagcccactcggatggtaatcttgaggtcctttctcccgatactgcctcgaattcttag

SEQ ID NO: 2673 - DNA, 852 bp, Acyrthosiphon pisum
atgcaattgctgctgtccaagtcaataatatttactgtcatcgataagttcagattgtcgtccggaaagtatttcaaaatgagtgctgtgagttttaccgtaggacgcaaaaattgttccacggcgggcgtggacgtatctaaaatgtgtgccgcacaccgagccatcgataagcatgttaaagacggcatgatactgggcattggtagcggctcgacgattgtgtacggtgttcaacgattggcacaaagaacgaaagacgagaatttatctgttgtttgtgtgccaacgtcgtatcaggcacgtcagctgattatcgattacaaactaacattgggaaacttagacacacatcctaaaatagattgtacaattgatggagcagatgagattgaaaagggcactttgacatgcataaaaggaggaggagggtgtttgacacaagaaaaaattgtagcatcgtgttctgaaaaattgataattgttgccgatggagctaaagaggtggaccatttgggtcaaaaatggaagaaaggtatacctattgaggtaatacctatgtcatgtaaaccgattcagcaaaaaattgaaggaaaatatggaggtgaagccattttgaggatgtctgctgataaagcaggacctttggttacagacaacggtaacttcttattggattgggtttttcctgaaacaaaatattgttggtcatccgtccacaattacttaaaactaatcccaggagtggttgagactggattattcattgatatgacagatgaatgcttggtcggcgactcacaaggcaatgtacgacaactgaagaagactgaacagacattagagttgtag

SEQ ID NO: 2674 - DNA, 774 bp, Acyrthosiphon pisum
atgagtgctgtgagttttaccgtaggacgcaaaaattgttccacggcgggcgtggacgtatctaaaatgtgtgccgcacaccgagccatcgataagcatgttaaagacggcatgatactgggcattggtagcggctcgacgattgtgtacggtgttcaacgattggcacaaagaacgaaagacgagaatttatctgttgtttgtgtgccaacgtcgtatcaggcacgtcagctgattatcgattacaaactaacattgggaaacttagacacacatcctaaaatagattgtacaattgatggagcagatgagattgaaaagggcactttgacatgcataaaaggaggaggagggtgtttgacacaagaaaaaattgtagcatcgtgttctgaaaaattgataattgttgccgatggagctaaagaggtggaccatttgggtcaaaaatggaagaaaggtatacctattgaggtaatacctatgtcatgtaaaccgattcagcaaaaaattgaaggaaaatatggaggtgaagccattttgaggatgtctgctgataaagcaggacctttggttacagacaacggtaacttcttattggattgggtttttcctgaaacaaaatattgttggtcatccgtccacaattacttaaaactaatcccaggagtggttgagactggattattcattgatatgacagatgaatgcttggtcggcgactcacaaggcaatgtacgacaactgaagaagactgaacagacattagagttgtag

SEQ ID NO: 2675 - DNA, 903 bp, Pediculus humanus corporis
atgaataactttcaagtgcatctgataatctttttatttcgtctaatgacattaaactcactaggcttagcaaatggatttctattaatcttttcagttacaccattttttaagaaaagtaataatttgtcgcataataaattcttttttaactataattttaatcgttttttgaccttaaaacaaataaggaaaatgtcaacggttgaagaggcgaagaaatgtgctgcacattcagcagttgttaatcacgttaagaataacagcattgtaggtataggcagtgggtctacagttgtttatgctgttgaaaaattagccgaccgtataaaaaatgaaaagttacatatcatttgtatcccgacttcatttcaagctgaacaactaattactgaaaacaaattaaatttaggttctctctctcagtatcctgagattgatgtggttatcgatggtgctgatgaagtagatgaaaacttaacattaataaaaggaggagggggatgtttattacaagaaaaaataattgctagttgttcgaaagaaatgatagttatagctgatttcaataagaaatccaaaaaattaggtgaaaaatggaagaaaggagttcccattgaagtcattccattttgttatgtaccgataaaaaacaaaatacaattgaaatttggtggagaagctgtgctgcgaatggccaagatgaaagctggaccagttgttactgacaatggtaattttatcctcgattggaaattccctgaaaataaagattataattgggaaaaaataagtgtcgatttaaaactaatacctggagttgtcgaaactggattgtttgttaatatggctaagaaagcatattttggaatgtcagatggttctgtcgttatgactccttag

SEQ ID NO: 2676 - DNA, 816 bp, Aedes aegypti
atgttccaacgtttcttcgggacagtttcgctattctctggttctagatctataaaccctctattaagcagtatcgtcgccagccgtgcttcctcgtctgccgcagcaaaaatgagtctggatctggccaaaaagattgccgccttcaaagccgtcgacgagtacgtgcgggataacacggtggtcggagtgggcagcggttccaccgtggtctacgccgtgcaacgcctggccgagcgggttaaaaccgaaggattgaagctggtatgcattcccactagcttccaggcgcgccagttgattatcgaaagcggcctagtgctgggcgacttggagcaacacccgaagatccattgtgccatcgatggggccgatgaagtggacgctgacatggtcctgatcaaaggtggtggaggctgtctgctgcaggagaagattgtggcatcctgtgcggatcagctggtggtcattgctgattatacgaagaattccaagaaactaggagagcagtacaaaaaaggcattccaatcgaggtggttccaatggcgtacgttccgatcaggaacaaagtggcggccaaatatggaggaagtctgaagctacggatggccgtggcgaaagctggtcctgtcgtcactgacaacggtaactttattctggattggcacttcccggaagaaaagttcgattgggacgtcgtcaatcgtgacataatgatgattcctggagtagtggagacggggctgtttgtaaaaatggcaacgaaagcctattttggccttgccgatggatctgtgactgaaagaagcgcctag

SEQ ID NO: 2677 - DNA, 837 bp, Anopheles gambiae
atcctcgtggggcacatgttccggcaattgctgcattcactttcacctagcttagtacagtcgggacgacggagttcgctcgcttgcagcacaaaccttgctctgttttcaacgcaaaccaccgccaagatgtccctggaggaagcaaaaaagtgtgccgcgtacaaggcggtcgatgagtacgtgaaggataataccgtcgttggggtcggttcgggctcaaccgtggtgtacgcggtgcaccggatagcggagcgggtgaaggcggaaggactgaagctggtctgcattccgacgagcttccaggcccggcagctcatcatcgagcacgggctggtgcttggcgatttggagtgcaatccccggctggactgtgcgatcgatggggcggacgaggtggacgccaagatggttctgatcaagggtggcggtggatgtttgctgcaggaaaaaatcgtcgcctcctgtgccgaccggctggtggtgatagcggactacacgaaagactcggccaagctgggccaacagtaccgtaaaggcattccgatcgaggtcgcaccgatggcttacgtgccgatcaagggcaaggtggagtcgcggttcggcggtacgctcaagctgcggatggccgtcgctaaggcgggccccgtcgtcaccgacaacggtaacttcatactggactggagcttcccggccgataaggagcacgactgggacgctgtcaatcgggagatcatgatgataccgggggtcgttgatacggggctattcgttggcatggcgaccaaggcgtactttggccaacaggatggttcggtcacggaacggagcgcctaa

SEQ ID NO: 2678 - DNA, 819 bp, Monosiga brevicollis MX1
atgcggggttatgcttgtagacgttctccgaggaaattttctttgaagctcttcagcgtggtggacgtcaaaatggctgaaatttctcaagaagtgctgcaaggcctggacacggttgctcaggccaagctgcgtgccgcctatgcagcggtcgacaaccacgtcaaggatggtcaagtcgtgggtatcggcagtggctccaccgtggtgtttgccgtgcagcgactggcccagcgcgttcgcgacgaaaacttgcgggtgatttgcattcccacctcctttcaggcgcgacagctcattctcgagaacaaactggttcttggcgacctgaatgccaatcccgtcctggatgtggccattgacggcgcagatgaagtgtcggcccagttggactgcattaaaggtggaggcggctgccttttgcaggaaaagattgtggcgtccaatgccgatcaactgattattatcgccgattacagcaagattgcagactacttaggatctgtctggaagaagggcgtgcccttggaggtcattgccgattgctacgttccaatcatgcgcaagctcgagaagatgggcggcaagccggtgcttcgcatggccaaagccaaagccggtccctgcgtcactgacaacggcaatttcatcgttgactgcgactttggcgtcatgcaagagcccgccaagctcgagcagcaactcttgagcattcccggcttggttgagaccggtttctttttgcaaatggccgtcaaggcttactttggcatgcaggacggcagtgtcaagacgctcgatgcacctgcacggcaataa

SEQ ID NO: 2679 - DNA, 792 bp, Ciona intestinalis
atgaaattcggttccatttgtaggtcaatttattcagtagttagaatgtctaccacgaattcttcgctcacgaatggagttgaaaatgctaaacgtgtcgccgcttttaccgccgccaacaatttcgtacagaatggctatgtaattggtgttggcagtggttcaactatagaatatgctgtagaacgcattgcggaaagagtagaggctgagaatcttaaagtgacatgcgttccaacttcattccaagccagagaacttatattaaagtacaagctttcactaagtgatcttgaccgacattccaagcttgatgttgctatagatggagctgacgaagtggatgagcaatttacccttatcaagggtgggggtggatgtttgacacaagaaaaaattgttgcagcggctgccaagaagttcgtagtcattgcagatttcagaaagaagtcaaccaaccttggtgaaaactggaaaaaaggaattcctattgaggttgttccaatggcaattcttcagattcaaaacaaaataaaagagaaatatgggggaatctgcactatacgacttgctaaaagcaaagcaggtccagtgatcacagacaacggaatgatgattgttgattggcagtttgataaaagtcataactggtctgaggtccaccagtttattaaacttattccaggtgtcgtagagactggtatatttttcaacatggccgatattgttatatatggtactgaaaatggacagtctgatattaaagcaaatacaactgtgctgacaaaatag

SEQ ID NO: 2680 - DNA, 780 bp, Schistosoma japonicum
atggctgaatcaaatgctctagaatgtgcaaagcagaaagcttgccaatcagctgtttctgactggctcaaagataatcaaattattggactggggagtggtacaaccatcaagtacgctgtagagtttattgctgaaaaagtggaaagtgaaaatttgcaaattcagtgtataccaacttcatttcaagcacgacaacttttaataaaccataaactaccagtgacagaccttgacatacatgaaaagatagatgtaacttttgatggagccgatgaagttgacgaagatcttcatttgatcaaaggtggtggtggttgtttactacaagagaaaattgttgcttcttgtactgctaatttcattgccattgtagatgaacgaaaacattcaaagagattaggctcgtattggactaaaggcttacctattgaagtaattccaatggctttcaaacctatacaaacaagaatagagaaattgtttggtggaaaagttattttacgagaagctgtttcaaagatgggtccagttgtaacagataatggaaattttttattagattggaaatttgatacaaataaacagtattattggccagaagtaaatattgaactgtcaaatatacccggtgtcgttgatactggcttatttatcaatatggcacgtagaatttatgttggcaatatgaatggtacagtttgtaaattggaagggaaaccatctaatactttatgctacaatcaacatttgcttaacagtactgatagtagcctctaa

SEQ ID NO: 2681 - DNA, 708 bp, Culex quinquefasciatus
atgtctctggagcaggccaagaagattgccgcgttcaaggcggtcgacgagtacgtccggaacgacacggtggtgggcgtcggaagtggttccaccgtggtgtacgccgtccagcggttggccgaacgggttaaggctgagggactgcggttggtgtgcattccgacgagcttccaggcgaggcagctgattattgacgccgggttggtgttgggagatctggagcagaacccgcgtattgactgtgcgattgacggggcggatgaggtggacgcggacatggtgctgatcaagggcggtggcggatgtttgctgcaggaaaagatcgtggcttcgtgcgccgcccagttgattgtgatcgcggattacacgaaggattccaagcgactaggcgagcagtacaaaaagggcatccccgttgaggtcgtcccgatggcgtacgtgcccatccgggatcgcatcgcggccaagtacggtggaaagttgcagctgcggatggccgttgccaaggccggtccggtcgttacggacaacggaaactttatcctcgactggcactttcccgacacgatcgtgaacggatgggacgaaatcaaccgggatataatgatgatcccgggggtggtggagacgggactgtttgtcaaaatggccaccaaagcgtactttggactggcggatggatcggtcatcgaacgaagtgcctaa

SEQ ID NO: 2682 - DNA, 714 bp, Apis mellifera
atgggagagttacttactctcgaaagtgctaaacaaattgcagcttacaaagcagttgacgaatatgtgaagaataacagtatcattggaattggtagtggatctacagtaatatatgctgttcacaggcttgttgaacgtgtaaaggaggaaaatcttaatgttatttgtgttccaacttcattccaagctcggcagttaatattaaataatcatcttaaattgggtgatttggagacctatcctaaattggattgtgcaattgatggagcagatgaagttgattctgacatgaatcttatcaaaggtggaggaggttgtttacttcaagaaaaaattgttgcatcctgtgctaatcaacttattatagtagcagattatacgaaaaattctcaaaaacttggtgaacaatataaaaagggtattcctattgaagtagttcctatggcatatgtcgctattttaagaagaattgaagataattatggaggacttgtgaaagttagaatggctttagctaaagctggtccagttataacagataatggtaattttatccttgattggcattttcctcgtgatataagtaattgggataaaatcaatatagaaatctcaatgataccaggagtagttgaaactggactttttataaaaatggcaaaaaaagtgtactttggaatgcctgatggtagtgttaaagaacaattttaa

SEQ ID NO: 2683 - DNA, 702 bp, Tribolium castaneum
atggcatccctcgaaagtgctaaaaaactggcggcctacaaagctgtggacctccacgtgcaaaacaattccattgtgggtgtcggcagcggctccaccgttgtttacgccgttgagaggttagccgaacgtgtgaaaaacgaaaaattaaatgtacagtgtgtcccaacgtcctttcaagccaggcaattgatcatccagcacaggctgcacctaaccgacctagagatacatccaagattggatgtttgcattgatggtgccgatgaagttgattccaccttgacattgattaaaggaggtgggggatgcttattgcaggagaagattgttgctagctgcgccaaggagttaattattatagcggattataccaaaaattcacaaaagctgggggaacaatacaaaaaggggattccgattgaagttgttccgatggcctatctccccattaaaacgcaaattgaaaaccaactgggagggacagttgagctcagaatggctaaagccaaagctggacctgtggtcaccgataatgggaattttatcctggattggaaaaacttccaggattataaatgggacacaatcaacaccaaattgaatctcattccgggagttgtggagacgggactatttgttaacatggccaagaaggcctattttgggttggccgatgggtcagtcaaagaacaaatttaa

SEQ ID NO: 2684 - DNA, 729 bp, Drosophila mojavensis
atgaacgacattattgaactggacgcagcaaagaggctagcagccgaaacagccgtggatcaatatgtgaccgaggatacgaaagttttgggcattggtagcggctcaaccatcgtgtttgtcgtccaacggcttgcggagcgcgtctggaaggagggcacactgccagaattgatctgcgtgccgtcatcgttccaagcacgccaactgatactcgatcacaatctcacattgggcgatctggatcgtaattataaaatcgatgtttatattgatggcgccgacgaagtggacagcagcctggtgctaatcaaaggcggcggcggctgcctgatgcaggagaagatagttgcctcgtgcgccaagacagttgtcatcgtggcagactatacaaagcgctcgctccgcctgggcgagcaatggtgcaagggcatacccattgaggttgcgccgatagcccatgtgccagtcaagcataagatcgaggagctctttgggggcgaagcacagctacgtattgccctgaagaaggctgggcccattgtcaccgacaacgggaattttctgttagactggagatttgttgcgaaacgtgaatacgactgggacgaggtgaataaggcaatatctatgataccgggtgtcctggagactggtctattcgtcaacatggcacacaaatgctactttggaatggccaatggcacccttaaggtccagagcaaatag

SEQ ID NO: 2685 - DNA, 729 bp, Drosophila virilis
atggactcgaaaattgctctggatgcagccaagaagctagcggcacgcgctgccgttgaccagtgggtgaccgaggagaccaaagtggtgggcattggcagcggttcgaccatagtatttgttgtggatcgcattgcggaacgcgtgtggaaggagggcgccctctccgacatgatttgtgtgccctcatcgtatcaggcgcgtaagctgatacttgatcataatctaacattgggcgatttggatcgcaactgccggatcgatgtatatattgatggcgccgacgaggtcgacagcggtatggtgctcattaaaggcggcggaggttgcctcatgcaggaaaagattgttgcctcgtgcgcgaagagtgtaataatcattgcggactacactaagaaatctctccgcctaggcgagcaatggtgcaagggaatacctattgaggtcgcgcccatggcctatgtcccaatcaagcataaaatcgaggagctcttcggcggcgaggcgcagctgcgcattgccttaaaaaaggccggcccaattgtcaccgacaatggcaactttctgctggactggagatttgttgccaaacgcgaatacaattggtacgaggtaaatctggcaatatccatgataccgggtgtcttggagactggtctgtttgtggacatggcaaccaaatgttactttggcatggcagatgggaccgtcaaggtgcagagtagatag

SEQ ID NO: 2686 - DNA, 729 bp, Drosophila grimshawi
atgacggataagatagcattggatgcagccaagaagctagcggcaataaccgcggtcgaccagtgggtcaccgaggagacaaaagtggtgggcattggcagtggatcaaccgttgtctttgccgtcgaacgcattgcggaacgtgtgtggaaggatggcgccttggcggacatcatctgtgtgccatcatcgtatcaggcacgtttgctgatactcgatcataatttgacattgggcgatttggatcgccatagcaaaattgatgtttacatcgatggtgccgatgaggtggacaatgccatggtgctgattaagggcggcggcggttgcctgctgcaggagaaaattgtggcatcgtgtgccaagaagatgattgtcattgccgattacacaaagaaatcactgcgcctcggcgaacagtggtgccgtggcatacccatcgaggtatcaccccaggcccatgtgccagtcaaactgaaaatcgaggagcttttcgggggacatgctgagctgcgtgtggcattgatgaaggccggtcccattgtcaccgacaatggcaactttctgatcgactggaaatttgtggcgaaacgtgaatacaactgggatgaggtgaatcgcgcaataaccatgataccgggcgtcatggagacgggtctattcgttgacatggcaatcaaatgctattttggcatggctgacggcaccgtcaaagtccagaataaataa

SEQ ID NO: 2687 - DNA, 843 bp, Drosophila sechellia
atgttatctgggtttttgcgacgaggcgtccaacgagcacggttcaccttcacccagcaactcggcgaagatcttttgagcggcgcagcggcggcactccacacccagatacgcaagatggatgacattgcgctggacgcggccaagaagacggcggcccgcacggcggtggaccagtgggtgactgaggacacgaagattctggggattggcagcggatcgacggtggtgtatgccgtgcagcggatcgcggagcgcgtgtggaaggagggcgagctgacggacctcatatgcgtgccttcgtcctaccaggcgcgccatctgatcctcgactacaacctcaacctgggcgatctggacaggaatcccaacatagacgtggccatcgacggggccgacgaggtcgaccgccatatggtgctgatcaagggcggcggcggctgcttgctgcaggagaaggtggtggcctcctgcgccaagcacttcatcgtggtggccgactacaccaagaactccatccgcctgggcgagcagtggtgccgcggcgtgcccatcgaggtggcgcccatggcgtacgtgcccatcaagctgcacatcgaggcgcttttcggcggcgaggcctcgttgcgtatggccaaggtgaaggcggggcccattgtcacggacaatggcaacttcctgctggactggaagttcatcgccaaccgggagtacgactgggacgaggtcaaccgcgccatcaccctcatcccgggcgtcctggagacgggcctgttcgtgaacatggcccacaagtgttactacggcatggccaatggcacggtcaaggtccagaacaagtag

SEQ ID NO: 2688 - DNA, 843 bp, Drosophila simulans
atgttatctgggtttttgcgacgaggcgtccaacgagcacggttcaccttcaccaagcaactcggcgaagatcttttgagcggcgcagcggcggcactccacacccagatacgcaagatggatgacattgcgctggacgcggccaagaagacggcggcccgcacggcggtggaccagtgggtgactgaggacacgaagattctggggattggcagcggatcgacggtggtgtatgccgtgcagcggatcgcggagcgcgtgtggaaggagggcgagctgacggacctcatatgcgtgccctcgtcctaccaggcgcgccatctgatcctcgactacaacctcaacctgggcgatctggacaggaatcccaacatagacgtggccatcgacggggccgacgaggtcgaccgccatatggtgctgatcaagggcggcggcggctgcttgctgcaggagaaggtggtggcctcatgcgccaagcacttcatcgtggtggccgactacaccaagaactccatccgcctgggcgagcagtggtgccgcggcgtgcccatcgaggtggcgcccatggcgtacgtgcccatcaagctgcacatcgaggcgcttttcggcggcgaggcctcgttgcgtatggccaaggtgaaggcggggcccattgtcacggacaatggcaacttcctgctggactggaagttcatcgccaaccgggagtacgactgggacgaggtcaaccgcgccatcaccctcatcccgggcgtcctggagacgggcctgttcgtgaacatggcccacaagtgctactacggcatggccaatggcacggtcaaggtccagaacaagtag

SEQ ID NO: 2689 - DNA, 843 bp, Drosophila melanogaster
atgttatctgggtttttgcgacgaggcgtccaaagagcacggttcaccttcacccagcaactcggcgaagatcttttgagcggcgcagcggcaacactccacacccagatacgcatgatggatgacattgcgctggacgcggccaagaagacggcggcccgcacggcggtggaccagtgggtgactgaggatacgaagattctggggattggcagcggatcgacggtggtgtacgccgtgcagcggatcgcggagcgcgtgtggaaggagggcgagctgacggacctcatctgcgtgccctcgtcctaccaggcgcgccatctgatactcgactacaaccttaacctgggcgatctggacaggaatcccaacatagacgtggccatcgacggggccgacgaggtcgatcgccatatggtgctgatcaagggcggcggcggctgcttgctgcaggagaaggtggtggcctcctgcgccaagcacttcatcgtggtggccgactacacaaagaactccatccgcctgggcgagcagtggtgccgcggcgtgcccatcgaggtggcgcccatggcgtacgtgcccatcaagctgcacatcgaggcgcttttcggcggcgaggcctcgttgcgtatggccaaggtgaaggcgggacccattgtcacggacaatggcaacttcctcctggactggaagttcatcgccaacagggagtacgactgggacgaggtcaaccgcgccatcaccctcatcccgggcgtcctggagacgggcctgttcgtgaacatggcccacaaatgctactacggcatggccaatggctcggtcaaggtccagaacaagtag

SEQ ID NO: 2690 - DNA, 726 bp, Drosophila melanogaster
atggatgacattgcgctggacgcggccaagaagacggcggcccgcacggcggtggaccagtgggtgactgaggatacgaagattctggggattggcagcggatcgacggtggtgtacgccgtgcagcggatcgcggagcgcgtgtggaaggagggcgagctgacggacctcatctgcgtgccctcgtcctaccaggcgcgccatctgatactcgactacaaccttaacctgggcgatctggacaggaatcccaacatagacgtggccatcgacggggccgacgaggtcgatcgccatatggtgctgatcaagggcggcggcggctgcttgctgcaggagaaggtggtggcctcctgcgccaagcacttcatcgtggtggccgactacacaaagaactccatccgcctgggcgagcagtggtgccgcggcgtgcccatcgaggtggcgcccatggcgtacgtgcccatcaagctgcacatcgaggcgcttttcggcggcgaggcctcgttgcgtatggccaaggtgaaggcgggacccattgtcacggacaatggcaacttcctcctggactggaagttcatcgccaacagggagtacgactgggacgaggtcaaccgcgccatcaccctcatcccgggcgtcctggagacgggcctgttcgtgaacatggcccacaaatgctactacggcatggccaatggctcggtcaaggtccagaacaagtag

SEQ ID NO: 2691 - DNA, 726 bp, Drosophila yakuba
atggacgacattgctctggacgcggccaagaagacggcggcccgcacggctgtggatcagtgggtgacggaggacacgaagattctgggtattggcagtgggtccaccgtggtgtacgccgtgcagcgcatcgcggagcgcgtgtggaaggagggtgagctgacggacctcatctgcgtgccgtcgtcctaccaggcgcgccatctgatcctcgactataacctcaacctgggcgatctggacaggaatcccaacatagacgtggccatcgacggggccgacgaggtcgaccgacacatggtgctcatcaagggcggcggcggctgtttgctgcaggagaaggtggtggcctcctgcgcaaagcacttcatcgtggtggccgactacacaaagaactccatccgtctgggggagcagtggtgccgcggagtgcccatcgaggtggccccaatggcgtacgtgcccatcaagctgcacatcgaggcgctctttggcggcgaggcttctctgcggatggccaaggtgaaggcgggacccatcgtcacggataatggcaacttcctgctggactggaagttcatcgccaaccgggagtacgactgggatgaggtcaaccgcgccatcaccctgattccgggcgtcctggagacgggtctgttcgtgaacatggccaccaagtgctactacggcatggccgatggcaaggtcaaggtccagaataagtag

SEQ ID NO: 2692 - DNA, 726 bp, Drosophila erecta
atggaagacattgctttggacgcggccaagaagacggcggcccgcacggcggtggatcagtgggtaacggaggacacgaagattctggggataggcagtgggtccaccgtggtgttcgccgtgcagcggatcgcggagcgcgtgtggaaggagggtgagctgacggacctcatctgtgtgccctcgtcctaccaggcgcgccatctgatcctcgactataacctcaacctgggcgatctggacaggaatcccaacatagacgtggccatcgacggggccgacgaggtcgaccgacacatggtgctcatcaagggaggcggcggctgtttgctgcaggagaaggtggtggcctcctgcgccaagaacttcatcgtggtggccgattacacaaagaactccatccgtctgggggagcagtggtgccgcggagtgcccatcgaggtggcccccatggcgtacgtgcccatcaagctgcacatcgaggcgctcttcggcggggaggcctctctacggatggccaaggtgaaggcgggacccatcgtcacggataatggcaacttcctgctggactggaagttcatcgccaaccgggagtacgactgggacgaggtcaaccgcgccatcaccctgatcccgggcgttctggagacgggtctgttcgtcaacatggccaccaagtgctactacggcatggccgatggccaggtcaaggtccagaataagtag

SEQ ID NO: 2693 - DNA, 726 bp, Drosophila ananassae
atggaggacattgctgtggacgcttctaaaaagagggccgcgcgcacggcggttgacgagtgggtcactgaggacaccaagatcctgggcatcggtagcggctccaccatcgtgtacgctgtgcagcgcattgcagagcgcgtgtggaaggaaggtgaactgactgaccttatctgcgtgccctcgtcctaccaggcccatcacttgattctggactacaatctcaacttgggcgatctggaccggaatcccaacatcgatgtggccatcgatggagccgatgaagtggatcgtcacatggttttaatcaaaggcggcggcggctgcttgctccaggagaaggtggtggcctcttgcgccaaacacttcatcgtggtggccgactacaccaagaactcgatcagactgggcgagcagtggtgccgcggtgtacccatcgaggtggcccccatggcctacgttcccgtcaagcttcagatcgaggccctgttcggcggcgaggcatctttacgcatggccaaggtcaaggcgggaccgattgtcacggacaatggtaactttctgctggactggaagttcattgccaaccgggagtacgattgggatgaggtaaacagggccataacgttgattccgggcgtgctggagacggggctgttcgtgaacatggcccataagtgctactttggtatggccgatggcaatgtgaaggtgcagaacaagtag

SEQ ID NO: 2694 - DNA, 729 bp, Drosophila persimilis
atgggcgacgagatttcattggacgaggccaaaaagaaggccgcacgcacggccgtggacgagtgggtgaaggaggacacaaaaattgtagggattggaagcggctcgacggtcgtgtacgcggttcagcgcattgcagagcgtgtctggaaggatggcgagctgacggacctgatctgtgtgccctcgtcctaccaggcccagcatctgatcttggactacaatctaaacttgggctcggtggatcgcaatcccatcatcgatgtggccatcgacggggccgacgaggtggactcgaatatggtattgatcaaaggcggcggtggctgcttgctgcaggagaaggttgttgccgcctgctccaaaaagttcattgtggtggccgactacacgaagaaatcgttgcatctgggcgagcaatggtgcaggggcgttccaattgaggttgcgcccatggcccaagttcccataaagctgcagatcgaggccatgtttggtggcgaggtcgtactgcgcatggcaaaggtaaaggctggacccattataaccgataatggcaattttctgctcgactggaagttcgttggcaagcgagagtacaactgggatgaagtgaatcgcaccatcaccatgatcccaggcgtcttggagacgggactcttcgttgacatggcccacaagtgctacttcggcatggccgatggcagtgttaaggctcagtccaagtaa

SEQ ID NO: 2695 - DNA, 738 bp, Drosophila willistoni
atgagtgaaactatttcgctggatcaggccaagaaattggcagcacgcgccgctgtggaagaatggattattgaaggcgaaaccaagattgtgggcattggcagtggatcgactatagtctatgcagtggaacgcctggcggaacgtgtgtggaaggacggtgaactatccgatctgatttgtgtgccaacctcttttcaggcacgttcattgatactcgatcacaatctgaatttgggagatttagatcgttatcccatattggatgtggccattgatggagccgatgaggtggacagtcgcatggtttgcatcaaaggtggcggcggttgtctaatgcaggagaagatcgttgccgcttgtgccaaacgttttgttgtggttgctgattatacgaagaaatccttacgccttggcgagcaatggtgcaaaggtgttcccattgaggtggctccgatcgcccatgtgcccatcaaactgaagattgaggccatgttcggaggcgaagctcacttgcgcatggccaaggcaaaggccggaccgattgtcaccgacaatggcaatttcctgctggactggaaatttgtggccaaacgggaatatgactgggatgaagtgaatcacgccatcaaaatgattcccggtgtcatggagacgggtttatttgtgggcatggcgcacaaatgctatttcggtatggccgatggcaatgtcaaggcgcaggtcaattcaaaatga

SEQ ID NO: 2696 - DNA, 828 bp, Danio rerio
atgaggagggttgtgttcgctcagatcagctacagattcagatctctcctccacttcttctctccaccgggcaaacacgtgcgactaatcaacagcagcaggcggctctactgctctcgcatggctgaagaggccaagaaactggcggcttatgctgctgtggacaaccacatacagaataatcaggtaattggtgtgggcagcggctcaactattgtctatgcggtggacaggctggctgagaaggtcagacaggaaaagctgaatattgtgtgtgttcccacatcattccaggcccgtcagctgattctgcagcatggtctccctctgtctgatttagaccgacatcctgagctggatgtagcgattgatggggctgatgaggttgatacggctctgaccttgattaaaggaggaggaggatgtttaacccaggagaagattgtggctggatgcgccaaacacttcattgtcattgcagattataggaaagactctaaggctctggggcagcagtggaagaagggtgtgccagtggaggtcatccccatggcgtatgtgcctgtgtccagagccatcgcccgctgctttggaggagaagccgtgctgaggatggcagtcagtaaagctggtcctgtggttactgataacagtaactttatcctggattggaagtttgagcatgctcagaactggaaagaggtcaacacggccattaagatgatcccaggagtggttgagacaggtttgtttgtgggcatggctgaacgggtgtacttcgggatggaggacggaagtgtgaagactcgagatcctcctgtcaactaa

SEQ ID NO: 2697 - DNA, 651 bp, Danio rerio
aataatcaggtaattggtgtgggcagcggctcaactattgtctatgcggtggacaggctggctgagaaggtcagacaggaaaagctgaatattgtgtgtgttcccacatcattccaggcccgtcagctgattctgcagcatggtctccctctgtctgatttagaccgacatcctgagctggatgtagcgattgatggggctgatgaggttgatacggctctgaccttgattaaaggaggaggaggatgtttaacccaggagaagattgtggctggatgcgccaaacacttcattgtcattgcagattataggaaagactctaaggctctggggcagcagtggaagaagggtgtgccagtggaggtcatccccatggcgtatgtgcctgtgtccagagccatcgcccgccgctttggaggagaagccgtgctgaggatggcagtcagtaaagctggtcctgtggttactgataacagtaactttatcctggattggaagtttgagcatgctcagaactggaaagaggtcaacacggccattaagatgatcccaggagtggttgagacaggtttgtttgtgggcatggctgaacgggtgtacttcgggatggaggacggaagtgtgaagactcgagatcctcctgtcaactaa

SEQ ID NO: 2698 - DNA, 727 bp, Danio rerio
gcggctctactgctctcgcatggctgaagaggccaagaaactggcggcttatgctgctgtggacaaccacatacagaataatcaggtaattggtgtgggcagcggctcaactattgtctatgcggtggacaggctggctgagaaggtcagacaggaaaagctgaatattgtttgtgttcccacatcattccaggcccgtcagctgattctgcagcatggtctccctctgtctgatttagaccgacatcctgagctggatgtagcgattgatggggctgatgaggttgatacggctctgaccttgattaaaggaggaggaggatgtttaacccaggagaagattgtggctggatgcgccaaacacttcattgtcattgcagattataggaaagactctaaggctctggggcagcagtggaagaagggtgtgccagtggaggtcatccccatggcgtatgtgcctgtgtccagagccatcgcccaccgctttggaggagaagccgtgctgaggatggcagtcagtaaagctggtcctgtggttactgataacagtaactttatcctggattggaagtttgagcatgctcagaactggaaagaggtcaacacggccattaagatgatcccaggagtggttgagacaggtttgtttgtgggcatggctgaacgggtgtacttcgggatggaggacggaagtgtgaagactcgagatcctcctgtcaactaa

SEQ ID NO: 2699 - DNA, 708 bp, Osmerus mordax
atggcagaagaggctaagaaactggccggttacgccgcggtggacaaccatgtgcagaacaaccaggtgttgggagtgggcagtggatccaccatcgtctatgcagtggacagattagcggaaagagttcgtcaggagaaactcaacattgtgtgtgtccccacttctttccaggctcgtcagctcatcctgcagcatggcctccctctctcagacctggaccgccacccagagctggatgtagcgattgacggggcagatgaagtggactctgccctcaccttgattaaaggaggagggggctgtctggcgcaggagaagatagtggcaggatgtgccaaacatttcattgtcatcgctgactacaggaaggactccaggtgtctgggtcagcagtggaagaagggtgtccccattgaggtgctgcctgtagcctatgtccccgtgtccaggaccattgctcagcgcttcggaggggaggccgtcctgaggatggccgtcagcaaggccggcccggtggtgacagacaacagcaacttcatcctggactggaagtttgagcatgcccagaactggaaggaggtcaatacggccatcaagatgatcccaggtgtggtggagacggggctctttgtgggcatggctgagagggtgtacttcgggatggaggatgggagtgtgaagaccagagaccctccagttaactga

SEQ ID NO: 2700 - DNA, 693 bp, Tetraodon nigroviridis
atggccgaggaggcgaagaagctggccgcctacgccgctgtggacaaccacgtccagaacaaccaggctgtcggggtgggcagcggttccaccatcgtctacgccgtggacaggctggcggcgagggttcgtcaggagaagctcaacatcgtgtgtgtgcccacctccttccaggctcgtcagctgattctgcagcacagcctggcgctgtccgacctggaccggcacccgcagctggacgtggccatcgacggcgccgacgaggtggacgcagatctgacgctgatcaaaggtggcggcggctgcctgacgcatgagaagatcgtcgccagctgtgccaaacacttcatcgtcatcgccgactacaggaaggactccaaggttctggggcagcagtggaagaagggcgttcccatcgaggtcatccccatggcctacgtccccgtctgcaggaccatcgtccggcgcttcgggggcgaggcccacctgcgcatggccgtcagtaaagcggggcccgtggtcaccgacaacagcaacttcctcctggactggaagttcgacggcgctcagaactggagggaggtgaacgccgccatcaagatgatcccaggcgtggtggacacgggcctgttcgtggacatggctgaacgagcctacttcgggatggaggacgggagcgtgcaggttcgggac

SEQ ID NO: 2701 - DNA, 708 bp, Xenopus laevis
atgacagaagaggccaagagacttgcgggctgtgctgctgtggataaccatgttaagaacaatcaagcacttggcattggaagtggctccaccatagtacatgctgtgaatcgactagcggaacgggtgaagcaggaaaatctgaaagtcgtgtgtgtccctacgtcttttcaggcccggcagctgatcctgcagaacggattagttctgaccgacttggacagacaccctgagcttgatgtcgccattgatggagcagatgaagtggattcagatcttaaccttataaaaggaggaggtggctgcttggctcaggagaaaatagtggctggctgtgccaagtccttcatcgtcattgccgattacaggaaagattccaaaaattttggggagcaatggaagaaaggtgttcctattgaagtgatccccatggcttatgtaccggtgattaaagccttacagagtcggtttgggggtgtagctgaattaaggatggctgtcagtaaagcaggcccagtggtcacagataatgggaactttcttttagactggaagtttgacaaggtgcatgactggagaactgtaaatacagaaataaagatgataccaggtgtggtagacactggtcttttcattaacatggctgagcgagtttatttcggaatggaggacgggacggttacaatccgcgacaagccaatgaattaa

SEQ ID NO: 2702 - DNA, 708 bp, Gallus gallus
atggctgaggaggccaagaggctggcagcctgcgcggcggtggacaagcacgtccagaacaaccaagttcttggcatcggaagtggttctacgattgtccacgcagtgcatcgattagctgagagggttaaacaagaaaacctgtcaattgtctgcatccctacgtctttccaggcccgtcagctgatcctgcagaatggcttaacactaagtgacctggaccgacatccagagcttgatgttgccattgatggagcggatgaggtggattctgatcttaaccttatcaaaggaggcggtggttgcttgacacaggagaagatagttgcaggatatgcaaaatgcttcattgttattgctgattacaggaaaaaatcagagaacctcggggagcagtggaagaagggaatccctattgaagtcatccccatggcttacgtccctgtcaccagagccctgaccaaaaacttcggaggtgctgcagagctgcggatggctgttagcaaagcaggccccgtggtgacagacaatgggaacttcatcctggactggaagtttgacaaggttcacgagtggagcgaagtgaacactgccataaaaatgataccaggcgtggtggagacggggctgttcatcgacatggcggaggtggtgtactttggcatggaggacggctcggtcagcgtgcgggagaagcagcctcgttga

SEQ ID NO: 2703 - DNA, 714 bp, Macaca mulatta
atgtccaaagccgaggaggccaagaagctggcgggccgcgcggccgtggagaaccacgtgaggaataaccaagtgctgggaattggaagcggttcgacaattgtccacgctgtgcagcgaatagcggaaagggtgaagcaagagaatctgaacctcgtctgtattcccacttccttccaggcccgccagctcatcctgcagtatggcttgaccctcagtgacctggatcgacacccagagatcgaccttgccatcgatggtgctgatgaagtagatgctgatctcaatctcatcaagggcggcggaggctgcctgacccaggagaagattgtggctggctatgctagtcgcttcatcgtgatcgctgatttcaggaaagattcgaagaatctcggggatcagtggcacaagggaatccccatcgaagtcatcccaatggcctatgtcccagtgagccgagctgtgagccagaagtttgggggtgtggttgaacttcgaatggctgtcaacaaggctggtcctgtggtgacagataatgggaattttatcttggactggaagtttgaccgggtacacaaatggagtgaagtgaacacagctatcaaaatgatcccaggtgtggtggacacaggcctattcatcaacatggctgagagagtctactttgggatgcaggatggctcagtgaacatgagggagaagcctttctgttga

SEQ ID NO: 2704 - DNA, 1085 bp, Bos taurus
agttgccgggacgttcgcagttcggcgctggcagcacaagtaccggcgtcagggagactaacatcgtctgtccgggcccgtccgcgatgtcaaaggccgaggaggccaagaagctggctggccgcgcggccgtggagaaccacgtgaggaataaccaagtgctgggaattgggagtggttctacaattgtccacgctgtgcagcgaatagctgaaagagtggaacaagagaatctgaagctcgtctgtattcccacctccttccaggcccgtcaactcatcctgcagtatggcttaactctcagtgacctggaccgacacccagagatcgatcttgccatcgatggtgctgatgaagtcgacgctgacctcaacctcatcaagggtggtggaggctgcctgacccaggagaagattgtggccggcaatgccagtcgcttcatcgtgattgccgatttcaggaaagattcaaagaacctcggggatcagtggcacaagggcatccccattgaggtcatccctatggcctatgtcccagtgagccgaactgtgacccagaagtttgggggcgtgattgaacttcgcatggccgtcaacaaggcaggtcctgtggtaacggataatgggaactttatcctggactggaagtttgaccgggtccacaaatggagtgaagtgaacatagccatcaaaatgatcccaggtgtggtggacacggggctgttcatcaacatggccgagagagtctacttcgggatgcaggacggctcggtgaacatgagggagaagccgttctgaatgggccctgcaggagcagagtgtgttcctcttgcgtccccagcccaccgccaaggtggccatgcctctctgagcctttgccttaatgtatctgtgccaggtggacagcttggcagggtgagggttaaatccagtcttctgaagtattgttattaaatgtctttttaaaaagagagatataaacatatatatatttttactattaaaaatgctcagttgtttttttttaataaagtggaacttgatttcatgttttataagaaacatttaccaaaaaaaaaaaaaaaa

SEQ ID NO: 2705 - DNA, 761 bp, Mus musculus
cccgcggcgacaagggaggctcgagcgcgggcggcccggccccctccacgatgtccaaggccgaggaggctaagaagctggcgagccacacggcggtggagaaccacgtgaagaataaccaagtgctgggaattggaagtggttctacaattgtccacgctgtgcagcgaatagctgaaagagtgaagcaagagaatctggacctcatctgcatccccacatctttccaggccaggcagcttatcttgcagtatggcttaaccctcagtgacctggatcaacacccagagattgaccttgccatcgatggtgctgacgaagtggatgctgagctcaatctcatcaagggtggaggaggctgcctgacccaggagaagatcgtggctggttatgcaagtcgtttcattgtgattgctgatttcaggaaagattcaaagaacctcggggatcggtggcacaaggggattcccattgaagtcatcccaatggcctacgtcccagtgagccgggctgtggcccagaagtttgggggtgaggtggaacttcgaatggctgtcaacaaggcagggccagtggtgacggataacgggaattttatcctggactggaagtttgaccgggtgcataaatggagtgaagtgaacacagctatcaaaatgactccaggcgtggtggacacaggccttttcatcaacatggcagagagagtctactttgggatgcaggatggctcagtgaacgtgcgggagaagcccttctag

SEQ ID NO: 2706 - DNA, 711 bp, Mus musculus
atgtccaaggccgaggaggctaagaagctggcgagccacacggcggtggagaaccacgtgaagaataaccaagtgctgggaattggaagtggttctacaattgtccacgctgtgcagcgaatagctgaaagagtgaagcaagagaatctggacctcatctgcatccccacatctttccaggccaggcagcttatcttgcagtatggcttaaccctcagtgacctggatcaacacccagagattgaccttgccatcgatggtgctgacgaagtggatgctgagctcaatctcatcaagggtggaggaggctgcctgacccaggagaagatcgtggctggttatgcaagtcgtttcattgtgattgctgatttcaggaaagattcaaagaacctcggggatcggtggcacaaggggattcccattgaagtcatcccaatggcctacgtcccagtgagccgggctgtggcccagaagtttgggggtgaggtggaacttcgaatggctgtcaacaaggcagggccagtggtgacggataacgggaattttatcctggactggaagtttgaccgggtgcataaatggagtgaagtgaacacagctatcaaaatgactccaggcgtggtggacacaggccttttcatcaacatggcagagagagtctactttgggatgcaggatggctcagtgaacgtgcgggagaagcccttctag

SEQ ID NO: 2707 - DNA, 711 bp, Mus musculus
atgtccaaggccgaggaggctaagaagctggcgagccacacggcggtggataaccacgtgaagaataaccaagtgctgggaattggaagtggttctacaattgtccacgctgtgcagcgaatagctgaaagagtgaagcaagagaatctggacctcatctgcatccccacatctttccaggccaggcagcttatcttgcagtatggcttaaccctcagtgacctggatcaacacccagagattgaccttgccatcgatggtgctgacgaagtggatgctgagctcaatctcatcaagggtggaggaggctgcctgacccaggagaagatcgtggctggttatgcaagtcgtttcattgtgattgctgatttcaggaaagattcaaagaacctcggggatcggtggcacaaggggattcccattgaagtcatcccaatggcctacgtcccagtgagccgggctgtggcccagaagtttgggggtgaggtggaacttcgaatggctgtcaacaaggcagggccagtggtgacggataacgggaattttatcctggactggaagtttgaccgggtgcataaatggagtgaagtgaacacagctatcaaaatgactccaggcgtggtggacacaggccttttcatcaacatggcagagagagtctactttgggatgcaggatggctcagtgaacgtgcgggagaagcccttctag

SEQ ID NO: 2708 - DNA, 747 bp, Branchiostoma floridae
atggatttgataacacaggctaaacagtcggcggcgtaccaggccatagacaaccacgtaaagaacggccaagctttggggatagggtcgggttctacaatcgtgtttgctatcaacagactagcggaaagggtacaagaggaaaacctgaatgttgtctgtgtgccaacatcattccagtccaagcagctgctgacagagaaaggcctggcagtgtctgacctggagcgcacaccatcgcttgatgtggccatagatggagctgatgaagtagacaaagatctcaacctcatcaaggggggaggtgctgcctgtacacaggagaagattgttgcttcctgtgccaagtactttgtggtgattgcagatcacaggaaagactccaagttacttggtgagcagtggaagaagggagttcccattgaggttatccccatgggttatgttcctgtcatcagggccatcgagaagaaactgggagggaaggctgaactcaggatgggagcaaacaaggctggtcctgttgttactgacaatggcaacttcatcctggactggaagtttgacgagacaaaagactggaagaaagtgaacatggaaatcagcatgatccctggtgtggtggagaccggtttgtttatcgacatggcacagcgggcgtacttcggcatgccggatggcagcgtcacctttagggaaaaactttccagaaacggaacacctgaatgtgacgagagcgaaaaatag

SEQ ID NO: 2709 - DNA, 711 bp, Caligus rogercresseyi
atgtcaaatctcatcgaggactctaagaagctcgctgccatcagctcagtggacaatcatgttcagaatggacacgtcgtaggcatcggaagtggctccacaattgtatatgctgttcagcgactcgctgaaagagttgaggctgaaaaaatgagcgtgtcttgtatcccgacttcatttcaggctcgccaactcattatggagcatggactacccatgacttcctttgaggctgttgaatcatgcgatgtgacgatcgatggatgtgatgaggcagatgctagcttgactctcattaaaggtggaggtggatgtctagctcaagaaaaggtcgtggcccagttctcaaagacctttgtggtcattgcagactatcggaaaaagtctcaaaagctgggtacatcatggaaatacgttcctattgaagtccttcccttagcttataagccggtcaccaaatggatttccgatcatcatggaggcgaagccattcttcgcatggcaaaggccaaggctggcccgctggtaacagacaatggaaatctaattctggattggtactttgatttaaataaaacctacgactggaaaaaagttaatggagagctttgttctttggcgggaattgtggacacaggattatttatcgacatgacgaaaacagcttactttggacaaaaggatggtactgtggaaactgttctgatataa

SEQ ID NO: 2710 - DNA, 696 bp, Nematostella vectensis
atggaagcaggaaagaaagccgctgcagtttatgctgttaataagtttgtgaagaatggacatgtcctcggtataggtagtggctctacagtcgtctatgccgtggagaggcttgccaaaagagtgatgaaagaaaagttagaagttgtttgtgttcctacctcattccaggcccagcaactgattactgaaaacaaactggtgctgagtgatttagaaagaaatcctgagcttgatgttgccattgatggtgctgatgaagttgatgctaatctgacccttattaaaggtggaggtggctgcctcacacaggagaaaatagtcgcttcatgtgcaaagaccttagtgattattgccgatgacaggaaggactcaaagcaattaggtgaaaaatggagtaagggagtcccagttgaagttgtgccatttgcgtaccgaccggtgatgctgaaaatggaaaagatgggcttgtctcctgttctcagaatggctaaagcaaaggctggccctgttgtgacggataatggcaattttattattgatgttggatttagtaagcctcaagactggaacaagctgaatactgatcttaacttgattccaggtgtactggaaacaggcctttttgtgaacatgacgaatcacgtggtatttggaaaggaagacggatctatagccactcgggatgcgcggtaa

SEQ ID NO: 2711 - DNA, 699 bp, Hydra magnipapillata
atggaggctgcaaaaaaagcagctgcttatgaagctgtaaataaatatgtcactaaagaaacaaaatatttaggagttggtagtggatcaactattgtgtatgccgtagaaagattagctcaacgagtaaaagaagaagaccttaatataaaatgcattccaacatctttccaatcaagacagcttattttagacaatggtttagttctaagcgatatccagcagcatcctgagttggacattgttatagatggtgccgatgaagttgatgtcaatttaaattgtattaaaggtggtggaggatgtttaactcaggagaaaatagttgcttcgtgtgctaaaaattttgttattatagcagatagtactaaacgttctcagcatttaggagatagttggaaaaatggcgtagctgttgaagtaattccaatggcttattctttagttattatgaaattaaaacagcttggtttttatccgtctctcagaatggctaaagcaaaaaccggacctttagttacagataacggcaactttataatagactttaagtttgacaagttaaccgattgcaaaatcgttaatgatagccttatttctataccaggaattgtggagacagggttatttatagaaatggctaactcagtaatttttggcttttctgatggaaccactgaagaaatatttcgacaataa

SEQ ID NO: 2712 - DNA, 723 bp, Phytophthora infestans
atgtcgagccccatcgagcagtctaagcgcaccgctgcgcgccaggccgtggacgagtacgtcaagagcggatacgtcgtgggtgtcggcagcggctccacggtcgtgtacgccgctgagcgtctcggagagctcgtcaaggagaagaaactcacggacatcaagtgcatcccgacgtcgttccaggccaagcagctcattgtccagcacaagctcacgctctcgagtctggacgagaaccccgtgatcgacgtcaccattgatggagctgacgaagtggatctccaactcaactgcattaagggcggaggtggctgtcagctgcaggagaagatcgtggcgtttgcagccaacaagttcgtggtgatcgctgactaccgcaaggaatccaagcagcttggcgagcagtggacgcagggcgtgcccgtcgaggtcgttccgatggcctacgtgccgcttatgaacaagatggagcaggacttcggcggtaagtccgtgctgcgtatggccaaaagcaaggctggacctgtggtcacggacaacggcaacttcgtgctggatgtcaacttcggcgtcatcaacgaccctaagacgctgtgcgatcgtctcaaactgctgcctggtgtcgtggaggtcggactcttctgtggcatggctgagaaggccttcttcggacagacggacggctcgttcaccacacgggtagcggacaagtctgcctaa

SEQ ID NO: 2713 - DNA, 756 bp, Caenorhabditis briggsae
atggtcaccagcaccgctcccgaagcagaactggcaccaatcgagcaagcgaaaaaacgggctgcttttgcctgtggagaaaaatacgttcaaagtggatgtcgtctcggtgtcgggtccggaagtactgtgaagtatctcgtcgagtatctgaaacaaggatatcaaaatggacaactgaaggatatcatttgtgtcccgaccagcttcttgacgaaacaatggttgatcgaatcaggacttccagtttctgacctagatgctcatccagaattggatgtttgtatcgatggagccgacgaagttgacgggcagtttacgtgcatcaaaggaggaggtggctgcctagctcaggaaaagatcgtgcaaactgctgccaaacatttctacgttattgccgactatttgaaagactctaagcacttgggtgaccggtatcctgctgtaccgattgaggttctccctccagcatctcaacctcttcttcgttcgattccacgtgccgagggaggcagttgtcaactccgtcaggctacaaaaaaatgtggaccagtcgtgactgataacggaaactttattattgactggcagttcgaaaagaatgtgtctggtcgagattggctggcgattcagcaaagactcgcaaacactccaggaatcgttgagactggattgttcatcggatgcgtcgacgcagtctttttcgcttattccgatggatccgttaaggaaatcgtgaatacgaagaaacactga

SEQ ID NO: 2714 - DNA, 783 bp, Brugia malayi
atgaaaacgcattcaactctggatttggccaaacgagcagcagcgtttgcagctggtgaacagcatgtaaaaagtggttgtcgaattggtgttggcagtggtaccacggctaaatttttagttgaatttttggctgaaaaagttaatgatggtacggtgaaggatattatctgcgtaccttcttcattctcaactcgccagtggttaatcgattatggtttacaagttattgatttggagaagattctcgatttagatttatgtattgatggagctgacgaagtagacatcaacctgaattgtataaaaggtagtggtggtggttgcttaactcaagaaaaaatcgtgcagacatgtgccaaaaagttttatatcattgctgatgccagtaagcaatcagaaaaactgggcgataggaattttcccattccaatcgaagttgttccatttggatatgcgccagttttaaattggataaaacgtcaggaaggtggtgaggttgagttgaggacgaacagtaaagaaaagttggatccatttattacagacaacaacaattttattttggattggaattttccgaaaaataaatatgtgacaacggaagatttatcagctttgcatacacgtctgaaatcattaccgggtgttgtcgaaacgggtctttttataggtgttgctgagaaggcttattttgctactgcagatgggaatgttacggaaaggctaagaccagatccttctcttcatttctccctaaatcaaaaatcttcgcttcattaa

SEQ ID NO: 2715 - DNA, 699 bp, Dictyostelium discoideum
atgtcattagataattgtaaaaaagtagcagcatataaagcagttgatgattttgttaaagatggttgtaaaattggtattggtagtggtagtacaataaagtatgcagttgatagaattaaagaattaggattaaagaatgtaatttgtgtaccaacatcatttcaatctactcaattaattgttgaagcaggattagagttatcagatttatcacgtacaccagaattggatattacaatcgatggtgcagatgaagtggataaggattttaatttaattaaaggtggtggtggttgtcaattacaagagaagatcgttgcatactcttcaaagaaattagttattgttgcagatcatacaaaggaatcaacagagttgggtgaaaattggaaaaaaggtatcccaattgaagtggtaccaatggcttacgtacctgtaatgaagaaattagaaagttcatcattttcattgactccaaaattacgtatggccgtaaataaagctggtccagttgtaactgataatggtaatttcataatcgatgctcaattctcaaaaccactatcaaatattccacaattagcaattgatattaaaatgattccaggtgttgttgaaacaggtttatttgtaaatatgactaaaattgcttatttcggtcaaactgatggtacttgtaaagttaaatcaatttaa

SEQ ID NO: 2716 - DNA, 725 bp, Polysphondylium pallidum
taaagtgttatacagttagtagtgtaaaaatggataaagaaattttagagaaagcaaagaaattggctggttacaaagctgtcgatgataatttaaagagtggattgcgtgttggtattggaagtggctccactattaaatatgttgtagatcgtatcaaagagttgggtttggatgtcatttgtgtgccaacttcattccaatcgacacaactcattgtcaacgccggcttgacactctctgacttgtcgcgtacacccgagctcgatatcaccatcgacggtgccgacgaagtcgattcacagttgaattgtatcaagggtggcggtgcttgccagctgcaagagaagatcgtcgccgctgcctcgaagcgtttggtaatcgttgccgacttcaccaaggacagccaggcgttcggtcagcagtggaagcgtggtatcccaatcgaggtggtgccaatggcatacgtgcccgttatgaacaaactcagttcgatgtcactcaagccagtcttgagaatggcagtcaacaaggccggtccagtggtgagtgacaacgccaactttatcatcgacgcacaattcgagtcgatctctaacgtcgccgaactggcaaccaaaatcaaaatgattccgggtgtagtagagaccggacttttcgtaaacatggcttcacgtgcttatttcggacaacaagatggtaccgttaaagagagaaccatttag

SEQ ID NO: 2717 - DNA, 756 bp, Malassezia globosa CBS 7966
atggcttcttcgtcacagtctgtatctactgttgaatctgcaaaacgagctgcagcgtacgcggctgtggatgcgtacgtcaagccacaccatcaactcattggaattggatctggctcgacggtaccgtatgtagtagaacggatctatgagcgaggcgaaaaagtgaacaattcttgcaggtttgtgccgacaagcttccaggccaagaacctcatcatagagcgaaatctcaacttgggcgacatggacacgggcctacaattggatgtgactatcgatggtgctgacgaagtagatgcatctctcaatctcatcaaaggcggaggtgcatgtcacttgcgtgagaaagtccttgctgaagcggcaaaagagtttgtcgtcgttgcagactttcggaaaatgtcgatggtgctcggggagaattggagaaaaggagtgcctgtggaagtcgctccgttcgctgcgaaacatgtgctcaagtcgctggaaaggctcggtagcacagacgctaaactccgtatggctgtggctaaggctggacctgtcgtcacggacaatgggaatttgtgtattgatgccgtctttcccgagtccatcatgcgcaatcctgatcacttgctgaagcagattaaactcttgaccggtgtggttgaagtggggatttttaccaacatttgtaaggcagcgtacttcggtaatgaagacggttcaatcacgcgccagcttcctgatggttctagagttcgtatgtag

SEQ ID NO: 2718 - DNA, 861 bp, Ustilago maydis
atggcttcttccaacgctaccaacagtaccagtgccgccagtgctgccaacaccaactcgtctgctttcaagagtgccgaattggctgctttgagcggcgtcgaggctgctaagcgtgctgctgcgtacgctgccgttgacaaccacgtcaagccgcagcacgagatcattggtattggctcgggctcaacggtgccttatgttgttgagcgaattgctcaacagggacctgctgtgaatgcaaagcgttggttcgttcccaccggcttccagtcacgcgaactcatcatcaacgccggccttcgtctcggtgatgtggatagcttccccagcatcgacgtcactatcgatggcgctgacgaggtcgacaatgcgctcaactgcatcaagggcggcggtgcttgtcatttgcgcgaaaaggtactcgccgaagccgccaatgaatttgtcgtagtcgctgactaccgcaagaatggatcgcagctcggcacaaagtggctgcaaggtgtccccatcgaggtcgctccgtttgcctatgcaaaagtgcttcagaacctcaaaaagatgggttctgacaaggcggtccttcgcatgggcaaggcaaaagccggtcccgtcgttacagataatggcaacttttgcatcgatgctcccttccccgaagcacagatgaaggatccctctgatttgctcaagcgtatcaagttgctcaccggtgtacttgaggtcggtctgttttgcaacatttgcaagtccgcctactttggcaacgatgacggcaccatcaccatcaaaaccgccgccggagatgtgcaagagggcgtccactttgacgtctccaaggcgcctgcaacagcataa

SEQ ID NO: 2719 - DNA, 888 bp, Coprinopsis cinerea okayama7#130
atgtcaccttcgaccacgtactcgaaatcctctgctaccactgctggacgcggttacctgaacggctcccccttgaaatcgaaatctttggcttccggcgttgatggcaaagcagcaggaggaatggagaccctttcgttgattgaagcttcgaaacgcctggcggcgtatactgctgttgaccagcatgtaaaacctgagcacaggatcattggtattggctcgggctcgactgttccgtatgtggtggataggattgtgcaacagggtgttgagcttaatgccggacgggtgttcattcctactggcttccaatcgagacaactcattgttgcagcagggttgacccttggcgatgtggaccaatacccaacaatcgatatcaccattgacggagctgatgaagtcgatcataatttgaactgtgtgaagggaggaggagcatgtcatttgagagagaaagtgttggctgaggctgctcatacgttcatcttggtggcggattacaggaagaacgtgcaatttttgggaacgaactatctctcgggtgtaccgatagaagtcgtcccgttcgcgtataacaaggtgttgcacaacctgcatcattcgcttggaagcccaaaggctgctctgcggatggccataaagaaagccggtcctgtcgtctcggacaacggcaacttcatcatcgacgcgcccttcacgcaggagcaactggcggatccgtacaccgttttggcacagattaagatgttgacgggtgtggtggaggtggggctgttctgcaagatggccaaggctgcgtactttgggaatgaggatgggagtgtgacggttaggtgggacgatgggagggtggaggttgttcctagtgctacgagtgcgtag

SEQ ID NO: 2720 - DNA, 750 bp, Laccaria bicolor
atggacatcatcgagtcctcgaagaggctggctgcgtacacggcggtggacaaccacgtcaaacccgaacacaaggtcatcgggatcggttctggctcaacagtgccgtatgtggtggagcggattgttcagcaaggtgtagaggcgaataagggtcgtgtgtttattccgactggtttccagtcaaaggagttgatagtctcatcaggcttaggtcttggagatgtcgatcaataccctacgatagacgtgacgctggatggtgctgatgaagtggattcacaactgaactgcgtcaaaggagggggcgcttgccatttacgcgaaaaagtgttagctgaggctgccagaaccttcattctcgttgcagattaccgaaaaaacgtgcaatacctgggaacgaatttccttcaaggggtaccaattgaagtggtaccatttgcttatgcgaaagtcctccaaaatctgcatcaggtgctgggatcaccgaaggctacgttgaggatggcagtgaagaaggctggtcctgtcgtttcagacaacggaaatttcatcatcgacgcaccattcgatcgtgaaaagatgattgaccctttcactatcatggcgcaaatcaagatgttaacgggcgtagtggaggttggtttgttctgccgtatggccaaggcggcatactttgggaatgaggacggcactgtaacagtcagatgggacgatggaaaaatagaccaagtagcagcgccggtttag

SEQ ID NO: 2721 - DNA, 723 bp, Candida albicans
atgtcttctacaagtaaagttgaatccgccaaaaaattagctgcttataaagcagttgatgaaaattttcctaaagatgctaaagtcattggtattggatctggatccactgttatttatgctgccgaaagaattggtcaattggacaataaggattcatttatttgtatccccacggggtttcaatcaaaacaattaatcattgataatggattaagattaggtactattgaacaatacccagatattgatattgcctttgatggagctgatgaagttgatccacaattaaatttgattaaaggtggtggtgcttgtttatttcaagaaaaattagtagcggcatctgctaaaaaatttgttgttgttgctgattatagaaagaaatctgataaattgggacaactgtggagacaaggtgtacctattgaaattgttcctaattcatatagtaaaatcattcaggaattatctaaaaaattaggagctaaaaatgtggatttaagacaaggtggtaaagctaaagctggtcctataattactgataataataatttcttattggatgctgattttggtgaaatagaaattgacaatgttggtaaattacatgaacaaattaaattattagttggtgtcgttgaaaccggattatttactaatatggctaataaagcatattttggtgaagaagatggatctgttagtgtatggagtaaatag

SEQ ID NO: 2722 - DNA, 792 bp, Candida albicans
atgttcataagaagtttatatcatcgaattagcaacactaaaacaattacaaatctcattatacgaaacatgtcttctacaagtaaagttgaatccgccaaaaaattagctgcttataaagcagttgatgaaaattttcctaaagatgctaaagtcattggtattggatctggatccactgttatttatgctgccgaaagaattggtcaattggacaataaggattcatttatttgtatccccacggggtttcaatcaaaacaattaatcattgataatggattaagattaggtactattgaacaatacccagatattgatattgcctttgatggagctgatgaagttgatccacaattaaatttgattaaaggtggtggtgcttgtttatttcaagaaaaattagtagcggcatctgctaaaaaatttgttgttgttgctgattatagaaagaaatctgataaattgggacaactgtggagacaaggtgtacctattgaaattgttcctaattcatatagtaaaatcattcaggaattatctaaaaaattaggagctaaaaatgtggatttaagacaaggtggtaaagctaaagctggtcctataattactgataataataatttcttattggatgctgattttggtgaaatagaaattgacaatgttggtaaattacatgaacaaattaaattattagttggtgtcgttgaaaccggattatttactaatatggctaataaagcatattttggtgaagaagatggatctgttagtgtatggagtaaatag

SEQ ID NO: 2723 - DNA, 792 bp, Candida dubliniensis
atgttcaaaagaaatttatatcatcaaatcaccaataaaataacatttacacaattaattatacgaaacatgtcttctaccagtaaagttgaatcggccaaaaaattagctgcttataaagctgttgatgaaaatttccctaaagatgctaaagtcattggtattggatctggatctactgttatttatgcagcagaaagaattggacaattatccaataaggattcatttatatgtatccccacggggtttcaatcaaaacaattaattattgataatggattaaaattaggaaccattgaacaataccccgatattgatattgcctttgatggagctgatgaggttgatccacacttaaatttaattaaaggtggtggtgcttgtttatttcaagaaaaattagtggcgacatccgctaaaaaatttattgttgttgctgattatagaaagaaatctgataaattgggacaattgtggagacaaggtgtacctattgaaattgttcctaattcatatagtaaaatcattcaagaattgtctaagaaattggcagctaaaaatgtcgatttaagacaaggtggtaaagctaaagctggtcctataattactgataataataattttttgttggatgcagactttggtgaaatagaaatcgaaaaggttgagaaattacatgaacagattaaactattagtaggtgtagttgaaactggattatttactaatatggctgataaagcatatttcggtgaagaagatggatctgttagtgtatggagtaaatag

SEQ ID NO: 2724 - DNA, 759 bp, Candida tropicalis
atgataaaatcctttgttagacaattatcaagaacatcaccacgtttaaccatgtcatcatccgttgaatcagccaaaaaattagctgcttatagagcagttgatgaaaacttcccaccaaaagctaaagtcattggtattggatcaggatctactgtcatttatgttgccgaaagaatcggacaattagaaaataaagattcttttatttgtatcccaactggattccaatctaaacaattgatcattgacaatggattgaatttaggagctattgaacaatatcctgagttggatattgcttttgatggtgctgatgaagttgacccacaattgaatttaatcaaaggaggtggtgcttgtttattccaagagaaattagttgcttctgctgctaaaaagtttattgttgttgctgattatagaaaagaaagtaagaaattgggtgaaagttggagacaaggtgtaccgattgaaattgttccaaactcatatgctaaagttaccaaacaattatacgacatgggtgccaaaaaagtagatttaagacaaggtggtaaggctaaagctggaccagtaattaccgataacaacaactttttattggatgcggatttcggggaaattgaagaccccgaagaattacacaaacaaatcaaattacttgtcggtgtggtggaaactggtttattcaccgatatggctgataagtcctattttggtgaagaagatggtagtgttgttgtctggggtcaataa

SEQ ID NO: 2725 - DNA, 855 bp, Lodderomyces elongisporus
atgctcttccacaggatactaccgcaatataaaactgcgatttccacatacttgaccccaacacactgcagactctatattgccaacttagtcacatcaagaagaatgaccaatattgaagctgctaagaagttggctgcatacagagccgttgatgagaacctcccaccacacgcaaaagtcattggaattggatcaggttcgactgtggtctacgttgcggaacgtattggtcagttgccaaacaaagacgactttgtttgcatttccaccggtttccaatccaaacaactcattattgataatggattgaagttgggacaaattgagcaacatccatcgattgatattgctttcgatggtgctgatgaagttgatccacagttaaatttgattaaaggcggaggtgcctgtttattccaggaaaagctcgttgcgtctgcatcggataaattgatcattgttgctgattttagaaagcaatccaaacatttgggacagaactggcgtcaaggtgtgccaattgaggttgttcctatcgcatttacaaaattgataaacgacttgaagagattgggtgccaagagtgtcgatttgagacaaggtggaaaggctaaagcaggacccgtgattactgataataataatttcatattggatgctgattttggaattattgaggatccaaagagcttgcatttgcaattgaagcaattggttggtgtggtggatactgggttgtttaccggaatcactgaaaaagtttactttggagaagagtcgggtgaggtgacgacttgggatggagtagtcactggttcgactactgaagaggttattgctgagtccaaataa

SEQ ID NO: 2726 - DNA, 756 bp, Clavispora lusitaniae
atgcggtccttctttctttcttccatacgccagacccgtctgttttccatgacctcgctcgtagaaaaagccaaaagagccgctgcccacagagcagtcgacgagaacttgtctgcacacgccaaagtcgttggtgtcggctctggatccaccgtggtgtatgtcgccgaaagactcggccagttgccgcaaaaggcgctgtttgtgtgtattcccaccggtttccagtcgaaacagttgattatcgacaacgggctcaccttgggcaccatcgaacagtttccccagattgacattgcctttgatggagccgacgaggtggatgggaagttggggttgatcaagggaggcggcgcctgcttgttccaggagaagttggtggccacggctgcagaaaagtttgttgtcgttgccgactaccgcaaggagtcgcgtgtgttgggctcgcagtggacgaaaggtgttccgatcgagattgtgcccaactcgtatgctaaggtcacgcttgacttgaaggcgctaggcgcccggacggtggtgttgcggcaaggcggctcggccaaggccgggcctgttgtgaccgacaacaacaactttttgcttgatgccgatttcggcgacatttcggacccagaggcgttgcatgcccaaatcaagatgttggtgggtgtggtggagactgggcttttcaccggcatggccacgaaggcctactttggccaggaaaacggcgaggtgtcggtgtgggaagcatga

SEQ ID NO: 2727 - DNA, 744 bp, Pichia guilliermondii
atgctccccacatttgtccgcttctcccgcatcatgagttccggaattgagcatgctaaacgtatggctgcgtataaagcagtggacgccaactttcctccccatgccaaggttgtaggaattggctcgggatccactgtggtttatgttgctgagcgaattggccagttgaaaaataagcatgattttgtatgtatttccactggatttcaatcaaaacaactcattatagataatgggttgactttgggggccattgagcagtttcccaaggtggacattgcctttgatggcgccgacgaagtggacacaaacctcaatctcattaagggaggtggcgcctgtttatttcaagaaaagttagttgcaagttcggctgacaaattcattgtggttgcagacaccagaaaaaagtcacccagcgatttggggattgcgtggcgtaagggggtaccaattgaagtggtgcccaattcgtatgctgtggtgaccagacaactcaaggaattgggtgcaaaatccgtggtgctccgccaaggaggaggagccaaagcgggaccggtggttactgacaacaataattttcttatagatgctgattttggctcgatttctgaccctggaagcctccaccagcaaatcaagcttttggtgggggttgtggaaacggggttatttgtggatatggctcatacggcgtactttggggatgagagcggcgaggtgagcgagcagctgaggtaa

SEQ ID NO: 2728 - DNA, 744 bp, Pichia guilliermondii; identical to SEQ ID NO: 2727

SEQ ID NO: 2729 - DNA, 714 bp, Pichia stipitis
atgtcgtctctctcccttgtggaacaagcaaagaaatccgctgcctaccaagctgtggatgagaattttcccgtctctgccaaggtcgtgggtattggatctggctcgactgtcgtttacgtagctgaacgtattggtcaactagccaacaaggactcgttcgtttgcattcctactggattccaatctaaacagttgattatcgacaatggcttgaagttgggtgctattgagcagtttccagaaattgacattgctttcgatggtgctgatgaagtggaccctgccttgaacttgattaaaggtgggggtgcctgtttgttccaggaaaagttggtagcagccagtgcaaagacatttgtagttgtggcagactaccgtaagaagtctgacaacttgggtatccagtggaaacagggtgttcctatagaaatcgtgcctaactcgtatgctaaagtcatccaagacttgaaaaaattgggtgcaatcactgtgaatctcagacaaggaggttcggctaaggctggtccaattatcaccgacaacaacaacttcttgctcgatgccgattttggcgccatcaaggacccaaaggctttgcacgaccagatcaaggcccttgtaggtgtagttgaaactggcttgttcacatcgatggctgcgaagtcatactttggcgaacaggatggtcaggtcaatatctggtctatctag

SEQ ID NO: 2730 - DNA, 759 bp, Debaryomyces hansenii
atgctaaaaaggatcataagcgccagatacattcgaaacatgtctagtggagcatcattggtagaaaaagctaagaaaagtgccgcataccaggcggtggatgagaatttcccggaaggagccaaggtggttggtgtgggctcagggtcgacggtgatttatgttgctgaaagaataagtcaattgaagaacaaggagtcgtttgtgtgcgttcctacggggttccaatcgaagcaattgatcattgacgccggattgagattgggaacgattgaacagtaccctgaggtggacattgcgttcgatggtgcggatgaggtggacacggagttgaatttgatcaaggggggaggtgcatgtcttttccaggagaagttggtggctgctgctgctagtaagtttgtgattgtggccgatttccgtaagagatcaccctcgaagttgggtatacagtggagaaagggagtacctattgagattgtgccatgtgcgtatgcgaaggtgtccaaggacttggaagccatgggtgcgaagaaagttgaattgagacaggggggttcagccaaggcagggccagtagtgaccgataacaataactttttgattgatgctgatttcggcgagatagaagatcctgccaaattgcacaccgacatcaaacaattggtcggggtggtggaaaccgggttgtttgtgcaaatggcctacaaaacgtactttggagaggaatctggggaagtcaagtgctggtcaaagtaa

SEQ ID NO: 2731 - DNA, 720 bp, Debaryomyces hansenii
atgtctagtggagcatcattggtagaaaaagctaagaaaagtgccgcataccaggcggtggatgagaatttcccggaaggagccaaggtggttggtgtgggctcagggtcgacggtgatttatgttgctgaaagaataagtcaattgaagaacaaggagtcgtttgtgtgcgttcctacggggttccaatcgaagcaattgatcattgacgccggattgagattgggaacgattgaacagtaccctgaggtggacattgcgttcgatggtgcggatgaggtggacacggagttgaatttgatcaaggggggaggtgcatgtcttttccaggagaagttggtggctgctgctgctagtaagtttgtgattgtggccgatttccgtaagagatcaccctcgaagttgggtatacagtggagaaagggagtacctattgagattgtgccatgtgcgtatgcgaaggtgtccaaggacttggaagccatgggtgcgaagaaagttgaattgagacaggggggttcagccaaggcagggccagtagtgaccgataacaataactttttgattgatgctgatttcggcgagatagaagatcctgccaaattgcacaccgacatcaaacaattggtcggggtggtggaaaccgggttgtttgtgcaaatggcctacaaaacgtactttggagaggaatctggggaagtcaagtgctggtcaaagtaa

SEQ ID NO: 2732 - DNA, 759 bp, Pichia pastoris
atgtaccgaagatttctttccaaggctacaacccgtacaatgtcatcccttgtagaacagtcaaaaaaacttgcggcttacaaagccgtagatgaaaaccttaaagactcacattcagtggttggtgttggatctggctctaccgtggtctacgtggctgaacgtctagggcaattggagcacaaatcgtcatttgtctgtattcccacaggattccagtccaaagagctgatcttaagcaatgggctaagattaggatctgttgaagagtactccagtatagatattgcatttgacggggctgatgaaatcgactcccaactgaatttgatcaaggggggtggggcttgcttaatgcaagaaaaactggtagcttcctgttcgaaacaactattcatcgtcgcagactatagaaagagatctcctgaaaagctgggccatgcatggcgccagggtgttcccattgaagtcgttccggctgcttataacaaggtattgaacgacttgaaaaatttggagggctacaagtctgcaaaagttaggtacgggggaaccttcaaagctggtccagtggtaactgacaacagtatgtttatcatcgatgctgattttggtgaaattcctgttgagaaagtttcaaccttgcattcccagattaagggcttagtaggagtgttggaaacgggcctatttgcgaatatgaccactgctgcttacatcggcaatgaagatggttcagttgccaccttaactttgtaa

SEQ ID NO: 2733 - DNA, 777 bp, Saccharomyces cerevisiae
atggctgccggtgtcccaaaaattgatgcgttagaatctttgggtaatcctttggaggatgccaagagagctgcagcatacagagcagttgatgaaaatttaaaatttgatgatcacaaaataattggaattggtagtggtagcacagtggtttatgttgccgaaagaattggacaatatttgcatgaccctaaattttatgaagtagcgtctaaattcatttgcattccaacaggattccaatcaagaaacttgattttggataacaagttgcaattaggctccattgaacagtatcctcgcattgatatagcgtttgacggtgctgatgaagtggatgagaatttacaattgattaaaggtggtggtgcttgtctatttcaagaaaaattggttagtactagtgctaaaaccttcattgtcgttgctgattcaagaaaaaagtcaccaaaacatttaggtaagaactggaggcaaggtgttcccattgaaattgtaccttcctcatacgtgaaggtcaagaatgatctattagaacaattgcatgctgaaaaagttgacatcagacaaggaggttctgctaaagcaggtcctgttgtaactgacaataataacttcattatcgatgcggatttcggtgaaatttccgatccaagaaaattgcatagagaaatcaaactgttagtgggcgtggtggaaacaggtttattcatcgacaacgcttcaaaagcctacttcggtaattctgacggtagtgttgaagttacggaaaagtga

SEQ ID NO: 2734 - DNA, 783 bp, Candida glabrata
atgtcctacaccccattgccaaatattaacgacttcccaactctaggtaatcctctagaagatgccaagagagcagctgcttatcgtgctgttgatgaaaacttgaactttgacgaacacagaatcatcggtgtaggtagtggtagtactgttgtttacgttgccgagcgaattggtcaatacttgaaggatgagaagtaccatgacaaagtatccaaatttatctgtatccctactggttaccaatcccgtaacttgattcaagataatggtttaattctaggttctatcgagcagcacccccatgtagacattgcctttgacggtgctgacgaagttgaccacaacttgcaattgatcaaaggtggtggtgcatgcttgttccaagaaaaattggtatccactagtgcaaaaatcttcattgttgttgctgattccagaaaaaaatcggatactaacttggggataaattggaagagaggtgtgccaatagaaatcgtgccttcggcctggtcaagagttcaacatgacttgactagcattctccatgcaaactctgctcctgtaaggcaaggtggcagtgctaaagccggtccagttgtcactgataacatgaacttcttgatcgacgctgacttcggtgaaattcaagatccaaaagccctacatgaacaaatcaaaatgttggtgggtgtcgtcgaaactggtctgttcattgataacgctcacagagcttacttcggtaagcctgacggtagcgttgaagtcattgataagaaataa

SEQ ID NO: 2735 - DNA, 780 bp, Vanderwaltozyma polyspora DSM 70294
atgtcaagtgtaccagatatcaaaactttaccaaaattatccaacccactagaagatgctaagagattagctgcttaccgtgcagttgatgaaaatgtagatttccaaaatgaaagggttattggtattggtagtggtagtacagttgtctatgtagctgaaagattaggccaatacctaaaagatccaaaatataccaaatatgtatctcaattcgtttgcatcccaactggtttccaatcaagagctttgattctagataatggtttacaattagatagtatagatcatcaccctattattgatattgcttttgatggtgctgatgaagttgatgtcaacttacaattgattaaaggtgggggtgcttgtttgttccaagaaaaattggtaagtacaagtgcaaaaagatttatagttgtagcagaccatagaaaacaatctccacaatatttaggtaagaattggagacaaggtgtcccaattgaagtagtaccttctgcatatgtacgtgtccaacatgatttgttaaataagctacacgcccaaactgctgttgttagacaaggtggtagtgcaaaggcaggtccagttgtcacagataacaacaatttcattatagatgctgactttggtgaaataaaagatccaaagtcattatatgtaagcattgaaatgctgattggtgtagtagaagtgggtttattcattgataacgccgaaaaggtttatttcggtaatgctgatggttctgttaatgtgttggataagaaaaattaa

SEQ ID NO: 2736 - DNA, 828 bp, Lachancea thermotolerans CBS 6340
atgtttcgaaatttgaaaagtctggttcacacgagcgtgcgccgttttgctgccaagatgacctccatacccgatgtcaagaaccttcccacactccacagcactctcgaggaagccaagagagtggcagcatatagggccgtggatgaaaacctggactacgcgaaccaccgtgttatcggcgttgggagtgggtccacagtgatctacgttgcggagagactgggccagtacctgctcgaccctcagttctcgatttacgcgtcgcagttcatttgcattcccactgggttccagtccaaagagctgattctcaccaacggcttgaggctcggctcggtcgagcagtacccggtgatagacatcgtgttcgatggtgcggacgaagtggacgtcaacctgcagctcatcaagggtggtggcgggtgcttgttccaggaaaagctcgtcagcaccagcgccagcaagtttgtcgtggtcgcagactaccggaagcgctcgcccaaatacctaggtaccaactgggtcaagggtgtgccaatcgaggtagtacccacgagttacatacgagtcctcaacgacctcaagaccaagctaaagtgtaaaaatgcggtcctgagacagggtgcgcctgcaaaggctggccctgtcgttactgacaattgtaacttcatcatagacgcgcacttcggcgagattgagcaccccgagaagctgcatcaagacatcaaaatgctggttggggtggtggaaacgggcctgttcattgacaacgcgtctaaggcgtactttgggaacccggacgggtcggttgaaatgctggtatga

SEQ ID NO: 2737 - DNA, 825 bp, Kluyveromyces lactis
atgtaccgtgtgtttgataaactagcttctaggccgtttgtttcactccccggaatccagctcatcgccaaaatgccattatccgatcttaataaactgcctccattagctgaccagttggaacaagctaagagaattgcagcctaccgtgctgttgacgaaaacttcgacgcaaagacccataaggttgtcggtgttggcagtggtactactgttgtttatgttgctgaaagacttggggaatacatggatgagaaaacaaattttgtttgtattccaacgggcttccaatcgaagcaattgatcctatcaaacaagttacaacttggtgtcattgaacaattcccagaagttgacattgcctttgacggtgccgatgaagttgatgcaggtttgcaattaattaagggtggtggtgcttgcttgttccaagagaagttagttagtactagtgccaaaaaattcatcgttgtggcggattcaaggaagaaatctccaaagtacttgggtaccaactggaaaaaaggtgttccaattgaggttgttccaagctcgtacgttcgtgtcctctctgatttaaagaacaaattgaactgcaaatctgccatggtaagacaaggtgggtcagctaaagccggccctgttgtcaccgataactgcaatttcatcatcgatgctgatttcggagaaattacagacccaagaaagctacatcaagatatcaaactattagttggtgttgtcgaaactggtttgttcattgataatgccgaaaaggcttactttggctatccagatggttctgtagacctacaagagttataa

SEQ ID NO: 2738 - DNA, 768 bp, Ashbya gossypii ATCC 10895
atgtcggtaacgccaattgaagagctgccctccctgggcgacgcgctggaggacgcaaagcgcgcagcgtcgtaccgcgccgtggacgagaatctagaccccgcgaaacaccgcgtggtcgggataggcagcggatcgacagtggtctacgtggcggaacgcataggaaaataccaggcgtcacctgagctgaaggcgaaggtggagtttatctgcattcccacggggttccaatcccgccagttgatcctcgacaacggcctgcgtctgggcagcatcgagcagtacccagaggtggacattgcgttcgacggtgcggacgaggtggaccccgagctgaacctgatcaagggcggcggtgcctgtctgttccaggaaaagctcgtgagcacgagcagcgctcaattcatcgtggtcgcggactcccgtaagcgctcgccgcaacgactgggcacaagctggacgcgtggcgtgcccgtcgaggtggtgcccagcgcgtacgtgcgcgtactgcgcgacctgcacggcattcccggctgccgcagcgcgcagctgcggctcggggaaccgggcaaggcgggcccggtcgtcaccgacaacaacaacctgctcatcgacgccgatttcggcccgctcgaagaccccgccgcgctgcacgcccggatcaaggccctcgtcggcgtcgtcgagaccggcatcttcgccggtaacgctgccaaggcgtacttcggcagcgccgacggctctactcagaccctcgcacgctag

SEQ ID NO: 2739 - DNA, 825 bp, Schizosaccharomyces pombe
atggattcagcagaaaagaagttggatttgtctcccattgaattagctaagcgattggcttgtcatatggcggttgacgaaaattatcctgaaaatcccaaagtcattggtattggaagtggcagtaccgttgtatacgttgtcgagcgtttattgacaaagcctggcgttgatagtgttgttttcattcctactggtttccaatctaaacaattgattgtcaacaacggtttacgcctcggggatcctgattgctatccaaacgtggatgtgtcttttgacggtgctgatgaagtggatgacaatcttcagtgcattaagggtggtggtgcttgccttttccaggagaaattaattgccttcttagcaaagagacttgtaatcgttgccgattctcgtaaaaattcccatgtcctcggtgaatattggaaaaaaggtgttcccattgaagtaatgcccatggcctatgcttctattttaccccaactggtggaactcggtgctattgaacctaagcttcgtatgggtgctcctggaaaggctggtcctgttgttaccgataatggaaatttcatcattgatgctcatttcggtcttattaaaaaccccaaagaactttttgccaaaatcaaattattggttggtgtagtagaagttggcttattttgtgatatgatttcagccgtttattttggtagcaaagatggaagtgttaccgtcaaaaaagctagtggtgaaaaacacattattccggctcctgttactgctgctgctaatgaagtggatgccaaagtagctgaaacaaatgcaaagcctctcaattag

SEQ ID NO: 2740 - DNA, 831 bp, Schizosaccharomyces japonicus
atgtcgagaactttggacttggattctgaggatttatcccctattgaactcgcaaaacgtcaggcttgccatatggctgtcgacgaaaaccttcctaaatcagccaaggtcattggtattggtagtggaagtacggtggtttatgttgtcgagcggttgttgaagaaacccggcatcgagaatgtcgtgttcttgcctaccggtttccagtcaaaggaactcattgtttccaatggtctgcgtctcggtgacccagactgctaccccgacgtcgatgtggctttcgatggtgccgacgaggttgatgccaaccttaactgcatcaagggtggtggtgcttgcctgttccaggaaaagctgattgctgtgttaaccaagcgtttggttatcgtagctgactctagaaaaaactcagagaagcttggtgcttactgggttaagggagttcccattgaggtcgtccccatggcttacacatttgttctccgtgagcttaagcgtctgggttgcaaagaacccaagctgagaatgggtgctccgggaaaggccggtcctttggtcaccgataacggcaacttcataatcgatgccaacttcggattgatcgacaaacccgaggaactgttcaaacaaattaaacttattattggcgtcgttgaggtcggtatcttcagccaaatgatccagtctgcttacttcggtaaccctgacggcagtgtcacggtaaagaagaacgatggtactcagcgtattattcctgcagaggtcactgttgcttcagctgttcaacaaaagatcaccggcgagaaccctaacgttatcaccgtctaa

SEQ ID NO: 2741 - DNA, 732 bp, Yarrowia lipolytica
atgtcctccgaactgcctcctcttgagcaggccaagcgaatcgccgcccaccaggccgtggagcaacactaccccaaggacgccaaggtcgtgggcattggctcaggatccaccgtggtctacgttgccgagaagattgcgtcgttgcccaaggagctcaccaaggacaccgtgttcatttctacgggtttccagagcaagcagctgatccagaacgccgggttgcgactgggatgcatcgaccagtactccaacggagatctggacgtggcgtttgacggcgccgacgagaccgaccctcagctcaactgcatcaagggcggaggagcatgcctcttccaggaaaagattgtcgccgagtgtgcccgcaagtttgtcgtggtggccgactaccgaaaacagtccaaggctctgggcaccgtgtggatccagggtatccccattgaggtggtgcccgacgcctacaacaaggtaattgctgatctcaagaagatgggcgcccagtccgcggtgctgcgacccggctctcccggaaaggcgggccccatcatcaccgacaatggcaacttcattgtcgacgcctactttggcgagatccaacccgacgccgtcaaggacctgcacatcaagatcaagctgctgttgggcgtcgttgagaccggcctcttcactaacgcggacgtagcgtactttggaaacgccgacggaaccatctccaccattaccaagtaa

SEQ ID NO: 2742 - DNA, 819 bp, Neosartorya fischeri
atggctagtgtaatcgaggccgcaaagcgcgccgccggcaaggctgctgtcgccaaccactaccccaaagatgccaaatttgtcggtatcggcagcggatctactattgtatatgttgtcgaggctatcaaagaatctggcattgatacctctatgacaagatacgttcccaccggcttccaatcaaaacagctcatcctttccgccggcttgacagcagttgagtttgattcgctacccgaaggaaccgtacttgatgtcgcctttgacggcgcggacgaggtcgacgatgagctcaacttaataaagggcggcggcgcctgtctcttccaggagaaaattgtggctctgcaagccaaggagttcatctgcgtggcagactcgcgcaaactccagtctcgtctcctcacgaattggaaatacattcccattgaggtggcacctattgccgcccctcgtgtcctaaccaagctgcgagagttgggcagcattcagcccgccatccggctcagcggcacctccaagggacccctgaagacggatcaggacttctacatcattgacgctcctttcccaccattgctcaccaaggctgacgttgccgctggcaacgatgggaacggaaagggaggaatctgggaggttgatgccctggcgcaggcgattaagatgattgcgggcgtactggaggttggcatcttctccggcgtgaccggacctcaggctcaagcgcttggaggtattggtggccagaagcccatcgctgcttactttggcatgcccgacggcacagtatcagttaggaaggccatttcttag

SEQ ID NO: 2743 - DNA, 819 bp, Aspergillus fumigatus
atggccagtgtaatcgaggccgcaaagcgcgccgccggtaaggccgctgtcgccaaccactaccccaaagatgccaaatttgtcggtatcggtagcggatctactattgtatatgttgtcgaggctatcaaagaatctggcattgatacctctatgacaagatacgttcccaccggcttccaatcaaaacagctcatcctttccgccggcttgacagcagtcgattttgattcactacccgaaggaaccgtacttgatgtcgcctttgatggtgcggacgaggttgacgatgagctcaacttaataaagggcggcggcgcctgtctttttcaggagaaaattgtggctctgcaggccaaggagttcatctgcgtggcagactcgcgcaaactccagtctcgtctcctcacgaattggaaatatattcccattgaggtggcacctattgccgcccctcgtgtcctaaccaagctgcgagagttgggcagcattcagcctgccattcggcccagcggcacctccaagggacccctgaagactgatcaggacttctacatcattgacgctcctttccctccattgctcaccaaggctgacgtcgccgctggtaaagatgggagcggaaagggaggaatctgggaggttgatgccctggcgcaggcgattaagatgattgcgggcgtactggaggttggcattttctccggtgtgacgggacctcaggctcaagcgcttggaggtgttggaggccagaagcccatcgctgcttactttggcatgcccgacggcacagtatcggttaggaaggccatttcttag

SEQ ID NO: 2744 - DNA, 819 bp, Aspergillus clavatus
atggctagtctgatcgaagccgcaaagcgtgccgccggccaagctgctgttgccaaccactaccccacgaatcccaaattcgtcggtatcggcagcggttccacaattgtctatgtcgtcgaagcgatcaaggaatcgggcatcgatacctctcagacaaaatacgttcccaccggtttccagtccaagcagctcatcctttccgccgggctgacagccgttgagttcgattcgctacccgaagggaccgtcctcgatgtcgcctttgacggcgctgacgaggttgatgatgaactcaatctaatcaagggcggcggtgcctgtcttttccaggagaagatcgtcgctctccaggctaaggagttcatctgcgttgctgactcgcgcaaactccaatctcgcctcctcacgaactggaagtacattcccatcgaggtcgccccgatcgctgccccccgcgtcctgaccaagctcagagagctgggcagcatccagcctgccatccgcctcagcggcacctccaagggtcctttgaagacggaccaggacttctatctcatcgatgctccgttcccaccgcttctcaccaaggcggacgttgctgcgggcaaggacggcagcggaaaggctggcgtctgggaagccaatgcgctggctcaggcgatcaagatgattgcgggtgtgttggaggtcggtatcttctccggcgtgacagggcctcaggctcaggctttgggaggcattggtggccagaagcccattgctgcttactttggcatgcccgatggctcggtatcggtcaggaaggcccttgcttaa

SEQ ID NO: 2745 - DNA, 822 bp, Aspergillus niger
atggccagcgtcgtcgaagccgcaaagcgcgcagccggtaaggctgccgtcgagaatcactaccccaaggacgccaaatacgtcggcattggcagtggttcgaccattgtctatgtggtcgaggccatcaaggagtccggagtagacacctccgccaccaaatacgtccccactggcttccagtccaagcagctgattgtcaacgctggtctgaccgcagtggacttcgatgccctccccgaaggcacggttctggatgttgccttcgatggtgccgacgaggtcgacgacgagctgaacctgatcaagggtggtggtgcttgtctcttccaggagaagatcgtggctcttcaggccaaggagttcatttgtgtggctgactcccgcaagctccagtcccgcctcctcactggttggaagtacatccccatcgaagtcgctcctattgcggcccgtcgcgttctcggtgctctgaaagagattggcagcattgatcccgctgtccgcgtcaactctgatgccaagcaaggcccattgaagaccgaccaggccttcttcatcatcgacgctcccttcaagactctgctgacccaggcagacgtggctgccggaaaggacggcagtggcaaggacggcgtgtgggaggttcacgccctctctcaggcgatcaagcagattcccggtgttctcgacgtgggtatcttctctggcatgaccggccctcaggcgcaggcgctcggtggtgtcggaggccagaagcctattgctgcctacttcggtatgcctgacggttcggtgtccgtcagaaaggcagctgcttaa

SEQ ID NO: 2746 - DNA, 837 bp, Aspergillus oryzae
atggccgatcttatcgaatccgcaaagcgcgcagccggtcaggctgctgtaaagaaccactaccctaaggatgccaagtatgtgggcattggcagtggttccaccattgtctacgttgttgaggccatcaaggagtccggtgtcgacacctcccaaacaaaatacgtacccacaggctatctttccaagcagctcatcgtctccaacggcctgacagccgttgacttcgactctctccccgaaggaaccgtgctggacattgccttcgatggagcggatgaggtcgatgatgacctcaacctgatcaagggcggtggtgcctgtttgttccaggagaagattgtcgccctccaggctaaagaattcgtttgcgttgctgactcccgcaaacttcaatctcgtctcctttcgaactggaagtacattcccatcgaagtggcccccattgctgctagccgtgtccttggagagcttagggaactcggtagcatctcgcctgctcttcgcttgaacactactgctccggaaggcgcacccaagccaacccctttgaagaccgaccaggcctttaacatcattgatgctcccttcaagtctcttcttaccaaggcagacattgcagccggacaagatggcactggaaaggatggagtttgggaagtcgaagccctttctcgggccatcaagcagattcccggtgtcctggatgttggtatcttctccggtgaaactggtccccaggcgcaggctcgtggaggtactggtggtcagaagcctatcgccgcatacttcggtatgcctgacggctccgtgtccgttagaaaggcttctgcttaa

SEQ ID NO: 2747 - DNA, 834 bp, Aspergillus terreus
atgtcgaacgcaatcgaagaggccaaacgcgcggccggcaaggccgccgtggacaaccactaccccaaggacgccaagttcgtcgggattggtagtggctctaccatcgtctacgtggtcaaggctatcaaggagtcgggtattgacacctctaagaccaaatacgtgcctacggggttccaatccaagcagctgatcgtctcgaatgacctgacggccatcgacttcgattcgctcccggagggaacggtgctggatgtggcattcgatggtgcggacgaagtcgatgacgagctgaaccttatcaagggcggtggtgcctgtttgttccaggagaagatcgtggccctccaggccaaggagttcattgttgttgctgactcgcgcaagctccaatcccgtctcctctccaactggaaatatatccccattgaagtcgctcccatcgccgctcaccgcgtcctctccgccctcaaggaactgggcagcatcaaccccgttgttcgggtgccgcctgggtcctctccggagcttcccaagccgggtcctctcaagaccgaccaaggctttttcatcatcgacgccccgttccagacgctgctcacgcagggcgatgttgccgctggaaaggacggcagcggaaagggcggtgtttgggaggtcgatgctctgtctcgcgctatcaagcagatccccggtgtgttggacgtgggcatcttctctggcgtgacgggtcctcaggctcaggctgccggaggcatcggcggtcagaagcccattgccgcctacttcggcatgcccgatggctccgtttcggtccggaaggccgcttga

SEQ ID NO: 2748 - DNA, 822 bp, Aspergillus nidulans FGSC A4
atggccgagcttatcgagaaggctaaacgcgccgctggaaaggccgctgtcgaaaaccactaccccaaagatgccaaatttgtcggtattggcagtggttctactattgtgtatgttgttgaggccatcaaggagctgggaatcgatacctctggcacgtgttatgtgccaacgggcttccagtccaagcagctgatcgtctcggccggcctgacagcagtggatttcgatgccattcccgaaggaacagtgcttgatattgcgttcgacggtgcagacgaggtggatgatgagcttaaccttataaagggcggtggtgcttgtcttttccaggaaaaaattgttgctctccaagccaaggagttcatttgcgttgccgattcaagaaagttgcagtcccgcctcctgtctaactggaagtacattcccattgaggttgctccgatagctgctaagcgggtgctacctgctctgagacagctgggcagcatcaatcctgtacttcggccgcagactggatccaagctaggcccattgaaaactgaccaggacttttacatcatcgatgcacctttcccaactcttttaacaaaagcggacgttgcagctggaaaggacggtagcggaaaggatggcatttgggaggtcgacgctttgtcactggcgattaagcaaattcccggcgttttagatgttggtatcttctctggagtgaccgggcctcaggcccaggcgctcggcggcattggaggccagaagcccgttgcggcttactttgggatgcctgacggctcagtgcaggtcagaaaagcggacgcttga

SEQ ID NO: 2749 - DNA, 816 bp, Penicillium chrysogenum
atgtccgccgtcgaagaagccaagcgcaccgccgcaaaggtcgccgtcgaaaaacactaccctaaggatgcccgctgggtcggtatcggcagtggttcgacgattgtgtacgtcgtcgaggccatcacgaacctcggcgtggacacctccaacacaaagtacattccgaccggttaccagtccaagcagctgattgtcaatgccggattaatggctgtggagtatgatgcccttccgctcggcactgtcctcgatgtggcattcgatggtgcggacgaggtcgacgaggacctgaactgcatcaagggcggtggtgcatgcttgttccaggagaagatcgtcgctctgcaggctaaggaatttatctgtgttgctgaccaccgcaaactccaaccccgtctcctcacaagctggaaatcaatccctatcgaggtcgccccgatcgccgcctaccgcgttatccaaaaactcaaggaactcggtagtatcaatcccgccgtccggccatccgcgagcgtcaaggaaggtcccctcaagaccgaccaggacttcttcatcgtcgatgctcctttcaagccgatgctgatcaaggccgacatcgaggctggccaggatggtaacggcaaggatggtgtgtgggcggttgaggtgttggctcgcaagatcaaggagattatcggtgtgctcgaggtcggtattttccacggccaaaccggcccgcaggctgctgctgccggtggacttggtggtcagcgccctgttgcggcctacttcggtatgtctgatgggacggtcgctgttcgcaaggccgagtag

SEQ ID NO: 2750 - DNA, 825 bp, Ajellomyces capsulatus
atgtccacaatcgaggacgcaaagcggaacgctgctaaacaagctgtagcaaaacactatccaccgaatcccaaattcgtcggaattggcagcgggaccaccattgtctatgtggtcgaggccatcaaagcgctgggtgttgacaccacaaccactggcttcgtgcctacagggcaccagtcaaaccaacttgttgccaatgctggcttgacctctatttcactcgacgctcttcccgagggtgctgtgttggacgttgcgttcgatggtgcggatgaggtggacgatgatctcaattgcataaaaggtggtggggcatgcctgttccaggagaaactggttgcgctgcaggctaaggagttcatttgcgtagctgactctcgaaaactccagcgccggctcctgacaaattggccctcaatcccaatcgaagtagcccccctagccgtccgccgcgttatatcagagctccaaaaactcggcagccccctacccaaactccgtaacgcaccaattaaggaaggtgaacatacccaacccgtaaaaactgaccaagatttcttcctcgtcgacgcgccttttcccaaactcctcctgccgtccgacgttgcgcagggtgaggatgggtcgggcaaaaacggcgtctgggaagtcacggcgctggcggagaggatcaaattgatccctggtgtgctggaggttggtctcttctgcgggctgacgggcccgcaagcacaggccgctggcggcattggcgggcagaagcctaccgccgcgtatttcggcatgcttgatggctcggtttcggtgcgcaaggcgaattag

SEQ ID NO: 2751 - DNA, 825 bp, Ajellomyces capsulatus
atgtccacaatcgaggacgcaaagcggaatgctgctaaacaagctgtagcaaaacactatccaccgaatcccaaattcgtcggaattggcagcgggaccaccattgtctatgtggtcgaggccatcaaagcgctgggtgtagacaccacaaccactggcttcgtgcctacagggtaccagtcaaaccaacttgttgtcaatgctggcttgacctctatttcactcgacgctcttcccgagggtgctgtgttggacgttgcgttcgatggtgcggatgaggtggacgatgatctcaattgcataaaaggtggtggggcatgcttgttccaggagaaactggttgcgctgcaggctaaggagttcatttgcgtagctgactctcgaaaactccagcgccggctcctgacaaactggccctcaatcccaatcgaagtagccccccttgccgtccgccgcgttatatcagagctccaaaaacttggcagccccctacccaaactccgtaacgcaccaattaaggaaggtgaacatacccaacccttaaaaactgaccaagacttcttcctcgtcgacgcaccctttcccaaactcctcctgccgtccgacgttgcgcagggtgaggatgggtcgggcaaaaacggcgtctgggaagtcacggcgctggcggagaggatcaaattgatccctggtgtgctggaggttggtctcttctgcgggctgacgggcccgcaagcacaggctgctggcggcattggcgggcagaagcctaccgctgcgtatttcggcatgcctgatggctcggtttcggtgcgcaaggcgaattag

SEQ ID NO: 2752 - DNA, 879 bp, Ajellomyces capsulatus
atgtccacgatcgaggacgcaaagcggaacgcttctaaactagctgtagcaaaacactatccaccgaatcccaaattcgtcggaattggcagcgggaccaccattgtctatgtggtcgaggccatcaaagcgctgggtgtagacaccacagccactggcttcgtgcctacagggtaccagtcaaaccaacttgttgtcaatgctggcttgacctctatttcactcgacgctcttcccgagggtgctgtgttggacgttgcgttcgatggtgcggatgaggtggacgatgatctcaattgcataaaaggtggtggggcatgcctgttccaggagaaactggttgcgctgcaggctaaggagttcgtttgcgtagctgactctcgaaaactccagcgccggctcctgacaaactggccctcgatcccaattgaagtagcccccctagccgtccgccgcgttatatcagagctccaaaaactcggcagccccctacccaaactccgtaacgcaccaattaaggaaggtgaacatacccaacccgtaaaaactgaccaagacttcttcctcgtcgacgcaccttttcccaaactcctcctgccgtccgacgttgcgcagggtgaggatgggtcgggcaaaaacggcgtctgggaagtcacggcgctggcggagaggatcaaattgatccctggtgtgctggaggttggtctcttctgcgggccgacgggcccgcaagcacaggctgctggcggcattggcgggcagaagcctaccgctgcgtatttcggcatgcctgatggctcggtttcgacgtactctgcaacctcgtgtgtttgttataaacggtattgttacagaaacgattgcagagcaattgaataa

SEQ ID NO: 2753 - DNA, 825 bp, Ajellomyces dermatitidis
atgtccacaatcgaagacgcaaagcggaacgccgctaaagaagctgtagcaaaacactacccgccaaaccctaaattcgtcggaattggcagcgggaccaccattgtctacgtggtcgaggccatcaaggcgctgggcgtagatacctcgtccactggctttgtaccaaccggataccagtcgaatcagctcgttgccaacgctggcttgacgcctgtcgcattcgatgcgctccctgagggtaccgttttagatgttgcgttcgatggagcggatgaggtagacgatgacctcaattgcataaagggtggtggggcatgtttgttccaggagaaactggttgcgctgcaggcgaaagaatttatttgcgtagctgactcccgaaaactccaaccccgcctcctaacaaactggccatcaatccccatcgaggtagcccccatggccgtcggccgcgttacctcagagctcaaaaaactgggtagccccctcccaaaactccgcaccgcaccagttaacgcgggggaacagacccaacccgtaaaaaccgaccaggacttcttccttatcgacgcacctttccccaaactcctcctgtcctccgacgtcgtgcagggccaggatggttcgggtaagaatggcgtctgggaagtcacggcgctggcggagaggatcaaattgatccctggcgtgctagaggttggtctcttctgtgggctgacgggcccccaggcacaggcgactggtggcattggtggtcagaaacctgttgccgtgtatttcggtatgcctgatgggtcagtttctgtgcgcaaggcgagttag

SEQ ID NO: 2754 - DNA, 825 bp, Paracoccidioides brasiliensis
atgtccacaatcgaagacgcaaagcggaacgccgcgaaagaagctgtcgataaacactatccaccaaacgccaaattcgtcggaatcggtagcgggaccacgattgtctacgtagtcgaggccatcaaggcgctcggggtggatacgtctaccactggtttcgtgcctacagggtaccagtcgaatcaactcgttgtcaatgcgggcttgacccctgtcgcatttgatgcgcttcccgatggcgccgtgttagacgttgcgtttgatggtgcggatgaggttgacgacgacctcaattgtataaagggcggaggtgcatgtctgttccaggagaagctagttgcactacaggcgaaggagtttatttgcgtagctgactctcgaaaactccaatcccgcctcctaacaaactggccctcaattcccatcgaagtagcccccatagccgtccgccgcgttatagccgaacttcaaaaaatcggcagccccctgcccaaactccgcattaccgcacccgaggtaggagagcatgccactcctgtgaaaactgatcagggcttcttcctcatcgacgcaccatttcctaagctcctcttgccgtcggacgtcgcgcaaggtcaggatgggtcggggaaaaatggggtttgggaggtaacggctttggcagagaggattaatatgattcccggtgtattggaggttggtctcttttgcgggttgacggcccggcaggctcaagctgttggtgggattggtgggcagaagcctgttgctgcgtattttggtatgccggacgggtcggtttcggtgcgcactacgaagtaa

SEQ ID NO: 2755 - DNA, 825 bp, Paracoccidioides brasiliensis
atgtccacaatcgaagacgcaaagcggaacgccgcgaaagaagctgtcgataaacactatccaccaaacgccaaattcgtcggaatcggtagcgggaccacgattgtctacgtagtcgaggccatcaaggcgctcggggtggatacgtctaccacgggtttcgtgcccacagggtaccagtcgaatcaactcgttgtcaatgcgggcttgacccctgtcgcatttgatgcgcttcccgatggcgccgtgttagacgttgcgtttgatggcgcggatgaggttgacgacgacctcaattgtataaagggcggaggtgcatgtctgttccaggagaagctagttgcactacaggcgaaggagtttatttgcgtagctgactctcgaaaactccaatcccgcctcctaacaaactggccctcaattcccatcgaagtagcccccatagccgtccgccgcgttatagccgaacttcaaaaaatcggcagccccctgcccaaactccgcattaccgcacccgaggtaggagagcatgccgctcctgtgaaaactgatcagggcttcttcctcatcgacgcaccatttcctaagctcctcttgccgtcggacgtcgcgcaaggtcaggatgggtcggggaaaaatggggtttgggaggtaacggctttggcagagaggattaatatgattcccggtgtattggaggttggtctcttttgcgggttgacgggcccgcaggctcaagctgttggtgggattggtgggcagaagcctgttgctgcgtattttggtatgccggacgggtcggtttcggtgcgcactacgaagtaa

SEQ ID NO: 2756 - DNA, 825 bp, Paracoccidioides brasiliensis
atgtccacaatcgaagacgcaaagcggaacgctgcgaaagaagctgttgataaacactacccaccaaacgccaaattcgtcggaatcggtagcgggaccacgattgtctacgtagtcgaggccatcaaggcactcggtgtggatacgtctaccacgggtttcgtgcccacagggtaccagtcgaaccagctcgttgtcaatgcgggcttgacccctgtcgcattcgatgcgcttcccgagggcgccgtgttagacgttgcgtttgatggcgcggatgaggtcgacgacgacctcaattgtataaagggcggaggtgcatgtctgttccaggagaaactagttgcactacaggcgaaggagtttatttgcgtagctgactctcgaaaactccaatcccgcctcctaacaaactggccttcaattcccatcgaagtagcccccatagccgtccgccgcgttataaccgaacttcaaaaaatcggcagccccctgcccaaactccgcattaccgcacccgaggtaggagagcatgccactccagtgaaaactgatcagggcttcttcctcatcgacgcaccatttcctaaactcctcttgccgtcggatgtcgcgcaaggtcaggacgggtcggggaaaaatggggtttgggaggtaacggctttggcggataggattaatatgattcccggtgtattggaggttggtctcttttgcgggttgacgggcccgcaggctcaagctgttggtgggattggtgggcagaagcctgttgctgcgtattttggtatgccggacgggtcggtttcggtgcgcactacgaagtaa

SEQ ID NO: 2757 - DNA, 816 bp, Coccidioides posadasii C735 delta SOWgp
atgtctgctatagaggatgctaaacgtgcggcggcgcgggaagctgttgccaaccattatcctcaaaatcccaaattcgttggcattgggagcggtacaaccatcgtctacgttgttgaggccatcaaagcccttggcattgacacctcctccacctcattcgtgcccactggtttccaatcaaatcaactcattgtcaatgcagggttgacacccattgcctttgatgcgcttccagagggcgccgttctggatattgcgtttgatggtgccgacgaagtcgacgatgatctgaactgtatcaagggcggtggtgcgtgcttgtttcaagaaaaagtggttgccctgcaagcaaaggagttcattgttgttgctgactaccgaaaactccaaccacgacttttgactgcctggccttcgatacccattgaagtcgcacctctcgcctctcgcagagttatcacggccctccaagcccttggaagcccagaacccaagctccgccaatcgttgatttctcaagaaggccctgtgaagacagaccagagcttcttcctcatcgacgcgccgttcccacagctccttacttcctcggacatccaaagtggaaagactgcttctgcgaaggaaggtatttgggaggttgaaacattagcgaaggagattaaacaaattccaggtgtactggaagttggcttgttttacggacctactggaccacaagcacaggctactggtggagtcggtggccagaaaccgatcgctgcatattttggaatggccgatggctcagtcagtgttagaaaagtaaagtag

SEQ ID NO: 2758 - DNA, 816 bp, Coccidioides immitis
atgtctgctatagaggatgctaaacgtgcggcggcgcgggaagctgttgccaaccattatcctcaaaatcccaaattcgttggcattgggagcggtacgaccatcgtctacgttgttgaggccatcaaagcccttggcattgacacctcctccacctcattcgtgcccactggtttccaatcaaatcaactcattgtcaatgcagggttgacacccattgcctttgatgcgcttccagagggcgccgttctggatattgcgtttgatggttccgacgaagtcgacgatgatctgaactgtatcaagggcggtggtgcgtgcttgtttcaagagaaattggttgccctgcaagcaaaggagttcattgttgttgctgactaccgaaaactccaaccacgacttttgactgcctggccttcgatacccattgaagtcgcacctctcgcctcacgcagagttatcacggccctccaagcccttggaagcccagaacccaagctccgccaatcgttaatttcccaagaaggccctgtgaagacagaccagagcttcttcctcatcgacgcgccgttcccacagctccttacttcctcggacatccaaagtggaaagactgcttctgcgaaggaaggtatttgggaggttgaaacattagcgaaggagattaaacaaattccaggtgtactggaagttggcttgttttacggacctaccggaccacaggcccaggctactggtggagtcggtggccagaaaccgatcgctgcatattttggaatggccgatggctcagtcagtgttagaaaagtaaaatag

SEQ ID NO: 2759 - DNA, 810 bp, Microsporum canis
atggcagatatagaagctgcgaaacgagctgccgctactgaggcagtgaagaaccattacccaaaagacgcaaaattcataggcattggcagcggaactaccatcgtctacgttgtcgaagctataaaagaactaggcattgacacctcggccacaagctttgtgcccaccggatatcagtcaaaccaactaattgtcgatgccgggttaacagccattgcttttgacgctctgccagaggggacggtgctggatgctgcgtttgatggtgctgacgaggttgacgacgacttgaactgtataaagggtggaggagcctgcttattccaggagaagctggttgctctacaggccaaggagttcatctgcgtcgctgattggcgcaaaaaccaaagccgtctgctcacctcctggccatccattccgattgaggtcgcacccctcgctgcccgtcgagtaatagatgaattaaaactactggggagtccgaaccctctccttcggcaaaatccccgcgagaaatcaggcccagtgaagacggaccagtctttctttatcgttgatgcaccgttccctaaactactcttgccgtctgatattgcagctggacagaaggcagaaggtggcgcttgggaggtagaaaaattggccaatgctatcaatgccatcactggtgtattagaagtaggtctgttctgtgggcctaccggccctcaggctcaggccagcagaagagtaggaggacagaagcccgttgcagcctactttggatatacggacgggacggttgtttcgaagagggcaaagtag

SEQ ID NO: 2760 - DNA, 855 bp, Pyrenophora tritici-repentis
atgaccgacacaaacgttgaagccgccaaacgggccgctgcacaccaagcggtagccgatcacttcgacccagcagccacgcacgtcggtatcggatccggcaccaccattgtctacgtagtcgaagccatcaaggagcgctctacaaatcccaatatcctcttcgtacccactggtttccagtcgcgccaactcgtaatcaacgccggcctgactgccatctcctttgacagcctgccagaccgcgtcatgcttgacgtagcttttgacggcgcagacgaggtcgactccgaactcaactgcataaaaggcggcggcgcctgtctgttccaggagaagctagtagctgaacgcgcaaagaagtttgtgtgtgtagcagactatagaaagaggcaggaccgcctcttgaccaactggccaacgatacccatcgaggttgcgccactgtctcagctcaaggtcgccgctgcgcttaagatgctgggttccaccgggcccaagctaaggactacgctactggagaagtcagggcccctgaagacggaccaggatttctacattctcgatgccccgtttcctccactgctcacttcggctgatgtcgcggctggcaagggcaagggagatggcagtgatggtacctgggaagtcaacaacatcagccgggctatcaagggcctcactggtgtactcgaagttggcatctttgctggcttgaatggtatcgatgcccaggctcttcgtgagaaggaccaatccaccaaggccgtaaagggcggccaaaagcccgttgctgtctactttggaatgcaagacggcagcatcaaggtgcgaacagccgaaggcgagaaatag

SEQ ID NO: 2761 - DNA, 855 bp, Phaeosphaeria nodorum
atgaccgacaccgccgtcgaagccgcaaagcgcgccgccgcccaacaagctgtgaaagaccacttcgacccgtcaagcacacatgtcggcattggctcgggtactaccattgtctacgtcgtcgaagccataaaagagcgctctaccaaccccaacatcctcttcgtgcccacgggttaccagtcgcgccaactcgtcatcaacgccggtctcacgcccatcagcttcgattccctacccgaccacatcatgctagatgtcgctttcgatggcgcagatgaagtcgacgccgagctgaactgtataaagggcggaggcgcgtgtctattccaggaaaagctagtcgccgagagagcgaagaaattcgtctgtgttgcggactacaggaagaggcaggaccgtttgctcaccatctggcccaccattcccatcgaggtcgcacccctgtcgcaaagaaaagtcgtggctgcacttaaactgctcggttcaccaaacccgacgctgaggaccacgctgctggagaagtcgggaccccttaagacggaccaggacttctacattgtcgatgcgccgttcaagacgctgcttactgcggcggatgttaaggcaggaaaaggcaagggtgatggaacggacggcacttgggaggtcaaggcgattagcaaggcgatcaagggcttgactggtgtgttggaggtgggcatttttgctgggctgaatggtgttgaggcgcaagagctgcgcgcgcaagacaagtccgtcagtgcagtcatgggtggccagaagcccattgccgtatactttggcatggcagatggctccgtcaagctacgaacggcagagggcgaacaatga

SEQ ID NO: 2762 - DNA, 828 bp, Chaetomium globosum
atgtcgaccacggcagaggagcaggctaagctggtggagacgtcgaagcgtctcgccgcctaccaggctgtcaaagaccacctgctcccagagtataccaggataggcattggctccgggagcactgtcgtctacgtggtcgaggcaattgccgcgctcggacccgcggcgacgtccaagatggccttttacccgacaggctctcaatccgaggagttgattgaggcggcagggctgaccctgcaatacatcagcaagctgcccgctggtcagcagctggatgttgcgttcgacggcgccgacgaggtggatgacgacatgaatctgatcaaaggcggtggcgcttgcttgtggcaggagaagatcgtggccgccagcgctaagcagtttgtttgcgtcgccgacttccgcaagctttcaccacgcctggggaccgcgtggaaaaagggaattcccatcgaggtgctccccatggctgccccgagagtcctcgacgaactccagcggatgggctcgcaaaacccccgtatacgccccggtttacctggaaaggctggcgccatcgtcacagacaacggcttgtggattatcgatgcgccctttgctccgcttctactccctaaggacacagaaactgaccgcgggaccgatggcgcctggactgttgacgcactggcggatgggttgatcaagattcccggggtggctgagatcggcttgttttacgggaagaacgggctccaggttgccagcggcgcgcaaaagcccgttgctgcgtattttgggatggccgatggctcggttgaggtcaagacaccgtcgtcttga

SEQ ID NO: 2763 - DNA, 852 bp, Neurospora crassa
atgtccaccgcccccgatgcatccgccgcccagcagctcatcgaaaagtccaaattcctcgccgccaaccgcgccgtaaccgagcacctctcccccacctaccgacacatcggcatcggctccggctccaccgtcatccacgtcgtcgacgtcatctccaagctcggcaccaccatcaccggacccatgaccttttaccccacgggcgaccaatcccgcgacctcatccaagccgccggttttcgcctgggttacctctccgacctatcccccggccacgcgctcgacgtgtgcttcgacggcgccgacgaagtcgaccccgctctcaacctcatcaagggcggcggcgcctgtctcctccaggaaaaactcgtcgccaccgctgcgcgcaagttcgtctgcgtcgcggactcgcgcaagattagcaaccacctaggcacgcagtggaaaaagggaatccccattgaggtgttccccatggcggtgccgcaggtgttgggcgagttggagcgactggggcgtctaagcgcgcaggtgaggtcgggcctaccgggcaaggcgggcgcgtgcgtcacggataatggattgaggatcgtggatgcggtgtttaagccgctgttgacggaactgccagagggcaagcaggaaggggaggagggcgtgtggacggtggatgggctggcgagacggttgattgagattccgggcgtggcggagcatgggttgttttatggaaagagcgggttggaggtggagagcgggggtgcgcagaagccggtggcggcgtactttgggatggaggatgggtcggtcatggtgcagacgctggagaatggcttggttaaggcgtga

SEQ ID NO: 2764 - DNA, 894 bp, Magnaporthe grisea
atggcaagctcagggtcggccgtgtcggcggtcgagcaggcgcagttgatagagatggccaagaaggccgccgccttcactgccgtcaaggaccacttggatcctcgctacacacacgtcggcatcgggtctggctccaccgtcgtctacgtcgtcgaggccatcaaggagctgcacccagaggcctcgaaggacatgaccttctacccgactggcgaccagtccaaaggcctcatcaaggccggcgggctccgggcggccccgatagaggaccgaccccagggcagcctgctggacgtctactttgacggcgccgacgaggccgacgccgacctcaacctgatcaagggcggcggcggctgcctgtggcaggagaagatcgtcgccgtggcctcgcgcacatttgtctgcatcggcgacttccgcaagctctcgaggaacctaggcacccaatggaagcaagggatcccaatcgaggttctccccaaggcggcagaccatgtgctggccgagctggagaggctcggcgcgcactcgccgcgactgagatccggctcaggaaaggccgggtccgtggtgacggacaatgggatgcacatcatcgatgcccccttcaccccgctgcttctggccggagatgagggtgggactggcgagaatggaatctggagcgtcgacaggctcgcggctaaactcaagtctctggtcggcgtctgcgagattggcctcttctacggccgtagcggcctggatgcaaaggatgagggcggtgcacagaagcccgtcgcggcctatttcggcatggctgacggcagcgtgcagattctcaaccagggctccccgcccgtcacccttacaacatcgagcacgggtggctctgatggttccaaatga

SEQ ID NO: 2765 - DNA, 843 bp, Nectria haematococca
atgtcttcagcaaacctcgtcgagtcggccaagaagcaggccgcttaccaggccgtcaatgatcaccttcttcccgagtacaagtatgtcggtatcggctccggcagcaccgtggtctacgtcgtcgaggccattgtcagcaaggggcccgagttttacggtggcatgacctttattcctaccggaagtcagtccaagggcctcatccgtgctgctggcctgaagctggccatccttgacgagaggcctactgtcgatggcgtccctgtcgccctcgatgttgcctttgacggcgccgacgaggtcgatgaggacctcaaccttatcaagggtggtggtgcttgtctgttccaagagaagctcgtggccattgcggccaagaagttcattgccgtggctgactaccgaaagcagtctccccgactgtgcaccacatggaagaccatccccatcgaggtcctccctatggctgcccctgatgtcctgacccgtcttcgagccatgggctctcccaaccctgtcgtccgctcaggtctccccagcaaggctggcgagtgcgtcactgacaacggcatgtggctgattgacgccccgttccctcctttgctccttgccaaggacatcacctccgaagttgacggtcaaggaaaggatggtgtctgggagatcaacgccctcgcccaggagttggtccggttgcccggcatcgtcgagattggcctcttccacggcttcaacggtgacgaggctgtcaagctgggcaagcagttgcaagcacagaagcccgttgccgcctatttcggtctggccaatggcgaggtgcaggtgcagaatgcggcttaa

SEQ ID NO: 2766 - DNA, 846 bp, Gibberella zeae
atgtcttcatcagcaaacctagttgagtcggccaaaaagttggccgcctatcaggcagtcaatgatcacctcgatgcctcttacaagtttgtcggaattggctctggtagcaccgttgtctacgttgtggacgccattgtcagcaagggacccgaattctacaagggaatgacttttattcctactggaagtcagtcaaagggtcttattcgtgctgctggcttgaatcttgtaaacttggatgagaggcctatggtggatggccttcctgttcctcttgacgttgcctttgatggcgctgacgaggtggacgaggacctcaatcttatcaagggcggcggtgcttgtttgttccaggagaaattggttgcaattgctgccaaaaagtttatcgctgtagctgattaccgaaagcaatctcccaaactatgtactacatggaagaccattcctatcgaggttcttcccttgtccgcacctgatgttctggtccgccttcgagccatggggtcccccaaacctgccattcgttcaggtctccctgccaaagctggcgaatgtgtaacagacaacggcatgtggcttattgacgcaccgttctctcccttgcttcttcccaaggatatcaactccgagaacaagggccgtggagaaaatggtgcctgggaggttaatgccctcgccgaggaactggtccgaacacctggtattgttgaaattggtttgtttcacggcttcaatggaaacgaagctgtcaagctgggcaaggagtcgcaagcgcagaagcccattgcggcctatttcggtctcgccaatggcgaggtgcaggtacaaaatgccgcttaa

SEQ ID NO: 2767 - DNA, 846 bp, Verticillium albo-atrum
atgtccaccctgtcccccgtcgaatccgccaaaaaggccgctgccgcccgcgccgtgtccgaacacctgcagcctagccaccgctacgtcggcatcggatctggcagcacagtcgtctatgtcgttgacgccatcgctgccaagggcccctcgttctggggcgagatgaccttcttccccaccggcagccagagcaagggcctcatccgggctgccggcctgcgcctctgcaacctcgacgacaggcccctggagagtggcaagcccgtgacgctggacgtcgcgttcgacggcgccgacgaggtcgacgccgagctcaactgcatcaagggcggcggcgcctgtctgctgcaggagaagctcgtcgccatcgccgctaagaagtttgtcgtcgtcgccgactaccgcaagctctcgaacaacctactcacgcagtggaagaccattcccattgaggtcctgcccatggcggcgcccgatgtcctgaaccagctcgtggcgctgggctcgaccgggcccctcgttcgccccggtgtccctggcaaggccggcgaggtcgtgacggacaatggcatgtggatcattgacgcgccgtttgcgccgctgaagctgctcagcgagggcgcaggtgctgagcgtgccgccgacggctcgtggggcgtcaaggcgctggcggacgagattgtcaagattcccggtgttgtcgaggtcggcatctttttcggtctcgacggcagcgaagcggccaaggccggtaagtctggactggcccaaaagcctgtggcggcatactttggcatggaggatggcagcgtcaaggtgacaaacgcggcagggtcggagtag

SEQ ID NO: 2768 - DNA, 663 bp, Ferroglobus placidus
gtgaaagagatagcggctgagaaagctctggagttcgttgaaaacggaatgattctcggacttggaagcggaagcacggtaagaatatttgtagaaaagcttggtgagctcgttagaaaagagaggttgaaagtcgaagtaattccaacttcctacgacaccgaaatactggctgtaaaaaacgggttgaaagtatcttctctcctcgagcatccagagccggatctttgcgtagacggagcggatcaggttgatcgcaaacttaacctgatcaaaggtggtggtggggctttaacgagggaaaaaatagttgccgaagcttccaagaagttttacgtagtagtcgatgagagcaagcttgtggagaggttaaacatggcaattcccgtcgaaattctgcctttcgcttacggattcgtggaaagaaggttgaaggagcttggttacaactgcaacctcagaacgagcgtaaggaagctcggaccggtcatttcagataacgggaactacatagctgatgtggaggcgaaggaagtagatgttgagaaaatagagagagatttcagagttccagggattattgagcacggcgtttttccctcggaaatggtggatttggtgatagtcggaaggagagacggagctgaaataatcagaaaataa

SEQ ID NO: 2769 - DNA, 678 bp, Archaeoglobus fulgidus
atggactcgagtgggaagtataacgccgcaaagcttgctcttgagcttgtaaaggatggcatggttctcggaatagggagtggttctacagttgaggtgtttctgaacctgctcggagacaaaataagggaggagggactggaaatctacggaattccatcatcataccagtcctacttcgctgcgatcaggaatggggttgaaattgttgacctggttgagttcgagccggacctgtgcattgacggggctgatcaggtagatgccaagctgaactgcataaagggcggcgggggagcgatgacgagggaaaaaatcgttgccaaggcgagcaggaaggttgtgataatcgtggacgagagcaagcttgtggaaaaactgtcaatgcctgtgccggttgaagtgctgcccttcgcttacggatgggttctgagggagattgagaaaatgggatgcaaggcaaggctgagggaaggaaagggaaagattgggccggtgataacggataacggaaattttgttgtggactgcgactttggtgttatagaagaggatagggttgagggtttggagggtgagataaagctgattagcggggttgtcgagaacggtatcttttcgaaagagctgatagatgctgtaattgctgggtcaagtcgatctgcaagatttctttaa

SEQ ID NO: 2770 - DNA, 702 bp, Bacteroides intestinalis DSM 17393
atgaaatgggataatcaactgataaatcatttgcaatggtcgaatgcaattatcaatcgtgaaggaaaagaaatcgtagcgcgggaaattgctgcaatggcggaagaaggtgatgtgattggggctggttccggctctactgtctaccttacattatttgcattagcggaacgtattcgcaaagaatctctgcacatagaggttatccctgcctctgctgaaatttccatgacctgcatacaactgggtataccacaaactactctttggaataaacgtccggactgggcttttgatggtgctgatgaagtagatccggaacggagtctgataaaaggacgtggtggagccatgttcaaagaaaaacttctgataaaaagtagtggtaagaatttcattattattgacgacacaaaactggttgatcatttggggagccgctttccaatacctgtagaagtcttcccaagcgcattgacttttgtagagagtgagatgcggcgattaggagcttctgaaataacactgcgtcttgccgatggaaaagatggacctgttctgactgaaaatggtaattttattcttgatacccgcttcagttacattgatccttctttggaagaaaatctaaaaatgattaccggagtaattgaaagcggactttttatcggatatgatgttgaaatagtagttgcaaaataa

SEQ ID NO: 2771 - DNA, 702 bp, Bacteroides cellulosilyticus DSM 14838
atgaaatgggataatcaactgataaatcatttgcaatggtcgaatgcgatcattaatcgtgagggcaaagaaatcgtagcacaggaaattgctgcaatggcgaaggatggtgatgtgatcggagccggctccggttctaccgtttatctgacgctattcgcattagcggaacgtattcgcaaagaatctctacacatagaagtcatccctgcctctgcagaaatttctatgacctgcatacaattgggtataccacaaacgaccctttggaataagcgtccagactgggtttttgatggtgctgatgaagtagatccggagaaaagtctgattaagggacgtggtggagccatgttcaaagaaaaacttctgataaaaagcagtagtaagagcttcattatcattgatgatacaaaactggtagatcatttgggaagtcattttccaatacctgtagaagtgtttccaggtgcattaacttttgtagaaagcgaaatgcaacggttaggagcttctgacgtgaaattgcgtcttgccggtggaaaagacggacctgttctcaccgaaaacggcaactttatttttgatacccgcttcagttatgttgacccttctttggaacaaaacctgaaagcaattaccggggtaattgaaagcgggctttttatcggatatgatgttgaaatagtagttgcgaaataa

SEQ ID NO: 2772 - DNA, 702 bp, Bacteroides sp. 2_2_4
atggattgggaaaatcacctgataaaacacctgcaatggtcggactccatcatcaaccgggaggcaaaagaacacgtagcccgtgaaattgccgccacggcaaaagacggagatgtgataggagccggctccggctctacagtctacctgactctgttcgaactctcacgacgaattcgtgaagagcacttgcatatcgaagtgattcccgcctcacaagaaatctcgatgacctgcatacagctaggcatcccccaaactaccctctggaaccaacggcccgactggacattcgacggagcagacgaagtagatccgcaacagaacttgattaagggacgtggcggagcgatgttcaaagagaaactactgattagaagcagccgcaaaacgttcatcatcatcgaccccagcaagcgtgtaaatcagttgggaagcaaatttcccatccctgtagaggtctttccggactcactgacttatgtagagcatgagttgcagcgactgggtgcctcggagattgttcttcgtcccgctcgtggcaaagacggacctatctttacagaaaacggcaactttatcctcgacacccgtttcaactacatcgactcttcgctcgaagaacaactgaaggcaatcaccggtgttatagagagcggacttttcataggttatgacatcaaagtgatcgtggcggaataa

SEQ ID NO: 2773 - DNA, 702 bp, Bacteroides ovatus
atggattggaaaaatcacctgataaaacacctgcaatggtcggactccatcatcaaccgggaggcaaaagaacacgtagcccgtgaaattgccgccacggcaaaagacggagatgtgataggagccggctccggctctacagtctacctgactctgttcgaactctcacgacgaattcgtgaagagtacttgcatatcgaagtgattcccgcctcacaagaaatctcgatgacctgcatacagctaggcatcccccaaactaccctctggaacaaacgccccaactggacattcgacggagcggacgaagtagatccgcaacagaacttgattaagggacgtggcggagcgatgttcaaagagaaactactgattagaagcagccgcaaaacgttcatcatcatcgaccccagcaagcgtgtgaatcagctgggaagcaaatttcccatccctgtagaggtctttccggactcactgacttatgtagagcatgagttgcagcgactgggtgcctcggagattgttcttcgtcccgctcgtggcaaagacggacctatctttacagaaaacggcaactttatcctcgacacccgtttcaactacatcgactcttcgctcgaagaacaactgaaggcaatcaccggtgttatagagagcggacttttcataggttatgacatcaaagtgatcgtggcggaataa

SEQ ID NO: 2774 - DNA, 702 bp, Bacteroides sp. D2
atggattggaaaaatcacctgataaaacacctgcaatggtcggactccatcatcaaccgggaggcaaaagaacacgtagcccgtgaaattgccgccacggcaaaagacggagatgtgataggagccggctccggctctacagtctacctgactctgttcgaactctcacgacgaattcgtgaagagcacttgcatatcgaagtgattcccgcctcacaagaaatctcgatgacctgcatacagctaggcatcccccaaactaccctctggaaccaacggcccgactggacattcgacggagcagacgaagtagatccgcaacagaacttgattaagggacgtggcggagcgatgttcaaagagaaactactgattagaagcagccgcaaaacgttcatcatcatcgaccccagcaagcgtgtaaatcagttgggaagcaaatttcccatccctgtagaggtctttccggactcactgacttatgtagagcatgagttgcagcgactgggtgcctcggagattgttcttcgtcccgctcgtggcaaagacggacctatctttacagaaaacggcaactttatcctcgacacccgtttcaacgacatcgattcttcgctcgaagaacgactgaaggcaatcactggtgttatagagagcggacttttcataggttatgacatcaaagtgatcgtggcggaataa

SEQ ID NO: 2775 - DNA, 702 bp, Bacteroides sp. D1
atggactgggaaaatcatcttataaagcacctgcaatggtcggactccattatcaaccgggaagccaaagaacacgtagcccgtgaaattgccgccacggcaaaagacggagatgtgataggagccggttccggctctacagtctatctaactctgttcgaactggcgcgacggattcgtgaagagcacttgcatattgaagtgattcccgcctctcaagaaatctcgatgacttgcatacagctaggcatcccacaaactatcctttggaataagcgccccgactggacatttgacggagcggacgaagtagacccgcagcgaaacttgattaaaggacgtggcggagctatgttcaaagaaaaactgctcattagaagcagccgcaaaacgttcatcatcatcggccccagcaagcgcgtcaatctgctaggaaataaatttcccattccggtagaggtctttccggactcactaacttatgtagaccatgagctgcaacgactgggtgcatcagaaatcgtcctgcgtccagcccacggcaaagacgggcctgtctttacagaaaatgggaatttcatcctcgacacccgttttaactatatcgattcttcgctcgaagaacaactcaaaaccattaccggtgtcatagagagcggtcttttcataggttatgatgtcgaagttatcatggcagagtaa

SEQ ID NO: 2776 - DNA, 702 bp, Bacteroides thetaiotaomicron
atgaactgggaaaatcacctgatcaaagacctccaatggtccaatgagattatcaacagagaagcgaaagaacgtgtagcacgtgagatcgccgccacagccaaaacaggcgatgtgataggggccggctccggttccaccgtctacctcactttgtttgagctggcaaagcggattcacgaagagcacctatatctggaagtgattcccgcctctcaggaaatctccatgacttgcatacaactgggcatcccgcagaccaccctttgggacaaacgccccgactggacattcgacggagcggatgaggtagaccccgaccgcaacctgataaaaggacgtggcggagccatgttcaaagaaaagctgctgatcagaagcagcggaaaaaccttcattatcgtcgatcccagcaaacttgtcaatatcttgggaagcaaattccccataccggtagaggtgttcccgcatgcactgtcatacgtcgaaaaagaactgcgccgactgggtgcctccgaaatatcactacgccccgcccacggaaaagacggtcctattttgacagaaaacggaaactttatccttgatacccgtttccattatattgacgcttcgctggaagaacagctgaaaacaatcacgggcgttattgaaagcggacttttcatcaattacgacattgaagtagttgtaaccagataa

SEQ ID NO: 2777 - DNA, 705 bp, Bacteroides sp. D20
atggaatgggaaaatcagttgatacaggaattgcaatggtcaaataaaatcagcaataaggcgagtaaggaattggtagcccaggagattgccggactggccaaagacggtgatgtcataggagcaggctccggctctaccgtttatctcactttgtttgcattagctcaacgagttaaacaagaatctttgcatatagaaatcattccggcatctgccgaaatttcgatgacatgtatacagcttggcctgccgcaaactactctgtggaataagcgtccggattggacattcgacggtgcagacgaagtggatccgcataataacctcatcaaaggacgtggtggagccatgtttaaggagaagctcctaattaaaagcagtggtaagacttacatcattgtcgatgagagcaagcttgtcagcaaactggggagcaaataccccataccggtagaagtatttccacatgctctctcccatgtggaaaacgagatacgcttattgggagcttcaaaaatcagcctacgtcttgcagaaagaaaagacggtccggtatttaccgaaaacggtaatttcattcttgacattcatctcagcaacattgttcctgatttggaacagaaactgaaagccattaccggggttatcgaaaacgggctgttcatcggttatgatattacagtcctaatggcaaaccgctga

SEQ ID NO: 2778 - DNA, 705 bp, Bacteroides uniformis
atggaatgggaaaatcagttgatacaggaattgcaatggtcaaataaaatcagcaataaggcgagtaaggaattggtagcccaggagattgccggactggccaaagacggtgatgtcataggagcaggctccggctctaccgtttatctcactttgtttgcattagctcaacgagttaaacaagaatctttgcatatagaaatcattccggcatctgccgaaatttcgatgacatgtatacagcttggcctgccgcaaactactctgtggaataagcgtccggattggacattcgacggtgcagacgaagtggatccgcataataacctcatcaaaggacgtggtggagccatgtttaaggagaaacttctcattaaaagcagtggtaagacttacatcattgtcgatgagagcaagcttgtcagcaaactggggagcaaataccccataccggtggaagtgtttccacatgctctctcccatgtggaaaacgagatacgcttattgggagcttcaaaaatcagcctacgtcttgcagaaggaaaagacggtccggtatttaccgaaagcggtaatttcattcttgacattcatctcagcaacattgttcctgatttggaacagaaactgaaagccattaccggggttatcgaaagcgggctgttcattggttatgacattacagtcctaatggcaaaccgctga

SEQ ID NO: 2779 - DNA, 702 bp, Bacteroides fragilis
atgaaatgggaaagtagtttgatggaacatctccaatggtcggacacgataaccaaccgggagagtaaagagaggttggcccgtatgattgccatgcgcgtacaagaaggcgaggtcattggggctggctccggatcgaccgtatatctggcattgctcgctattgccgaaaggatacgtacggagaatctgcacgtcaccgtaatccctgcttcgatggagatatcgatggaatgtgtccgcttgggcattccgcagactactttatggatgtgccgtcccgactggaccttcgatggagcagatgaagtagatcccgaccgcaatctgatcaagggaagaggcggagcgctgttcaaggagaagctgctgataagcagcagcaaccgtactttcattttggtggacgaaagcaaacaggtttcttttctgggaagccgttttcctgtccccgtcgaagtctttccgatggctttgccctacgtagagagggaaatccgggcaatgggtgcttcacgtacccaactgaggccggctaaaggtaaagatggtcctgtgatcaccgaaagtggaaacttgattctcgatgcctggttcagcaatattcattcgtctcttgaaaaagaaatcaagtcggtgacgggtgttatagaaaacggactgtttatgggatatgatgtcgaggtgatggtagcaaaataa

SEQ ID NO: 2780 - DNA, 702 bp, Bacteroides fragilis
atgaaatgggaaagtagcttggtggagcatctccaatggtcggacacgatcaccaaccgggagagtaaggagcagttagcccgtatgattgccatgcgtgtgcaagaaggggagattattggggcaggttccggatcgaccgtatatctggcattgctcgctattgccgaaaggatacgtacggagaatctgcatgtcaccgtgatccctgcctcgatggagatatcgatggagtgtgtccgtttaggcattccgcagactactttatggatgtgtcgccccgattggacgttcgatggcgccgatgaagtagatcccgatcataacctgatcaaaggtagaggcggagcgttattcaaggagaaacttttgatatgcagcagcaatcgtactttcattttggtggacgaaagcaagcaggtttcttttctgggaagccgttttcctgttcctatcgaagtgtttccgatggctctgccttatgtggagcgggaagtgcttactatgggagctttgcgtacggagttgaggcttgctaaaggtaaagacggtcctgtaattaccgaaaatggaaatctgattctcgatgcctggttcggcaatattcattcgtctctcgagaaagagataaaatcaatcacaggagttgtcgagaatggattgtttatgggatatgatgtcgaggtgatggtagcaaaataa

SEQ ID NO: 2781 - DNA, 705 bp, Parabacteroides sp. D13
atgaagtgggatcattcattaatcgatacgttggaatggggaaatcagatctcccataaggaagataaaataaagatagcggatcttatcgcatctaaagtcgaaaacggacaagtcataggcgttggctccggttcgacctcctatctagcgttgactcgcatagcggaacgtatccgaacggaacgtctttccattttggcgatccccacttctttagaaatccggatgacttgcgcccagctaggcattccggttaccagcctgttttcccacaagccggactggaccttcgatggggctgatgaagtagattcccactttaacttgatcaaagggcgtggaggcgccatgtttaaggaaaagctgttaatcagttccagtccgcagacctatatactggtcgatccttccaagaaagtggagaggctgggagctaaattcccgatcccgatagagattttcccggaagctctcacctatgtagaggacaaactccagcgtttgaatccccgtgagataaaacttcgtatgggacaaggtaaggatggaccgatcattaccgagaatggcaatatgatccttgacgtatggatggactatatccctgaaaatacagaatccaccctcaagtcgattacaggcgtactcgagagtggactctttatgaactataaggtagaagtattagggcttacttcatga

SEQ ID NO: 2782 - DNA, 705 bp, Bacteroides sp. 2_1_33B
atgaagtgggatcattcactaatcgatacgttggaatgggggaatcagatctcccataaggaagataaaataaagatagcggaccttatcgcatctaaagtcgaaaacggacaagtcataggtgttggctccggttctacctcctatctagcgttgattcgcatagccgaacgtatccggacggaacgtctttccatcttggcgatccccacttcattagaaatccggatgacttgcgcccagctaggcattccggttaccagcctgttttcccacaagccgaactggaccttcgatggggctgatgaagtagattcccactttaacttgatcaaagggcgtggaggcgccatgttcaaggaaaagctattaatcagttccagtccgcagacctatatactggtcgatccttccaagaaagtggagaggctgggagctaaattcccgatcccgatagagattttcccgggagctctcacctatgtagaggacagactccagcgtttgaaccccggtgagataaaacttcgtatggggcaaggtaaggatggaccgatcattaccgagaatggcaatatgatcctagacgtatggatggactatatccctgaaaatacagaatccactctcaagtcgattacgggcgtactcgagagtggactctttatgaactataaggtagaagtattagggcttacttcatga

SEQ ID NO: 2783 - DNA, 705 bp, Parabacteroides distasonis ATCC 8503
atgaagtgggatcattcattaatcgatacgttggaatggggaaatcagatctcccataaggaagataaaataaagatagcggatcttatcgcatctaaagtcgaaaacggacaagtcataggcgttggctccggttcgacctcctatctagcgttgactcgcatagcggaacgtatccgaatggaacatctttccatcttggcgatccccacttcattagaaatccggatgacttgcgcccagctaggcattccggttaccagcctgttttcccacaagccggactggaccttcgatggggcggatgaggtagattcccattttaacttgatcaaagggcgtggaggcgccatgttcaaggaaaaactattgatcagttccagtccgcagacctatatactcgtcgatccttccaagaaagtggagaggttgggagctaaattcccgatcccagtagagatttttccggaagccctcacccatgtagaagacaggctccatcgcttgaacccccgtgagataaaacttcgtatggggcaaggtaaggatggaccgatcattaccgagaatggcaatatgatccttgacgtatggatggactacatccctgaaaatacagaatccaccctcaagtcgattacaggcgtactcgagagtggactctttatcaactataaggtagaagtactgggacttacttcatga

SEQ ID NO: 2784 - DNA, 696 bp, Parabacteroides johnsonii DSM 18315
atggaatggggaaagacaatattatcatctttggaatggggaaaaaccatctccaacagagaagagaaagagagagtggcagacatcatttcctcgatggtaaaagagggagaaatcatcggagtaggttcgggttcgactgcctatctggccttattaaaaatcgccagacggatgaaaaacgaacaattacatatccgtgcaatcccaacttcacaggaaatccgtatggcatgtgttcgtttgggtatccctgtcaccagcctgtgggaacacaaaccggactggacattcgacggggccgacgaaatagacacggaacataatatgatcaaagggcgcggaggagcaatgttcaaagaaaagctactgatcaactccagtccccgcacctatattatcgccgatccatccaagatcgtaacccaattaggatcccgcttcccggtccctatagagatatttcccgaagcacttacctacgtcgaagaagtgctccgggcttataatcccaaagaaatcaaattaagaatggctaaagggaaagacggccctgtgatcacggagaacgggaacctgattctcgatacctggttcgatcatatccccaataacctggaagaatcgatcaagtcgatcaccggggttatcgaaagcgggctgttcatacactacgacgtgcatatcatttcataa

SEQ ID NO: 2785 - DNA, 732 bp, Treponema vincentii ATCC 35580
atgaagaatacgataagtgttgaagatcagaaagtattggttgcccataccgccatcgataaactgatttcggaggggctcatccactcaggcatgaagatcggtcttggaacgggctctaccgcaatgcccgccgtaaagcgcttggcggagtatattgcaaagggagaattaaaagatattgccgccgttcctaccagtttccaaacgtcgatagcatgtgaagagtataatattccgattttttccctcagttcgggacgaatcaacggagtgttagaccttacgattgacggtgcggatgaaattgattctaaaaagaatcttattaaaggaggcggagcagcgttgctgcgtgaaaagattatcgcgtataatagtgaactttttgtcgttatcggcgatgaaaccaagagcgtcaaagctttgggggtaaactttccgcttccaatcgaaatagtgccggaagcgcggcttagtattatgaaaaaacttgaatcctacggagtttcaatgattatccgtgacggcatacgtaaaaaaggtcccattatcaccgataacggaaacttcatcatggatataaaatggccgctcaatgcaaaaatcaatccggtaaaattggaaagcgaactgaatgccataccgggtattatcgaaaacggattttttactcaaaagtctccgcgcgtatttttaagcaatgccaacggaaccgtcgaagagttttaa

SEQ ID NO: 2786 - DNA, 720 bp, Treponema denticola
atggacacgtcacagttaaaagaaagagttgcctatcatgcaatagacactcttttttcggaaggaaaaatttttgacggaatgaagataggactcggcacaggctctacagctatgccggctgtacaccgtctcgcccaattattgtcgtcaggtaagttaaaaaaaatatacgccgtacctacaagttttcaaacatcaatcgaatgtgaaaaactaggcatccctatttattctttaagttctcagcaaataggaggaagcttagaccttgctatagacggagcagacgaaatcgaccccgataaaaacctaatcaagggaggcggagctgccctcctcaaagaaaaaataatagcatataattcaaaagaatttgttgtcattgccgatgaaagaaaaaaagttaaatctatgggaaaaggatttgcccttccgatagaaattataccggaagcacgtttaagtattacaaaggctcttgaagcccaaggcatagaagtatttctgcgtgagggcgtaaaaaaaatgggacctgttgttaccgacaacggaaactttataattgatgtaaaatggcctaaagcagccgatgtagatcccaaagccttggaagaaagtttaaacaagattacaggtgtagtagaaaacggtttttttacaaaaaacactccaagagtatttatcgtacaccaagatggaaatatagaagatttataa

SEQ ID NO: 2787 - DNA, 852 bp, Treponema paraluiscuniculi
gtgcgcaaccctcagctggcacaatgcagatattcttttgcaccacaaaaaggacacagacgcgtgagtgcacttgtggaaaaagctatacacgagaggaacacgacgacgaacaccccattagacgttaccgcgcagaaattgctggttgcccagcgcagcgtggacaccctcgttcaagagggggtgctgcacgcgcacatgagtattggccttgggacaggctctacggcaatgcctgcggtaaaacgcatcgcagatcaccttgcacgcggcactctctctgacatagcggcagtgcccactagttttcaaacagcgctcatatgtgagcggtacaacatcccccttttttctctcagttcaaaacgggttgggggcaaactggatgtgactatcgacggcgcggacgaaattgacacccaaaattttgtcatcaaaggcggtggagctgcgcttttgcaagaaaagatcgctgcatacaacagcgcgcactttgttatcatcgtagacgaaacaaaggtggtagaaaccttaggcacgcgcgcagcgctccctatcgaagtggtgcctgaggcccgcatgagcgtgatgcgcacgcttcaggattgggggttgtccgtgcacatacgcgaagcggtgagaaaaaaaggaccggtggtgactgaccacggaaattttattttagacgcgcggtggcaatcgctcccgacgcgcaccccgcaagacatggaacgcgcgctcaatgcactgccaggggtcattgaaaacggcttgttcaccgagcgaaccgtacgcgtctttgttgcgcacgcagacggttcggtagaggagcgctcggcctctttctaa

SEQ ID NO: 2788 - DNA, 765 bp, Treponema pallidum
atgcacgagaggaacacgacgacgaacaccccattagacgttaccgcgcagaaattgctggttgcccagcgcagcgtggacaccctcgttcaagagggggtgctgcacgcgcacatgagtattggccttgggacgggctctacggcaatgcctgcggtaaaacgcatcgcagatcaccttgcacgcggcactctctctgacatagcggcagtgcccactagttttcaaacagcgctcatatgtgagcggtacaacatcccccttttttctctcagttcaaaacggattgggggcaaactggatgtgactatcgacggcgcggatgaaattgacacccaaaattttgtcatcaaaggcggtggagctgcgcttttgcaagaaaagatcgctgcatacaacagcgcgcactttgttatcatcgtagacgaaacaaaggtggtagaaaccttaggtacgcgcgcagcgctccctatcgaagtggtgcctgaggcccgcatgagcgtgatgcgcacgcttcaggattgggggttgtccgtgcacatacgcgaagcggtaagaaaaaaaggaccggtagtgactgaccacggaaattttattttagacgcgcggtggcaatcgctcccgacgcgcaccccgcaagacatggaacgcgcgctcaatgcactgccgggggtcattgaaaatggcttgttcaccgagcgaaccgtacgcgtctttgttgcgcacgcagacggttcggtagaggagcgctcggcctccttctaa

SEQ ID NO: 2789 - DNA, 687 bp, Borrelia recurrentis
atggaaaaacaaaaagaattgatctcaaaatatgcaattgataaatatgtaacaagcaacatgttcataggaattggaacaggaacaactgttttttatgcaattaaacacttaagctacaaaataaaatctggtgttttaaaaaatcttacattttatccaacaagtagtgacacacaatgcttacttgcaaaagaaaatattgcttacgaatcaaaatttacaaaacttaacaaaaatatagatatcacaatcgacggagctgacgaggttctattagataaaaaagcattaattaaaggtggtggagcagctcacttaatggaaaaagtagtcgcatataactctaatcagttattgatcattgcagatgaaactaaaatagtaacaaacttaggagaaaaaacaccaataccaatagaaattgccccaaatgcccttgcatttattaaagccaaactagaaaaaatgaactttaatcctgttttaagaacatgtaaatctaaagcaggaccactaattactgacaataataattatatcttagacataaaaatgaatattgaaaatcctaaaggaactgaaaaatattttaaattattccctggaatacttgaaattggtatttttaatcatcaaaatactaaaatcatatactatcaaaatggacaaattaaagaaacttaa

SEQ ID NO: 2790 - DNA, 687 bp, Borrelia duttonii
atggaaaaacaaaaagaattgatctcaaaatatgcaattgataattatgtaacaagcaacatgttcataggaattggaacaggaacaactgttttttatgcaattaaacacttaagttacaaaataaaatctggtgctttaaaaaatcttacattttatccaacaagcagtgacacacaatgcttacttgcaaaagaaaatattgcttacgaatcaaaattcacaaaacttaacaaaaatatagatatcacaatcgacggagctgacgaggttctattagataaaaaagcattaattaaaggtggtggagcagctcacttaatggaaaaagtagtcgcatataactctaatcagttattgatcattgcagatgaaactaaaatagtaacaaatttaggagaaaaaacaccaataccaatagaaattgccccaaatgcccttgcatttattaaagccaaactagaaaaaatgaactttaatcctgttttaagaacatgtaaatctaaagcaggaccactaattactgacaataataattatatcttagacataaaaatgaatattgaaaatcctaaaggaactgaaaaatattttaaattattccctggaatacttgaaattggtatttttaatcatcaaaatactaaaatcatatactatcaaaatggacaaattaaagaaacttaa

SEQ ID NO: 2791 - DNA, 687 bp, Borrelia turicatae
atggaagaacaaaaaaagttagtttcacaatacgcaattgatcattatgtaaaaagcaacatgcaccttggaattggaacaggaacaacggttttttatgcaattaaatatttaagcaaaaaaataaaatctggggacttaaaaaacctaaaactttacccaacaagtagtgatacaaaatacttacttgcaagagaaaatattacatatgaatccaaatttacaaaactcagcaaaaatatagacataacaatcgacggagccgatgaaattttattagaaacaaaagccctaataaagggtggtggagcagctcatctaatggaaaaaatagtggcatataattctcatcaattattgattattgcagatgaaacaaaaattgtacaaactttaggaacaagagcatctgtaccaattgaaattgttccagatgctcttgcatttattacagcaaacttagcaaacatgaactttaaccctgttttaaggacttgtaagtctaaatcaggaccaataataactgataataataactacatcttagatgtaaaaatgaatgtcgaaaaccctaaaggggctgaaaaatactttaaattactcccaggaatacttgaaattggtatttttaaccatcaaaacactaagatcatatactatcaaaatggacagattaaagaaacttaa

SEQ ID NO: 2792 - DNA, 687 bp, Borrelia hermsii
atggaagaacaaaaaaagttagtctcacaatacgcaattgatcattatataaaaagcaacatgcatcttggcattggaacaggaacaaccgttttttatgcaattaaatatttaagcgacaaaataaaatctggagacttaaaaaatttgaaactttatccaacaagtagtgatacaaaatatttacttgcaaaagaaaatattacatatgaatccaaattcacaaaatttagcaaaaatatagacatcacaattgatggggctgatgaaattttattagaaaaaaaagccctaataaagggtggtggagcagctcatttaatggaaaagataatagcatacaattctcatcaactattgattattgcagatgaaacaaaaattgtacaaactttaggagaaaaagtgtctgtaccaattgaaattgtcccagatgctcttccatttattacggcgaacctagaaaaaatgaactttaaccctgttctaaggacttgtaaattcaaagcaggcccaatcataactgataataataactacatcttagatgtaaaaatgaatattgaaaatcctaaaggggctgaaaaatactttaaattacttccaggaatacttgagattggtattttcaaccatcaaaatactaaagttatatactatcaaaatggacagattaaagaaatttaa

SEQ ID NO: 2793 - DNA, 687 bp, Borrelia afzelii
atggaaaatcaaaaaattttggtagcaaaatatgcaattgatcgctacatcaaaagcaacatgaaccttggaatcggaacaggtacaactgtttatcatgcaataaaatatttaagcgaaaagctaaaatcaggtaacttaaaaaatttaaaattttatacaacaagtagcgatacaaaatatttactctcaaaagaacaaattccttatgaatcaaatttttcaaaacttaacaaaaatttagacattgcaattgatggagctgatgaaattctattagaaaaaaaaagcttaataaaaggaatggggggagcacatctaatggagaaagtaatagcttacaattcagaaacattactaataatagcagatgaaacaaaaattgtaaaaaaattgggaacaaaaatgcctattcccatagaagttgccccaaatgctgttggatttattatgactagacttgaagaaatgaatttagacataaccttaagaatttgcaacgaaaaaaaaggacccattataactgataataataattatattttggatgtaaaaatgcacgtagaaaatcccgaagggacagaaaaatactttaaactatttccgggtatacttgagattgggatatttaatcatcaaaacacaaaaatagtttattaccaaaataaacaaatcaaggaagcctaa

SEQ ID NO: 2794 - DNA, 687 bp, Borrelia afzelii
atggaaaatcaaaaaattttggtagcaaaatatgcaattgatcgctacatcaaaagcaacatgaaccttggaatcggaacaggtacaactgtttatcatgcaataaaatatttaagcgaaaagctaaaatcaggtaacttaaaaaatttaaaattttatacaacaagtagcgatacaaaatatttactctcaaaagaacaaattccttatgaatcaaatttttcaaaacttaacaaaaatttagacattgcaattgatggagctgatgaaattctattagaaaaaaaaagcttaataaaaggaatggggggagcacatctaatggagaaagtaatagcttacaattcagaaacattactaataatagcagatgaaacaaaaattgtaaaaaaattgggaacaaaaatgcctattcccatagaagttgccccaaatgctgttggatttattatgactagacttgaagaaatgaatttagacataaccttaagaatttgcaacgaaaaaaaaggacccattataactgataataataattatattttggatgtaaaaatgcacgtagaaaatcccgaagggacagaaaaatactttaaactatttccgggtatacttgagattgggatatttaatcataaaaacacaaaaatagtttattaccaaaataaacaaatcaaggaagcctaa

SEQ ID NO: 2795 - DNA, 687 bp, Borrelia valaisiana VS116
atggaaaatcaaaaaattttggtagcaaaatacgcaattgatcactatatcaaaagcaatatgaaccttggaattggaacaggtacaactatttattatgcaataaaatatttaagcgaaaagctaaaatcgggcaatttaaaaaatttaaaattctatacaacaagtagcgatacaaaatatttactctcaagagaacaaattccttatgaatcaaatttttcaaaacttaacaaaaatttagacattgcaattgatggagctgatgaaattttattagaaaaaaaaagtttaataaaaggaatggggggcgcacacctaatggagaaagtaatagcctacaattcagaaacattgctaataatagcagatgaaacaaaaattgtaaaaaaattgggaacaaaaatgcctattcccatagaagttgcccaaagtgctgttggatttattatgactagacttgaagaaatgaatttagatacaaccttaagaatttgtaacgaaaaaaaaggacccattataactgataacaacaattatattttagatgtaaaaatgcacgtagaaaatcctgaaggaacagaaaaatactttaaactatttccaggtatacttgagattggaatatttaaccataaaaatacaaaaatagtttattaccaaaacaaacaaatcaaggaagcctaa

SEQ ID NO: 2796 - DNA, 687 bp, Borrelia spielmanii A14S
atggaaaatcaaaaaattttggtagcaaaatacgcaattgatcactacattaaaagcaatatgaaccttggaatcggaacaggtacaactgtttatcatgcaataaaatatttaatcgaaaagctaaaatcgggtaacttaaaaaatttaaaattctatacaacaagtaacgatacaaaatatttactctcaaaagaacaaattccttatgaatcaaatttttcaaagcttaacaaaaatctagacattgcaattgatggggctgatgaaattctattagaaaaaaaaagcttaataaaaggaatggggggagcacatctaatggaaaaagtaatagcttacaattcagaaacattgctaataatagcagatgaaacaaaaattgtaaaaaaattgggaacaaaaatgcctattccaatagaagttgcccaaaatgctgttggctttattatgactagacttgaagaaatgaatttagacacaactttaagaatttgtaacgaaaaaaaaggacctattataactgataataataattatattttagatgtaaaaatgcacgtagaaaatcctgaaggagcagaaaaatactttaaactgtttccaggcatacttgaaattgggatatttaatcataaaaacacaaaaatagtttattaccaaaacaaacaaattaaggaagcctga

SEQ ID NO: 2797 - DNA, 687 bp, Borrelia garinii
atggaaaatcaaaaaatgttggtagcaaaatactcaattgatcactacatcaaaagcaatatgaatcttgggattggaacaggtacaactatttattatgcaataaaatatttaagcgaaaagctaaaatcgggcaacctaaaaaatttaaaactctatgcaacaagtagcgatacaaaatatttactatcaaaagaacaaattccttatgaatcaaatttttcaaaacttaataaaaatctagacatagcaattgatggcgctgatgaaattctattagaaaaaaaaagcttaataaaaggaatggggggtgcacatctaatggagaaagtaatcgcttacaattcagaaacattgctaataatagcagatgaaacaaaaattgtaaaaaaattgggaacaaaaatgcctattcccatagaagttgcccaaaatgcagttggatttattatgaccagacttgaagaaatgaatttagagacaaccttaagagtttgcaaagaaaaaaaaggacctattataactgataacaataattacattttagatgtaaaaatgcacgtagaaaatcccgaaggaacagaaaaatacttcaaactatttccaggtatacttgaaattggaatattcaatcataaaaacacaaaaatagtttattaccaaaacaaacaaatcaaggaagcctaa

SEQ ID NO: 2798 - DNA, 687 bp, Borrelia garinii
atggaaaatcaaaaaatgttggtagcaaaatacgcaattgatcactacatcaaaagcaatatgaatcttgggattggaacaggtacaactatttattatgcaataaaatatttaagcgaaaagctaaaatcgggcaacctaaaaaatttaaaactccatgcaacaagtagcgattcaaaatatttactatcaaaagaacaaattccttatgaatcaaatttttcaaaacttaataaaaatctagacatagcaattgatggcgctgatgaaattctattagaaaaaaaaagcttaataaaaggaatggggggcgcacatctaatggagaaagtaatagcttacaattcagaaacattgctaataatagcagatgaaacaaaaattgtaaaaaaattgggaacaaaaatgcctattcccatagaagttgcccaaaatgcagttggatttattatgaccagacttgaagaaatgaatttagacacaaccttaagagtttgtaaagaaaaaaaaggacctattataactgataacaataattacattttagatgtaaaaatgcacgtagaaaatcccgaaggaacagaaaaatacttcaaactatttccaggtatacttgagattggaatatttaatcataaaaacacaaaaatagtttattaccaaaacaaacaaatcaaggaagcctaa

SEQ ID NO: 2799 - DNA, 687 bp, Borrelia garinii
atggaaaatcaaaaaatgttggtagcaaaatacgcaattgatcgctacatcaaaagcaatatgaaccttggggttggaacaggtacaactatttattatgcaataaaatatttaagcgaaaagataaaatcgggcaacctaaaaaatttaaaactctatgcaacaagtagcgatacaaaatatttactatcaaaagaacaaattccttgtgaatcaaatttttcaaaacttaataaaaatctagacattgcaattgatggagctgatgaaattctattagaaaaaaaaagcttaataaaaggaatgggaggcgcacatctaatggagaaagtaatagcttacaattcagaaacattgctaataatagcagatgaaacaaaaattgtaaaaaaattgggaacaaaaatgtctattcccatagaagttgcccaaaatgcagttggatttattatgaccaggcttgaagaaatgaatttagacacaaccttaagagtttgtaaggaaaaaaaaggacctattataactgacaataataattatattttagatgtaaaaatgcacgtagaaaatcccgaaggaacagaaaaatacttcaaactatttccaggtatacttgagattggaatattcaatcataaaaacacaaaaatagtttattaccaaaacaaacaaatcaaggaagcctaa

SEQ ID NO: 2800 - DNA, 687 bp, Borrelia burgdorferi
atggaaaatcaaaaaattttggtagcaaaatatgcaattgatcactatatcaaaagcaatatgaaccttggaatcggaacaggtacaactatttattatgcaataaaatatctaagcgaaaagataaaatcgggtagcttaaaaaatttaaaattctacacaacaagtagtgatacaaaatatttactctcaaaagaacaaattccttatgaatcaaatttttcaaaacttaacaaaaatctagacattgcaattgatggagctgatgaaattttattagaaaaaaaaagcctaataaagggaatggggggtgctcatctaatggagaaagtaatagcctacaattcagaaacattgctaataatagcagatgaaaccaaaattgttaaaaaattaggaacaaaaatgcctattcccatagaagttgcccaaaatgctgttggatttattatgactagacttgaagaaatgaatttagaggcaaccttgagaatttgtaaagaaaagaaaggacccactataactgataacaataattatatcttagatgtaaaaatgcatgtggaaaatcctgaaggaacagaaaaatatttcaaactatttccaggtatacttgagattggaatattcaaccataaaaacacaagaatagtttattaccaagacaaacaaatcaaggaagcctaa

SEQ ID NO: 2801 - DNA, 687 bp, Borrelia burgdorferi
atggaaaatcaaaaaattttggtagcaaaatatgcaattgatcactacatcaaaagcaatatgaaccttggaatcggaacaggtacaactatttattatgcaataaaatatctaagcgaaaagataaaatcgggtagcttaaaaaatttaaaattctacacaacaagtagtgatacaaaatatttactctcaaaagaacaaattccttatgaatcaaatttttcaaaacttaacaaaaatctagacattgcaattgatggagctgatgaaattctattagaaaaaaaaagcttaataaagggaatggggggtgctcatctaatggagaaagtaatagcctacaattcagaaacattgctaataatagcagatgaaaccaaaattgttaaaaaattaggaacaaaaatgcctattcctatagaagttgcccaaaatgctgttggatttattatgactagacttgaagaaatgaatttagaggcaaccttgagaatttgtaaagaaaagaaaggacccactataactgataacaataattatatcttagatgtaaaaatgcatatggaaaatcctgaaggaacagaaaaatacttcaaactatttccaggtatacttgagattggaatattcaaccataaaaacacaagaatagtttattaccaagacaaacaaatcaaggaagcctaa

SEQ ID NO: 2802 - DNA, 687 bp, Borrelia burgdorferi
atggaaaatcaaaaaattttggtagcaaaatatgcaattgatcactatatcaaaagcaatatgaaccttggaatcggaacaggtacaactatttattatgcaataaaatatctaagcgaaaagataaaatcgggtagcttaaaaaatttaaaattctacacaacaagtagtgatacaaaatatttactctcaaaagaacaaattccttatgaatcaaatttttcaaaacttaataaaaatctagacattgcaattgatggagctgatgaaattttattagaaaaaaaaagcctaataaagggaatggggggtgctcatctaatggagaaagtaatagcctacaattcagaaacattgctaataatagcagatgaaaccaaaattgttaaaaaattaggaacaaaaatgcctattcccatagaagttacccaaaatgctgttggatttattatgactagacttgaagaaatgaatttagaggcaaccttgagaatttgtaaagaaaagaaaggacccactataactgataacaataattatatcttagatgtaaaaatgcatgtggaaaatcctgaaggaacagaaaaatacttcaaactatttccaggtatacttgagattggaatattcaaccataaaaacacaagaatagtttattaccaagacaaacaaatcaaggaagcctaa

SEQ ID NO: 2803 - DNA, 687 bp, Borrelia burgdorferi
atggaaaatcaaaaaattttggtagcaaaacatgcaattgatcactatatcaaaagcaatatgaaccttggaatcggaacaggtacaactatttattatgcaataaaatatctaagcgaaaagataaaatcgggtagcttaaaaaatttaaaattctacacaacaagtagtgatacaaaatatttactctcaaaagaacaaattccttatgaatcaaatttttcaaaacttaataaaaatctagacattgcaattgatggagctgatgaaattttattagaaaaaaaaagcttaataaagggaatggggggtgctcatctaatggagaaagtaatagcctacaattcagaaacattgctaataatagcagatgaaaccaaaattgttaaaaaattaggaacaaaaatgcctattcccatagaagttgcccaaaatgctgttggatttattatgactagacttgaagaaatgaatttagaggcaaccttgagaatttgtaaagaaaagaaaggccccactataactgataacaataattatatcttagatgtaaaaatgcatgtggaaaatcctgaaggaacagaaaaatacttcaaactatttccaggtatacttgagattggaatattcaaccataaaaacacaagaatagtttattaccaagacaaacaaatcaaggaagcctaa

SEQ ID NO: 2804 - DNA, 687 bp, Borrelia burgdorferi
atggaaaatcaaaaaattttggtagcaaaatatgcaattgatcactacattaaaagcaatatgaaccttggaatcggaacaggtacaactatttattatgcaataaaatatctaagcgaaaagataaaatcggatagcttaaaaaatttaaaattctacacaacaagtagtgatacaaaatatttactctcaaaagaacaaattccttatgaatcaaatttttcaaaacttaacaaaaatctagacattgcaattgatggagctgatgaaattctattagaaaaaaaaagcttaataaagggaatggggggtgctcatctaatggagaaagtaatagcctacaattcagaaacattgctaataatagcagatgaaaccaaaattgttaaaaaattaggaacaaaaatgcctattcccatagaagttgcccaaaatgctgttggatttattatgactagacttgaagaaatgaatttagaggcaaccttgagaatttgtaaagaaaagaaaggacccattataactgataacaataattatatcttagatgtaaaaatgcatgtggaaaatcctgaaggaacagaaaaatatttcaaactatttccaggtatacttgagattggaatattcaaccataaaaacacaagaatagtttattaccaagacaaacaaatcaaggaagcctaa

SEQ ID NO: 2805 - DNA, 687 bp, Borrelia sp. SV1
atggaaaatcaaaaaattttggtagcaaaatatgcaattgatcactatatcaaaagcaatatgaaccttggaatcggaacaggtacaactatttattatgcaataaaatatttaagcgaaaagataaaatcgggtagcttaaaaaatttaaaattctacacaacaagtagtgatacaaaatatttactctcaaaagaacaaattccttatgaatcaaatttttcaaaacttaacaaaaatctagacattgcaattgatggagctgatgaaattttattaggaaaaaaaagcttaataaagggaatgggaggtgctcatctaatggagaaagtaatagcctacaattcagaaacattgctaataatagcagatgaaaccaaaattgttaaaaaattaggaacaaaaatgcctattcccatagaagttgcccaaaatgctgttggatttattatgactagacttgaagaaatgaatttagaaacaaccttgagaatttgcaaagaaaaaaaaggacccactataactgataacaataattatatcttagatgtaaaaatgcatgtggaaaatcctgaaggaacagaaaaatacttcaaactatttccaggtatacttgagattggaatattcaaccataaaaaaacaaaaatagtttattaccaagacaaacaaatcaaggaagcctaa

SEQ ID NO: 2806 - DNA, 672 bp, Pyrobaculum arsenaticum DSM 13514
atgtcgaaggctactttggctagagaagctgtgaagttggtgaaaccaggaatggtggtggggctgggctccgggacgacggctcgggagttcataaaggccctggcagaggccagaattgatggggttgtcctagtccccacctccgttgatagtgaaatattggctcaggaggtggggctcggcaatgcgcttaggcccatgtgggcggttgaccacgttgacttagccgttgacggcgccgacgaggtgacgcgagataagctcatcctcaaggggaggggtggggcgcttctcagagagaagatcgtagactacgccgctgacatgttcgtcgtgttgatagaggaacacaagctcgtggagaggatcccaaaggccagccccgtgcctattgaggtggtgccttgggcgtggcgcttcgtagctaggaggattgagagggagttcggcggctccgcccggctgaggaccggcgaggggaagctggggcccgtggtaactgacaacgggaactacatagttgattggactccgcccggcccccttgacgcctctgctgaggaccggctaaaagctgtgccaggtgttgtggagagtggcattttttcaaagaggagagatgccgtggtgttggtggccagacgagacgggacaatcttaagcttttag

SEQ ID NO: 2807 - DNA, 672 bp, Pyrobaculum aerophilum
atgttgaagaggctgttggcaagagaggcgattaggcttgtaaagagcggaatggtagtggggctcggctcaggtactacggcgcgcgagttcataaaagcgctcgccgaggcgggcgttgacgacgtcttgctagtggccacctcgtctgacagcgaaatactggcgtatgaggtagggctgggggacaggctccgccccatgtgggctgtggatagaattgacctagccgttgacggcgcggatgaagtgactaaggacaaggtattgctgaaggggaagggaggggcgttgttgagggagaaaatagtggactatgccgctgagaaattcgtcgttttgatcgaagagcataagcttgtggagagaataccgtcaaacaacccagtgccggtggaggtggtgccctgggcttggcgttttgtggccagagaggttgagaagaggtttggcggcgtcgccaaactacgccaagatggggggaagctggggcctgtcgtcacagacaacgggaattatattatagactggaacccccccggatttattgacccttatcttgaagatgagctcaaggccattccaggggttgtcgaaaatggcgtgttctccaagcggagagatgccacaattttagtggccagctcagacggcacaataaaaacactttaa

SEQ ID NO: 2808 - DNA, 672 bp, Thermoproteus neutrophilus V24Sta
atgggcaaggccttggtggcgagagaggctgtgaaatacattaagagcggcatggtggtggggctcggctctggcacaaccgcccgcgagttcatcaaggcgcttggggagctgggccctagagatgtggccctcgtggccacgtctgtcgacagcgagttgctcgcggtggaggtggggcttggggataggctgaggcctctttgggctgtagaccgcatagacatcgccgtcgacggcgccgacgaggtgacggaggaaaagattctgctgaaggggagggggggcgcgttgctgagggagaaggtggtggactacatggccgagaggtttctagttctgatagaggagcacaagcttgtgcaacatataccggcccgcaaccccatcccaatagaggtcgtgccttgggcatggcgcagcgtggctcgggccgtcgaggcgaaattcggaggcacggcgaagctaaggcaagacggcgccaagctgggccccgccttgacggacaacggcaactacctactggactggaccccgccggggcctgtggagccctccctagaggaggagctgaagctgatacccggggtggtggaaaacggcatattttcaaaacggcgcgacgcaacggtattggtggcaagaggagacggcacgttgaaggttctctag

SEQ ID NO: 2809 - DNA, 672 bp, Pyrobaculum islandicum
gtgttgaaaactatacttgctagagaggctgtgaaatatatagaaagcggtatgactgtgggactcggctctggtacaactgcgcgagagtttgttaaagccctagcggagtttggccctcgcgacgtcgtccttgtagctacgtctattgacagtgagttgttagccatagaggtggggttgggcgataggctgaggcctctgtgggctgtggagactatcgacattgcagtagatggggcagatgaggcgacgcgagataaagtgttgctaaagggcagaggcggcgctttgttaagagaaaagatagttgactatttagccaggcggtttgttgtgttagttgaggaatataaagttgtccagtatatccccacgagaaaccccatacctatagaagtggtgccttgggcatggcgacatgtggcaaaggctattaaagataggtatggcggcgtagctaaacttagacaagacggcggaaagctagggcctgtggtaacagataatggcaattatattatcgattgggagccgtcagcgccaatacaaccctcgttagaagacgagctaaagctaatccccggtgttgtagagacgggaattttttcaaagagacgtgatgctattgtcatagtagctagagaaaacagctctgtatatacattttag

SEQ ID NO: 2810 - DNA, 669 bp, Pyrobaculum calidifontis JCM 11548
atgaaacacctcttggctacccacgcgcttaggtacgtaaaggggggcatggtaattggcttaggctctggcaccactgcgagggagttcataaaggccctcgccgcgctgaggcacttggacctcacgctggtggccacctctgccgacagcgaggtagtcgcctacgaggtaggcctcggggacaggctcaggcccatgtgggctgtggataagatcgacttggcggtagacggcgccgacgaggtgacgagggggaagctcatgctcaagggcaggggcggggctctgctgagggagaaggtggtggactacgccgctgagaagttcgtagtgctcgtggagcggcacaaggtggtagactttatcccagcccgcaaccccgtgcccgtcgaggtcctcccctgggcgtggcgccacgtggctaggcagattgagaaaaaattcggcggctccaccgcgctgaggactggggaggggaagctggggcccgtggtaacagacaacggaaactacatcgtcgactggagaccggaggggcccatcgacgagagggttgaggacgagctaaagcagatacccggcgtcctagagacagggatattctccaagcggaaagacgccgtggtgctagtcgcagacgagaagggcacagtagaggagctctaa

SEQ ID NO: 2811 - DNA, 681 bp, Thermoproteus tenax
atgaagcacttactagcgcgtaaagcagcggagtatataagggaggggagcatagtcggcttgggctctggctccacggctaaggcgtttatagaggagctggcgaagagagtgcgcgaggatggcctcaccgtgactctcgtgtccacgagcgtagacagcgagttaaaggccgcagaggtcgggttggataaatatcttgccccactatgggccgtcgataggatcgatatagccgtcgacggcgcggatgagctgaccagagataggctcttcctcaaggggggtggcggcgctatgttccgcgaaaaggtggtggactatagagcatccacgttgataataatagcggagtcgcacaagcttgtggacaggataccggcgcgacatccaatccctattgaggtgcttccggcggcttggagacttgtggcagacgatattgtgaagaggtggggagggaaggctgtgctgagggtgtgccagtgcgggggaaagctgggccccctcgtgacagacaacgggaactatatactcgattgggcccctcctggccccatcgatcccgctctggaggacgaacttagggggatacctggcgtcatagagagcggtatattctcaaagagacgcgacgcggtagtgttgttggccgatgagcggggagtcttcgagctatag

SEQ ID NO: 2812 - DNA, 672 bp, Thermofilum pendens
atgaagctaaacgccgctagggaagctgcgcgccacgttcgtgacggcatggtcgtggggcttgggagtgggactacagtgaagatcttcatagacgtactcgccgagagggtaaggcaggaaaaccttacaattttctttgtatcctcatccatcgatacaagcctctacgctgccgggaaaggtctactcgaagtaccgctacacgagtacaccccagaggtaagcttcgacggcgccgacaccgtgctaccggataggtccctgatcaaggggggaggagggtgtcttcttagagaaaagatcgtggactactactccaaggagtatgtagtaattgtggatgcgacaaaggtcgcggagaccccaaggaaccttaacgttcccgtagaggtccatcctcaggctttcaagaaggttatggaggagttaaggaagagttacggcgcggtgaacgttacgcttagaacctacgaaaaagggaagctaggaccggtgctaaccgataacgggaactttatcctcgatgcgcttttcgacgaacttaaagacccgttaaggctcgagctttccttaaagagcgtccctggactaatagagacgggaatattctccgtcaaaaaaccatcaaagatcatagtggggtacctgcacggtgtgcaagtgatatga

SEQ ID NO: 2813 - DNA, 690 bp, Caldivirga maquilingensis IC-167
atggatccgaagttagcggcggctaaggctgcacttaagtatgttaggagtgggtacgtgattggtgttggttcaggttccacggctctaatgttcctgagtgaattagccgagaatattgagggaggtgggttaactgatgttaagcttattgccacttcaactgagactgagtatgagattgttaagcttggtctcggtgaattacttaggtatccttggcaggtggatcatgttgatgtggctattgatggggctgatgaagttgataaggataagaacctggttaagggtggtgggggtgcgttaactagggagaagataattgattactgggccagtgaattcatagtaatagttgatgaatctaaactggtggataaaatacccagtaagcatccgataccagtggaggttgtgccgtatgcgtggccattggttaaggctaggcttgagagggattacggtggctcagcggagttaaggtactcctcagggaagagggggccggttattactgataacgggaattacatcattgattacaggcctgggtcaggaatagagcctagggagggtgagagggtgattaaatgtatcccaggtgttgttgaggttggcttatttaatgggcttaaggtgtccagggtgattgtgggtaaacaggatggttcagttaatgaattttaa

SEQ ID NO: 2814 - DNA, 639 bp, Methanopyrus kandleri
ttgagcggcaaacggaacgcggccaggaaagccgcggaagaggtctgccgacgcgggtacgaggtgatcggggttggtgccggcaccaccgtcgaggctttccttgaagagctggtgaagagagaggccgacgtactggtgttcaccacgatacccggcacgatcgatgcttgtcgccgcatcggactgaacgtgactacgataccgcccgaagagctcccggtcgccatcgacggagctgacgccgtggatcccgatggtaacctgctgaaaggaggaggggcctgccactcgttggagaaggcgatagattacaccgccgacgagttctgggtcgtcgtggacgagtcgaagctcgtcgagaacctctgggagctcccggtacccgttgaggtactccgcggctgctacgagttaacagttcggacgctggaggagttcggtgaggtcagaccgagaacgtgtgacgagaagtacgggcccgtggtctcggactcgggtaatcccatcgtcgacctgcatgtggacgactgggatcccgccgagctcgaacgcgagttgaactccgttcccggcgtagttgaatgcggcgtattccccggggacaaggtagataggatcatcgtcgggaggtcgtag

SEQ ID NO: 2815 - DNA, 732 bp, Desulfurococcus kamchatkensis 1221n
atggatgcttcaagcattattgagcaggcgaagttaaatgcctgtgactatgcctgtaggcatctatatgagaaatatggtgatgccttggtagtaggggttggcacgggttcgactgtgaaactgttgatcactaagtgcagggatttcttcaccgagagaatactggtcccctcatcccacgacacactcctccacctggtatccctcggacttaacacggctgtcgatccagctggagtcgatgatatcgatctatacattgatggagccgatgaggtttcgggaaaactagacctcgtcaaggggaggggtggggccttcctaagggagaaatcccttgctgtacgtagtagggttaggatgtatgtggttgactacactaagtatactgggcttaaccacatatacgttaaacctattccgatagaggttgtacctgtctcggtgaaatatgttatcaggaagctacaggagctagggtatggcgagccattgctgagaatgggtactgggaaggatggcccagtggtctctgacaatgggaactttatcgttgactacaggcttttaaagcctgttgaagaccctttatctctccacaacacgcttaaactagtacatggagtgattgaaacaggtatattcccttcaaacctggttgacatcgttgtggtcggggaaccagccggggtcagggtgcttggaaaaaacactggtgggagggagtag

SEQ ID NO: 2816 - DNA, 702 bp, Staphylothermus marinus
ttgtatgagtatttaaagaaattatccagtatttatgcattgagaatgttcattgataaaataagagattccaaagtattagggattggcacgggctctacggttaaatactttatagatgaacttattcggttaggtatgctcaaagataaaaaagtagtggtctcaagttatgcaactcataattatctctacaaacatggaatagatgcttatactccgataaattgtaattatgcggatatatatgtggatggactagacgagatcaatgctaacttagatattataaaggggagaggagccgctcttctgtgggaaaaacaattagctattagaagcaagttgagaatatatattgcagattatacaaaagttaatccagaacagtatctatatatgaaacctgtacctatagaggtagttcctaatgcagtatattatgtaatagaaaaactaactattctaggatataaacctgttctacgcataggaaaaatgaaggacggacctattataactgataatggaaacttcattatagatcttgtctatgaaaaaatacagaatgcaaagcaagtagatgaagaaataaagaaaattaatggagtagttgaaaccggcttatttcctaataaccttgttgattacgtaattgtatcgtatccaggaaacattgtcaaggtatatagtaggcgataa

SEQ ID NO: 2817 - DNA, 714 bp, Aeropyrum pernix
gtgggtggttgtgatcctatggatgaggccgcccggggagcgctcgaccttctaggcaggattggcggggagctcggcgttctcggcgtgggtactggtaggactgtgatgaggtttctccgcgaggccagcgcccgtggggtggagccgggggtggctgtgcccagtagtttcgagactgctgttgagctggctggtttggggtggagtgtgggtgacccccgtgtataccggggggttaacgtttatgttgacggggcggacgaggcagagcccgggagagggtatatggtgaaggggggcgggggggctctgcttggcgagaagatactttcctccaggtcgaagctaaacatattcatagtcggcgaggacaggctcgtggggaggctgggggagaagacgcccgttcctgtggaggtagagcccgggttcgtctcgatggttctcgcaagcctggaggagctgggccttaacccgcgggtgaggacctcgccgggtaaaagggggcctgtggtcagcgactggggcggggttatagtggacctactcacaggccccctggaggaccctcgggggttggagtctatgctcaggaatgtgcctggcgtgagggagacgggcctgttcctcgggctggctgactatattgtcgtggggctgtccagctgcggctacagggttctaggcccctacagggggagggcggtctag

SEQ ID NO: 2818 - DNA, 765 bp, Hyperthermus butylicus
ttgactgcacttgcaaaggtggaggcagctagacgtgcagccgagattctggaacccctcatagagagagctgaaaggataggaattggtacgggctccacagtgaggctcgttcttagattccttatcgagtcgccagctgcatccgcgttgcgccgcgccaaggtatacgcttcgagcttcgacacgctgctcgagctacgcagacttggcattgaggcctatgatttcctgcctcgggacggtctagacgtatactttgacggggctgacgaagttgcaagggtctcggatatgtgtatggccgttaaaggccgcggggcggccatgttgcgggagaagctactagctttcaacagcgcctatacactgctagtggtcgacgagtctaaggtctcgagaaaccttggtgacaaggggaagccggtacccgttgaggttgtaccgccagcggttgaaaccatagtagaggagttcgaatcaaggggtatacgtgcggaagtgaggacaaactgtagctgtagggatggcccagcctttactgacaactatggcatcgtcatagacacgtggccctggggcgttatgagccccatacagtatgagtcgctgcttgacactcttcccggcgtaatgggccacggtctattcataggctacatggacgctatagtggtgggctacggtgacggtagaagcgaggagtggaggtgtagacgcacaaggctatctgctggcgcgaaggctaggagagctgagagatag

SEQ ID NO: 2819 - DNA, 666 bp, Ignicoccus hospitalis KIN4/I
ttgagcgggaaggaggcggtcgccaggagggcggcggagctggtcgcctcggaggccccggaggtgttgggcgtaggctccgggactaccgtgaggctgttcataaagtacctcaaggagttcggcttctccggcttgacggtcccgaccagctacgacacggccttggagctcaagaagcacgggcttaaggttttggacttaatgagcgtggatgaggtggagctcagcgtcgacggggcggacgaggtcttcacaatgaacggctctctgtacgccgtgaagggcggcggggcggcgatgctcagggagaaggtcctcgcttacatctctaggaagaggatctacatcgtggacgaggggaaggtgtcgggctccccgtgctcccgaggggtcccggtcccggcggaggtggtgcccagctccttgccggcggtggcgagggggctgaagctcttgggcgtggggtggaagttgagggaggcgaaggggaagctcggcccggtggtcacggacaacggcaacttagttatagacatggactgcaagagctcaattaacgtgatagaaaaggtggaggccttgccgggggtggcggtcaccgggcttttcggccctgacctcatcgacaaggtcgtggtcggcgagaggggggagctcccttga

SEQ ID NO: 2820 - DNA, 684 bp, Sulfolobus islandicus
gtgaatccaaaggaattattggcaacgtatactttgaactatctaagagaaaagaagataataggtgttggtacaggaaaaactgttaaaaaattgatagaagttttgagtaaagaagaaaatcttaaagaaactgtattgttcgttgcgagttcgctcgatactgaaatcgaattgagtaaacacggttttaaagtaatttcactcctttccgctattcaacctgaaatttacgttgatagtttcgatgtagttaccaaagacggtataatgataaagggtggaggaggtgccttgcttagagagaagcttttaacatatttttctaagtataggatttttataggagaattcaataagttaaaggactctaaactaattgacgttccaattgaggtcgtaagcgtcggcgtaagttatgtcaaagataagctagagaaaatgggatttgctgtaaaaataagagagggaagcggtaaaatgggaccaattatttcagataatggaaatgcgattttagatgtttctgttaagactgaaaatttatgcgagtttgacagaatgataaagaccattccatcagtagtagaaactgggattttctgtaaggaattatataataagataatattggctaatgaagaaggtaggattgaggaaatgtatgcgggggacgggatttga

SEQ ID NO: 2821 - DNA, 684 bp, Sulfolobus islandicus
gtggatccaaaggaattattggcaacgtatactttgaactatctaagagaaaagaagataataggtgttggtacaggaaaaactgttaaaaaattgatagaagttttgagtaaagaagaaaatcttaaagaaactgtattgttcgttgcgagttcgctcgatactgaaatcgaattgagtaaacacggttttaaagtaatttcactcctttccgctattcaacctgaaatttacgttgatagtttcgatgtagttaccaaagacggtataatgataaagggtggaggaggtgccttgcttagagagaagcttttaacatatttttctaagtataggatttttataggagaattcaataagttaaaggactctaaactaattgacgttccaattgaggtcgtaagcgtcggcgtaagttatgtcaaagataagctagagaaaatgggatttgctgtaaaaataagagagggaagcggtaaaatgggaccaattatttcagataatggaaatgcgattttagatgtttctgttaagactgaaaatttatgcgagtttgacagaatgataaagaccattccatcagtagtagaaactgggattttctgtaaggaattatataataagataatattggctaatgaagaaggtaggattgaggaaatgtatgcgggggacgggatttga

SEQ ID NO: 2822 - DNA, 684 bp, Sulfolobus islandicus
gtgaatccaaaggaattattggcaacgtatactttgaactatctaagagaaaagaagataataggtgttggtacaggaaaaactgttaaaaaattgatagaagttttgagtaaagaagaaaatcttaaagaaactgtattgttagttgcgagttcgctcgatactgaaatcgaattgagtaaacacggttttaaagtaatttcactcctttccgctattcaacctgaaatttacgttgatagtttcgatgtagttaccaaagacggtataatgataaagggtggaggaggtgccttgcttagagagaagcttttaacatatttttctaagtataggatttttataggagaattcaataagttaaaggactctaaactaattgacgttccaattgaggtcgtaagcgtcggcgtaagttatgtcaaagataagctagagaaaatgggatttgctgtaaaaataagagagggaagcggtaaaatgggaccaattatttcagataatggaaatgcgattttagatgtttctgttaagactgaaaatttatgcgagtttgacagaatgataaagaccattccatcagtagtagaaactgggattttctgtaaggaattatataataagataatattggctaatgaagaaggtaggattgaggaaatgtatgcgggggacgggatttga

SEQ ID NO: 2823 - DNA, 684 bp, Sulfolobus solfataricus
gtggatccaaaggaattactagcaacgtatactttgaactatctaagaggaaaaaagataataggcgttggtactggaaaaactgttaagaaattgatagaagttttaagtagtgaagaaaatcttaaagaaagctcattatttgttgcgagctctatcgatactgaaatcgaattaagtaagcgcggttttaaagtactttcccttttctccgctattcaaccagaaatttacgtcgatagcttcgatatagttaccaaagacggtattatgataaagggtggaggaggtgccttgcttagggaaaaacttttggcatacttttctaaatacagaatttttataggagaatctactaaactaaaagacactaaagtgattgatattccaattgaggtcataagcgttggagtaagttatgtcaaatacaaattagagaaaatgggatttaccgtgaaaataagggagggaagcggtaaaatggggccaattatttcagataatggaaatgtgattttggacgtttctgttaaaactgaaaatctatgcgagtttgacagaatgataaagaatataccatcaatagtagaaactggaattttctgcaaggaattatataataagatcatattggctaatgaacaaggtagaattgaagaaatggatgcgggggacgggatttga

SEQ ID NO: 2824 - DNA, 660 bp, Sulfolobus tokodaii str. 7
atggacccaaaagaagtagtagctcgctttattgttgataaattaaaggagcataaactaataggcttaggtacaggtaaaacagtaaagaaactaatagaagttttaagtgaagaaggtcttctaaaggaaaagatatttgtggcaagttcaatagatacggagttagagattagtaagagagaaggaatagtgatcaccttatattctggtttaagacctcaagtatatatagatagttttgatttcgtaacttctgataagattatgattaaaggtggaggagccgctttgcttagagaaaaaatgttatacacattctctaaggaaaaagtatttattggtgaagagttaaaacttaaggatttaaaagagtattctgttcctgttgaggttgtaccagtaggagtagcatacgttatttcagctcttaaagaaagaggctatgaagcaaaaataagagagggaaatggtaaaattggtcccataatctcagataatgggaatataattttagatgttattgtaaagagggaaaatttatgtgattttgaaagattggtaaaagaaattcctgcaataattgaaagtggtatattttgcaaaaaagattatgaaatttacttggctaacgaaaatgggaggattagtattttgtga

SEQ ID NO: 2825 - DNA, 663 bp, Sulfolobus acidocaldarius
atggatccaaaagaaatattatctcaatacgtctccaaaagattaacaggttatagtataataggcttaggtacaggtagaacagtgaagaaattaatagaacatttagatcgagaaggcattcttaaccagtttaaatacatagctagttcaattgatactgaattggaaatatcccagagaggaggtttaattttatcattgtactcagggattcaaccggatatatacatagatagttttgacgtagttacaaaggataaagtaatggttaaaggtggaggcgcagcattattgagagaaaagattttgactactttttctaaatcatccctctttataggcgagtataaaaaactagtaaagatagagcagcactcagtgaaggtacccgtagagatagttccagtatctattatgtatattttaaagaaaattaatgaaataggctttaaaaccagtatcagagagggaacaggaaaaatgggaggaataataagtgacaacggaaatatgataatagatgtagaggtaagaataaatcagctttgcgagtttgacaaaaccataaaaagcatacccggaataatagaaacaggcgttttttgcaataaatatgatgtggtacttgcagacgaagatggtaggatagaaatactctaa

SEQ ID NO: 2826 - DNA, 684 bp, Metallosphaera sedula
atgaccgatcccaaggaagtcctggctcactatatcctgccaattctagctaacaagagggtaattggtctgggaacaggtaaaacggtacggaagttagtagaggtgatggctcttcagggttctctgcagggcaggatactagtaaccagctcaactgatacggacctattagcctccagcaaaggagcactggtactatctcccttttccggggttattccagagatttacgtagatggctttgactttctggttgaatctcagggaaggaaggttctcattaagggaggaggggctgccctactaagagagaaaatactatcatttttctcaaaagaaagaatatttataggagagacatctaagttcgtgtccagaagggagatccaggttccggtggaagtggtacccgctggcttctcgctaatcttagtgaggctaaacgagatgggccttaaacctgttccaagagagggttccggtaagatgggcccagtggttacagataacggtaacctaatccttgacattagtgtaatggtggaggacctatgtaaatgggagagggagctcaaaacaattcctggagtggtggaaacgggtatattttgtgaaaacctatatgattccatagtgattggagatagcgaaggaagaatccaagtattccagagaggctga

SEQ ID NO: 2827 - DNA, 606 bp, Nosema ceranae
atgttaaaaaacaatataaaagatgtgtgtgaagataaacacactataggcataggcacaggcagaacagtagaaagcattcttcaatatctaaaccctaatagcacttatgtatcttctagtcaccagacatctatcagtcttactaatctttctctaaaaagtgtgcctattgaaactgtacaacgtctagatttgtacattgacggatgtgactatttcgacagggaagggaatatgattaaaggtaaaggtgggtcactcacaaccgagaaattgttgtgttctatggctgatgaggtagttatagtagtacaagattataaatatagaaagagatttaataattgttatgttcctattgagatattaccacagagtataaaatatatagaaaatattttaattaaaaacggtattaaatatgaattgagatgcagtaaaaataagtttggtcctgtgataacagatttagggaattttattattgatattgtgtatgatagagagtttttaataagaagtaagcaaatatgtggtgtagtggaacatggatactttgagaataaggactataatattaaagtagaggtatttaaagaataa

SEQ ID NO: 2828 - DNA, 606 bp, Encephalitozoon cuniculi
atggatcgagggtttccgaaatgcattgcgaataagacagtgattggaattgggacaggcactacagttgaaagatacatagatgcattacatcacgacgcgacgtatgtaccctccagcattaggacggcactgatacttagcgaaaaaggctttaccgtttcaagtcctttggcccatggagtcctagacctatacatagatggggcggattactttgacaagaatgggaacatgattaagggagggggaggggcattgaccacagaaaagctgctttactccatggccaaagagaccattataatagttcagagtcacaaatacagggaaacatttgatggatgttttattcctgttgaagccattcccacatctcttttgaaacttatttcaaccctagaaggaagtgggttgaagtattgtttaagggagactgatggaaagatgggaccattgatcaccgacttagggaactgcatagttgatgtagaatatgacgatgtatttatatcatcgtgcaagagcatttgtggtgttgtagagcatgggctgttcgagtcggttggaaataccacaattgtcgaagaagatggaaacaattga

SEQ ID NO: 2829 - DNA, 684 bp, Clostridium acetobutylicum
atggcaaaggataatctaaaaaaaatatctgctaagaaggctttagaatatataaaggataacacggtaatagggctcggcggaggagagacaataggatatttatgtgattatttaaaggaaaaaattaaaagtggtttcaatattaaagtggtaacaccatctataaaaactagaaacacctgtattgaaaatggtattgaggttttatatacatcaagtgttgaacatttggatgtggcttttgatggatgtgatcagcttgatgaaaaattaaacgcccttaaaagctgtggaggaatacattcaaaggagaagattattgcttctatggctgataaatatattttacttactaatgaaagtaaattcgtaaagaaattagattctacataccctatagttttagaaatattggaggagtcagcaggttatgttaaaagaagaataagtgaaattggtggaaaagcaacctttagatcaagtgctgcaaaggatggattcactataacggatagtggaaatctattgttagatgtattctttgatgaattaggagatgctaaggaacttcaaaaggggcttaagggtataacaggagttgttgaaacttctttatttgtggatttagtaagtcaggcgataatagcttatgaagatgatataaagattatttctaaataa

SEQ ID NO: 2830 - DNA, 681 bp, Clostridium beijerinckii
atgagtgataacgatttaaagaaaaatagtgctaaggaagccatgaaatatataaaagatgggatgatagtaggtctaggtggagggcggagcatagcttatttaatagaatttataaaacaggacaaaaatattaacgtaaagatagttactccttcagtgaaaacaaagatgctttgtatagaaaaaggtttagaagttttgtacacaagttctgtggataaagtggacgttgcttttgatggctgtgaccaagttgatgaaaaattaaatgcattgaaaagtggtggaggaattcatactaaggaaaagttaattgctagtatggcggaagaatatatccttcttgttgatgaggcaaaagttgaaaaagagttaacatttaatgttccggtagtacttgaagttttagaggattctttgaagtatgttgaaaaaaaagtactagaattaaatgggaaaccagtgattagaagtagcgatataaaagatggatttactataagtgataatggcaacctattagtagatgtattctttaataatgtaaaagatattcataaactaaatgataatctaataagaatttgtggagttatagaaacgtcattatttactaatgtaatcacaaaagtgattattgctagtaaggaaggtattagggaaatttcacaaaaataa

SEQ ID NO: 2831 - DNA, 681 bp, Clostridium butyricum
atgatttttatgaaaaagaaatgtgcaatggaggccttaaaatatataaaagataagtctattataggacttggtggagggagtactatttcatatcttgtttcttatattaaagagacaggattggatgtagagattgtaacaccatcatcagtaacagaaagacaatgcattgaaaatggattaaaagtagtacctgcatgggcagttgattctatatcagttgcatttgatgggtgtgatgaaattgataataatctaacggcattaaaaagtggaggcggtattcatacaaaagaaaaaataatagcatccatggcagaagattatattttgcttgttgatgaaagtaaggtggtagaaaagttagattttaaatatccagtagtcttagaaataatacctgaaagtataaaaatagttgaaaaaactgtaaagaaacttggtggtaatactgttatgagaagcagcagttctaaagatggatttacaagaagtgatcatggattgtttttaatggatgtgaactttaatagtgaagatgtagatgatatctcggtattgaatgacaaactaaaaaaaatagtaggagttgtagatacatctctattttataatattgcaaccaaggcaatagttgcaggagaaaacggtgtacgaataatggaatgtgaaaggtaa

SEQ ID NO: 2832 - DNA, 666 bp, Clostridium spiroforme
atgaataatttaaaagaaaaatgtgctttagaagcattgaaatatattaaagatcaaagtattgttggtttaggtggtggtagcacaattgcttatttagtagaatttttagctaaaaaaaatttagatataaagattgtaacaccatcttatcaaacagcaatgttatgtttaaaacaccaactttgtgttgtacctacatggtcagttgaccatgtagatattgcctttgatggttgtgatgaggttgatttaaaattaaatgcattaaaatcaggtggggcaattcatacaaaagaaaaaattattgcttcaatggctgatgattatgtgttattagtagatgaatcaaaggtatttgaaaaattgccttttgatcatgctataacaattgaaataattcctgaaagtataaaatatgtacaaaagagattagaaaaattaggagctattgtttctatgcgtcaaagtaaagctaaagatggttatactataagtgaccatggaatgtttattatggaagctaaatttaaaaatgttgaagatattcaagaattagataataatttaaaaaagattacaggaattgttgatacatcattatttgtaggtaaagtgaattttgttttatcaattgatgatgatggttatattcgtaagttttaa

SEQ ID NO: 2833 - DNA, 681 bp, Eubacterium biforme
atgattatgaaaaagaaatgtgcattatatgcatcaaaattagtaaaggatggtatggttgtaggtctaggtggcggtagtaccatatcgtatttaattgattatgtaaaagataaagatatcaaggtggtatctccttcttctaagactgtattattagctcaaaagatgggtttaactgtattaaatacgcaatatgtagatcatgtggatattgcctttgatggttgtgatgaagtggattcgcatttaaatgctttaaaaagtggtggtggtattcatacgcaagaaaaaatcattgcgtctatggctggtgaatatatcgtattggttgatgaaagtaaatttcatgagactttggcatttaaagtgcctgttgtagtagaagtattgcctaaggcttatagtattgtaaagaaaaaaattgaaaaattaaatgggaatattgagttgcgtacagcttcaaataaagatggatttctaatgagtgatgaagggaatatcttattagatgtctattttgatggggttcaagatattcgtttgttgaatcaaacattgttgatgatgccaggtgttgtggacactagtttgtttgtggatatacttactggaatgattctagtcaatgataagggcgtatttaaaaaagaaagaaatggagaattctatgcattataa

SEQ ID NO: 2834 - DNA, 693 bp, Bacillus coahuilensis m4-4
atgatggacaagaaacaacaatgtgccaagaaagcaatggactatattaaggatggcatggtgattggactcggtggaggaagcacgataaagcacctgatcggatatattgctagaagtgataaggaagtgaagatcattaccccctcttttgaaactagacaacattgtatcgaagcaggattaagggtactctctacttcagatgtgggcgaagtgagtgttgcatttgatgggtgtgaccaagtagatgagcagttccattcattaaagagtggaggggggatacatacagaagaaaagctgatcgcaagcatggcgaatgactacatactactagttgatgattcaaaatatgtacctacattgacctacgatcacccagtagtactggaagttcttccacaagctttagcatttgtgaagagacagctggaatcgttctcaacgctaggtggggcacttcgtatgagcaaagatagggatggagcagttcttacggaaaacggcaattacttgatagacgtacgtttcccgcctcaagaaaatagcaggggattggagcaatctttaaaaggcttgcctggtgttgtcgaggtatcattatttacggcggttgtgtctaaagtactcgttgctacagataatggtgtaagagaagtagcaagtcggagggacagggggattgtctga

SEQ ID NO: 2835 - DNA, 663 bp, Catenibacterium mitsuokai DSM 15897
atgaagaaaagaagtgcaaaagccgctttagaacttattgaagatggtatgattgttggtcttggtggtggagaaacaattggctatcttgttgaatatttaagtcattctcataaagatgtcaaggttgtaacaccttcgtttgcgacagaacaggtttgcattcaatctggacttgaactattaccactctggtcagtcaatcatgttgatttatcttttgatggctgtgatgaagtggatcaggatatgaatgcattaaaatcaggtggggctattcagacaagagagaaattgattgcctctatgagtgatcgttatattttattgcttgatgaatcaaagtattttgttactttaccatttttacatgatattacatgtgaagtgctcaaagaagcttatagttatgtatcaagaaaaattaaagaaatgggtggaaaacttattttaagaccaaataagagtaaagcaggaccggtcataagtgatgatggacattttattgtagatgtacattttgatacaatagaaaatataaaagaattaaataataaacttaataatattgaaggacttattgcgacttctctatttgtaggattagtgactgatcttattatttctaataaagaagaaacatacagaataggaggaaaataa

SEQ ID NO: 2836 - DNA, 702 bp, Eubacterium hallii
gtgacagaaaaaggagacagaataatgaacatgaaacaattatgtgccaaagaagcactaaaatatataaaagacggcatgtgtatcggacttggcggtggttctaccataggatatttagcagagtatcttgccaaagaggagagaaaaataacggtagtaactccatctgatgatacagcagaactttgtaaaaacttaggacttatggtattatcactggaaatgacagctcatatcaacattgctttcgatggttgtgatgagcttgataaagagttaaatgcgctgaaagcgaatggcgcgattcatacaaaggaaaaaattattgcatccatggcagaaaaatatgttttgttaattgatgaatctaagttttatgatacattaccgttaaaagattctgtgacattagaagtgattccacagagcagaaactatgtgcaggcacagatagaaaagcttggtggaaaggcagtaatgcgaaagagtggtgccaaagcgggttttgttattagtgataatggaaattatataatggatactgatttttctaatgtagccgcatttgcaggaaaaccagaagaacttcatcagaagttaaagcagcttactggagtggtggagacagcattatttattgatgtggtagcatttgctctttgtgtgtgcggggatgaagtaaaagtcatcgaaaaataa

SEQ ID NO: 2837 - DNA, 618 bp, Clostridium sp. SS2/1
gtgaaacgtttatgtgcaaaagcggcacttgatcttgtgccagatcatgggattatcggacttggtggtggagagacgatcagttatcttgcagaagatatcaaagaagcaaggaaagctgtcaaagttgtgacaccatcagatcatacagcacaagtatgtaaaaagcttggattagaaattgttgataccaaagaagtaaaagagatcgaaattgcatttgacgggtgtgatcaggttgattctgatcttgatgcatataaaagtggaggcggaattcacacattagagaagattattgcaaagatggcaaaagaatatgtattactggtcgatgaaacgaaagtaacagataagttaaataataaagtaccagttgtattagatattattccagaagcagtgaactatgtgacaagtcaggtggaagcaatgggtgcaacagtgaagaaacgtgatgaacatttactggaagtttattatgacactttaccagaactagaagagattgacaaaaacttaaagatgatcacaggggtaatcgagacatcattattttatcaggttgcaacaaaagcattggttgcaggtgaagaaggaatcagagtgatcaagtaa

SEQ ID NO: 2838 - DNA, 708 bp, Chitinophaga pinensis DSM 2588
atgacagactataaactggaagcagcgaaagcagcagcattaatgatcagcgccggacaaacgatcggtctcggagggggtaaaacaattgcgtacctggtagagcaactggcagctcagccggccttacaggcatcgctgacggttacctcttcgtcatttgatacgaccgcattattgcatgaaaaaggatttaaactggtagcgcccgcgtttgtcggcagactggatatttacttcgacggatgcgatgtatttgatgcgaacctgaacgcattgaagagcggaggaggtattcatgtgatggagaaattactggcttcagcagcagataagtttgtattactgggagatgaaagtaaagcacagccgaaactggatacgaaatatccaatggttgtagaattgctgccacaggccctggagatcgtcaaacaggcaataacggcacggtatccgcaaacgcggtttgtgcaacgtatgagcactggtaagataggagcgttgatttctgataatggtaatctgctggcggacgtatattttgaagcattccctgatctggaacagctggatatacaggtgaaaatgctgccgggagtggtgggacattccctgttctttcaaatggcacagcaggccgtgatagcaggagaagaaggtgtgaagtatatatatcctgctgttaaccaccaggtcaacggctaa

SEQ ID NO: 2839 - DNA, 684 bp, Pedobacter sp. BAL39
atgaataattataaacagcaagctgcaacggaagcattcaaactcatttctaaaggacaggtcatcggactgggagccggaagcactattgcttatcttgtgaagaccatagctgcagatcatgccctcgccagcacattgacattcagctcaccttcttatgatacggttattatgttgaatgatcacagacttaatgttaagccttccgactttctacaaggggtagacttgtatttcgacgggtgtgaccagctggattggcagcttaatgcgttgaaaagcggtggaggaatacatacctatgaaaagattcttgcggtaatggcggatgagtttgtcctgctcggagattacgggaaattggtggaacacctggatgtcacctatccactagtcatcgaagttctgccgcaagccctgaatgtagtgtcggcgatacttcgtaaacaatttaaaggcatctcgctgataataaggaccggagatcaacgtgtggggccagtaaggaccgacggaggctgttacctgatcgatgcctcctttgtaactttacctggattggaactgctggatcaaatcaaaatgatccccggcgtagtggatcactccttgttttttaagctggcggataaagccatccttgcagggcctgaaggaataagaacaattacccaaaaatga

SEQ ID NO: 2840 - DNA, 669 bp, Lactobacillus plantarum
atgacgattaaacaggcaattgttcaacaagccttgacgttaataaaaccgcaaatggttgttggttttgggggtggctcgacggttggtgaactggtcaaggaggcagccaatcatgtgaatgatattacggtcgtcaccccatcaccgacgacccgccaacttgcgaccgttctcgggtataccgttgtagatactgcatattgtgaccgcgtcgatattgcttttgacggctgcgatcagttagatcatcacggtaacgcgctcaaaagtggcggtggaatccatgctaatgagaagattattgccagcttggcggatgaatattggctgttaacgatgcaggaccggttagtcgatcaatttgatatcaagacgccactagtcttagaagtactgccagcggccttatcgttagtcatgcggacggtgagtgatcttggtggtcaggcaaccattcgaactgctaataatcgggatggcttcacgttaaccgatagcggcaatttattgatcgattgtcattttccaacgtatgccaaacttacggacctgaatgttgaattagcaactttggctggcgttgttgaaacgagctattttgatcatttggtgacgaatgcttggttgggtgatgcgaccacgaatacagtcaaagcgctattttaa

SEQ ID NO: 2841 - DNA, 669 bp, Lactobacillus plantarum
atgacgattaaacaggcaattgttcaacaagccttgacgttaataaaaccgcaaatggttgttggttttgggggtggctcgacggttggtgaactggtcaaggaggcagccaatcatgtgaatgatattacggtcgtcaccccatcaccgacgacccgccaacttgcgaccgttctcgggtataccgttgtagatactgcatattgtgaccgcatcgatattgcttttgacggctgcgatcagttagatcatcacggtaacgcgctcaaaagtggcggtggaatccatgctaatgagaagattattgccagcttggcggatgaatattggctgttaacgatgcaggaccggttagtcgatcaatttgatatcaagacgccattagtcttagaagtactaccagcggccttatcgttagtcatgcggacggtgagtgatcttggcggtcaggcaaccattcgaactgctaataatcgggatggcttcacgttaaccgatagcggcaatttattgatcgattgtcattttccaacgtatgccaaacttacggacctgaatgttgaattggcaactttggctggcgttgttgaaacgagctattttgatcatttggtgacgaatgcttggttgggcgatgcaaccacgaatacagtcaacgcgctattttaa

SEQ ID NO: 2842 - DNA, 666 bp, Lactobacillus johnsonii
atgtcactaattagtcaaaaagcacttagtaagattaaacccaatatgagtattagtttgggtggtggaagcaatgtgctgaatctcgcaaaagatctatgtcaagcacacatttcgaatctaacactctattctccctctgaaataactcaagctaaatgtaaacaatttggattaaaggtactaccttttagtgaaaactcatctcacttagacctagcctttgatggatgtgatagcattgataaaaatttcaatgctctaaagagcggtggtggtatccatctttttgaaaagctagccgctgaaaatacggaagaatatatcttattgcttccagcagaacgatttagagatgaactatcccctactattcccctctgtcttgaggtagtccccgcttgtcttgaaaatgtaataaactctattcctgaagaatacgactataaaattcgtctgggtaaagcagtagcatcctttgcgcgatcaccattgggtaatattttaattgatatttatcctcacacttcttggaataatataaaaaagctgaacagttttctcctaaaacaaaatggagttgtaagtagttcatattttgaaggaattgttaccagcattataaccgaaactaaaaataaagcagttgaaataaagaaaggataa

SEQ ID NO: 2843 - DNA, 666 bp, Lactobacillus johnsonii
atgtcactaattagtcaaaaagcacttagtaagattaaacccaatatgagtattagtttgggtggtggaagcaatgtgctgaatctcgcaaaagatctatgtcaagcacacatttctaatctaacactctattcttcctctgaaataactcaagctaaatgtaagcaatttggattaaaggtactaccttttagtgaaaactcacctcacttagacctagcctttgatggatgtgatagcattgataaaaatttcaatgctctaaagagcggtggtggtatccatctttttgaaaagctagccgctgaaaatacggaagaatacatcttattgcttccagcagaacgatttagagatgaactatcccctactattcccctctgtcttgaggtagtccccgcttgtcttgaaaatgtaataaactctattcctgaagaatacgactataaaattcgtctgggtaaagcagtagcatcctttgcgcgatcaccattgggtaatattttaattgatatttatcctcacacttcttggaataatataaaaaagctgaacagttttctcctaaaacaaaatggggttgtaagtagttcatattttgaaggaattgttaccagcattataaccgaaactaaaaataaagcagttgaaataaagaaaggataa

SEQ ID NO: 2844 - DNA, 666 bp, Lactobacillus gasseri
atgtcaataattagtaaaaaagcgcttagtaaaatacaacctaatatgaccgttagtcttggtggcggaagcaacgttttaacgctagctaaagacttgaataacgcacaaataccaggcttactcctttactcaccatctgagattactaagtttcaatgtgagcagcttggattaaatattttagctttaaatgacaatatgcctaaatttgatctagcatttgatggttgtgatagtattgatcaaaattttaacgcattaaaaagtggtggcggaatccatctttttgaaaaaatagccgctgaaaatgcaaaagaatatattttattattaccaaaagaacgttttaaagagacgcttaatcctactatttccttgtgtattgaaatcattccaaattgtttaaataatttaatgaaaaaaataccccaaggatatacagctaagattcgtttgagccagtcagtagcatcattcgctcattcaccattgggcaatctcttaattgatatttatcccaacaattcttggtcagacattgaacaattaaatgattttcttctaaagcaaaatggcgttataagtagttcttattttaaaaatcttgttacaagtattattaccgaaaacaacaatgaagcaattgaaataaagaaaggataa

SEQ ID NO: 2845 - DNA, 684 bp, Lactobacillus crispatus
atgaaaattaattcgataagtgacctcgctttaagtaaaatcaagccgaaaatgactatttctcttggcggcggaagcaatgtatttaagttatctcaagcgattgcacagcataacttagacatcacattatattctccatccgaacttactcgctttaggtgcaaagaactcggattagagcttcttccatctactgcagcgactaagatcgatattgcttttgatggttgtgacagcattgataagaattttaacgttctaaaaagtttgggtggaattcatctttttgaaaaacaggcagcacaaattgccaaacagtttatcctactcttacccagtcaaaggatacaaccgattctgaatcctaaaattccactttgtcttgaagtggcaccgccttgtgttaatcaagtacagaagtatttaagcagtttacatttaactagtaagattcgacaagatagttcagtagctgcatttgcccgtacgcctttgggcaactacttaatcgatgtttttaacgaagattggcacaatatcactgaacttaatcgtcaactttgtttacaaaatggcgtagttagttcttcactatttgaaaacttaactacttcattaattactgaaaaagacggagaaattattgaacttaagagaggtaataatcatgaaaacatttaa

SEQ ID NO: 2846 - DNA, 633 bp, Lactobacillus crispatus
atgactatttctcttggcggcggaagcaatgtatttaagttatctcaagcgattgcacagcataacttagacatcacattatattctccatccgaacttactcgctttaggtgcaaagaactcggattagagcttcttccatctactgcagcgactaagatcgatattgcttttgatggttgtgacagcattgataagaattttaacgttctaaaaagtttgggtggaattcatctttttgaaaaacaggcagcacaaattgccaaacagtttatcctactcttacccagtcaaaggatacaaccgattctgaatcctaaaattccactttgtcttgaagtggcaccgccttgtgttaatcaagtacagaagtatttaagcagtttacatttaactagtaagattcgacaagatagttcagtagctgcatttgcccgtacgcctttgggcaactacttaatcgatgtttttaacgaagattggcacaatatcactgaacttaatcgtcaactttgtttacaaaatggcgtagttagttcttcactatttgaaaacttaactacttcattaattactgaaaaagacggagaaattattgaacttaagagaggtaataatcatgaaaacatttaa

SEQ ID NO: 2847 - DNA, 678 bp, Lactobacillus salivarius
atggataatgttatcaatcttgcgttcaatttactccaccctgacactactattagcttaggtggaggaagtaatgttaaaaaactcgctcataaattgagtcagcatcctgaattgaatattaaagtttgttctccttcagaatatactagacaaatttgtcgtgatttaaatttaaatctcattgatataaccgaaacctctactatcgaattgggttttgatggttgtgacgctattgattttgatttaaatgtcttaaaaagcaacggtggtatccatacattggagaaagagtatgcctataaagcagaaaaatatattattatatctccaccagaaagattaaaggcttctcttaatccaaatgttcaactttgtttagaagttgtttctccttctgttgactctgttttatctacagctaaacaattaggtttaaaagccaaattaagattgggcagtgctgttgctagttacgcccgtacacctctaggcaattatcttattgattgctactgtgaaagctggcaagacattaaaaaaataaatagcatactaagttcacttaacggagttgtatcaacttcatattttgaaaacattgtccactctgttttaacacttgataaaaacaataatcctattgaaataaagaaaggtgatttacatgcataa

SEQ ID NO: 2848 - DNA, 678 bp, Lactobacillus salivarius
atggataatgttatcgatctcgcatttaatttgctccaccctgacactactattagcttaggtggaggaagtaatgttaaaaagctcgctcataaattgagtcagcatcccgaattgaatattaaagtttgttctccttcagaatatactagacaaatttgtcgtgatttaaatttaaatctcattgatataaccgaagcctctactatcgaatttggttttgatggttgtgatgctattgattttgatttaaatgtcttaaaaagtaacggtggtatccatacattggaaaaagagtatgcctataaagcagaaaaatacattattatatctccaccagaaagattaaaagcttctcttaatccaaatgttcaactttgtttagaagttgtttttccttctgttgactctgttttgttcgcagctaaacaattaggtttaaaagccgaattaagattgggtagtgctgttgctagttatgctcgcacacctctaggaaattatcttattgattgctactgcgaaagctggcaagacattaaaaaaataaatagcaaactaagttcacttaacggagttgtatcaacttcatattttgaaaacattgtccactctgttttaacacttgataaaaacaataatcctattgaaataaagaaaggtgatttacatgcataa

SEQ ID NO: 2849 - DNA, 672 bp, Lactobacillus casei
atgacagaacaaatcgccgctgctctagcacttattcagccgcatcaggtagtgagtcttggcggtggtcggcacatgcaggcgcttgctgatggcattgtcgcgcgggcattgccgggtattcagatttgcagtccctctgaagtaacgctggcttattgtcagacactggggttaccaacaacaacacagatagctagtgatattgcctttgatggctgtgacagtgccgataaggacttgaatttacttaaaagtaatggcggcattcatttttatgaaaagttgcacgcgcaggcgagccatgcttatgtgattctcactgctcagaaaaatgtcaacgctcaactgaatgccgcggtaccgctgacattggaagttgttagcgcggcaagtgaacaggtgagggcatctgctaagctgctaggcttgcaggcaaaacgacgaatggctaccacttacatgggctacacgcgaacgcgcgacggcaatgaattaattgattgtacgatggcggaatggacggatatcgcaaaagttgatcatttgctagcctcattaccgggagttgttgcgacgtcatactttgctcacttagcgacattactcttaatagaaacaccagatggtcaggtacatgaaattaagcagagcgtgaaccagcccggttag

SEQ ID NO: 2850 - DNA, 672 bp, Lactobacillus casei
atgacagatcaaatcgccgctgctctagcacttattcagccgcatcaggtagtgagtcttggcggtggtcggcacatgcagacgcttgctgatggcattgtcgcgcgggcattgccgggtattcagatttgcagtccctctgaagtaacgctggcttattgtcagacactggggttaccaacaacaacacagatagctagtgatattgcctttgatggctgtgacagtgccgataaggacttgaatttacttaaaagtaatggcggcattcatttttatgaaaagttgcacgcgcaggcgagccatgcttatgtgattctcactgctcagaaaaatgtcaacgctcaactgaatgccgcggtaccgctgacattggaagttgttagcgcggcaagtgaacaggtgatggcatctgccaagctgctaggcttgcaggcaaaacgacgaatggctaccacttacatgggctacacgcgaacgcgcgacggcaatgaattaattgattgtacgatggcggaatggacggatatcgcgaaagttgatcatttgctagcctcattaccgggagttgttgcgacttcatattttgctcatctggcgacattactcttgatagaaacaccagatggtcaggtacatgaaattaagcagagcgtgaaccagcccggttag

SEQ ID NO: 2851 - DNA, 672 bp, Lactobacillus paracasei
atgacagatcaaatcgccgctgctctagcacttattcagccgtatcaggtagtgagtcttggcggtggtcggcacatgcagacgcttgctgatggcattgtcgcacgggcattgccgggtattcagatttgcagtccctctgaagtaacgctggcttattgtcagacactggggttaccaacaacaacacagatagtcagtgatattgcttttgatggctgtgacagtgccgataaggacttgaatttacttaaaagtaatggcggcattcatttttatgaaaagttgcacgcgcaggcgagccatgcttatgtgattctcactgctcagaaaaatgtcaacgctcaactgaatgccgcggtaccactgacattggaagttgttagcgcggcaagtgaacaggtgatggcatctgccaagctgctaggcttgcaggcaaaacgacgaatggctaccacttacatgggctacacgcgaacgcgcgacggcaatgaattaattgattgtacgatggcggaatggacggatatcgcaaaagttgatcatttgctagcctcattaccgggagttgttgcgacgtcatactttgctcacttagcgacattactcttaatagaaacaccagatggtcaggcacatgaaattaagcagtgcgtgaaccggcccggttaa

SEQ ID NO: 2852 - DNA, 717 bp, Lactobacillus paracasei
gtgaaatataatttcatcaaaaataaaagagaggaagcaactttcatgacagaacaaatcgccgctgctctagcacttattcagccgcatcaggtagtgagtcttggcggtggtcggcacatgcaggctcttgctgatggcattgtcgcgcgggcattgccgggtattcagatttgcagtccctctgaagtaacgctggcttattgtcagatactggggttaccaacaacaacacagatagctagtgatattgcctttgatggctgtgacagtgccgataaggacttaaatttacttaaaagtaatggcggcattcatttttatgaaaagttgcacgcgcaggcgagccatgcttatgtgattctcactgctcagaaaaatgtcaacgctcaactgaatgccgcggtaccgctgacattggaagttgttagcgcggcaagtgaacaggtgatggcatctgccaagctgctaggcttgcaggcaaaacgacgggtggctaccacttacatgggctacacgcgaacgcgcgacggcaatgaattaattgattgtaagatggcggaatggacggatatcgcaaaagttgatcatttgctagcctcattaccgggagttgttgcgacgtcatactttgctcacttagcgacattactcttaatagaaacaccagatggtcaggtacatgaaattaagcagagcgtgaaccagcccggttag

SEQ ID NO: 2853 - DNA, 648 bp, Lactobacillus ruminis
atgctgcaggaagcaatgaagatgatcaagcctgagatgaccgtgagttttggcggcggcagcacggttgccaggcttgcaaaatacttgtgcgatgaagatgaaactttaaggaaaacgctgaaggtaacgactccttcgcttgaaacgatggaagttttgaataagctgaactatcagatcgtggcgttggacgatgttgaaaaaattgacgtggcgtttgacggttgcgactatgtgacgcaaaatttgaatgcccaaaagtgcatgggcggcatccatgttgatgaaaagaaggcggccaaaaaagccttgcggtacgtcttgctgacaaagcctgagcgtatcggaaaaacgtacaatgccaaactgccgatttgtgcagaggttgaacaagacgaggcggatctttttttgaaaatggcagatcaagctggttttgaggctaaaaaccgtcctggaatcaagacgagtcgcggcaatctgttgtttgatctgtataatgaaaaatgcactcaagcagacgccgaagatgttgaaacatggccgggagtcgttggcacgtcatctttttttgatctgtgcacggacgtgatttatgaggaaaaaggcaaaacgattcacttaagaaaggaagagctcaaatga

SEQ ID NO: 2854 - DNA, 705 bp, Lactococcus lactis
gtgacgaaagaaaatatcgcgaacttggcaataaatcttataaaagatgggcaaactataggtttgggtggaggaagaaacgtatcattaattgtgaagagtttagaaaaaagttctcttaagcatattagaattgtgacagtatctaacgaaacaaagactctgtgtgaacaaatgggtcttaatttagttgaatttgaagaagtagatcaaatcgattggacttttgatggctgtgattggattaatagaaagtttcaagcgttgaaaacaagaggagggatacaaactgaagagaaaatgttggctcaagtctctaaacattatgttttacttgtaacaaaagataaactatatgatcctaaaaaaacagaattaccgatttgttgtgaaatcttgccaaattcaataaaagtaattagaaaaaaattattaaattataatgctgattttaatttaaggatttcaaataatatgccaataaaaacaagacatggaaattatttaattgatgttcaatggaaaaatagtgatattccagaatatataagtacagtcttagactcattagctgggatagtttctcatagtttttttttgaatgaaattacagaagttctatacaatgatgataacgtaaagcacatacataaaaatagagagagagaagaagaagaatgggaaaatataattggggaattgtag

SEQ ID NO: 2855 - DNA, 693 bp, Methylobacillus flagellatus KT
atgaacgacaagcaactcgtcgccatacaggcggcacagcacgtgcaggacggcatggtggttggcctgggcaccggctcgaccgccaattacttcatcgaggaactggcccggcgccaccgcgacgaaggtctgcatatcaccgcagccgcgagctccgtagccagcaccatccaggcgcagactcatggcttgccgttggtggcgctcgagcatcttggtaggctcgacctctacgtggatggcgccgatgaggtcaccaccaacctagccctgctcaaggggcgcggctacgacctcgtgcgcgaaaagctgctggcccgcgccagcgagcgcttcatcgtgctggtcgacaaaagcaagctggtgggccacctgggcgaaaaattccccatcccgctagaagtcatcccgttcgcatggcaactggtccaggcctcattacaacaactgggcatcgcaagcagcctgcggcaaaatgccgccaaggatggctgggccatcacctcccacggcagcctggtactggagctcacgctgccgaaaaccttcaagagcgatgagctcaaccggctgctgaacgacatcccgggcattgtcgagcatggcgtgttcgacgagcttgccgatgccgtattcgtggccgacaacggccaggtggaagaaatctggaagaggcctggaaatatttaa

SEQ ID NO: 2856 - DNA, 672 bp, Methylotenera mobilis JLW8
atgaatgacaaacaattggtcgcactacgtgctgcgcagtacgtacaaaacggcatgctggttggcttaggtaccggctcaacagcaaattatttcattgaagaactcgccagactgacacgtgagcaaggtttacgatgtaccacgattgccagctccgccatcagtgcacacaaggcccaatccttgcagttgcctatcgtggcgctagagcacgtagccagcatagatctatacgtcgatggtgcagatgagatcacaccagacaaaaccttacttaaagggcgtggtagcgatctggttaaagagaaactactggccaaagctgccacccagtttattgccgtggccgatgccagcaagcttgtgagtcatatcggacaaaacttcactatcccaattgaagtcattccctttgcctggcagctagcaaagaaaaacttagaagcattaggcggcgtaggcgaactgcgcccgaatgccgcaaaagatggcttctggattacctcgcacggcagctacgtattggacatgaagtttgatgctaacattgatgccaataccctaaatgccatgctcaataacacgcctggcgtggtagaacatggcattttctaccagctagccgataccatactaatcgcccaagacggcgtggtgagcgagcgctaa

SEQ ID NO: 2857 - DNA, 678 bp, Methylovorus sp. SIP3-4
atgaacgacaaacaactggtagccgagcatgccgccagcctggtggaagacagcatgatcgtcggcctgggcaccggctccaccgccaattacttcatcgaagcgctcagccggcgtcagcgtgacgaaggcctgcgtatcaccaccgtggcgagctccaccatcagcgcgatcaaggcagccgagcatggattgccactgctggatatctcgcaattggggcatctcgatctgtatgtggatggcgccgatgaaatcacaccgggtctgaccctgctgaaaggtcgcggccaggacctggtgatggaaaaactgctggcgcgtgctgccgaacgctttgtggtggtggcggacaagagcaagcaagtgagccgcataggcgagaaattcgtgatcccggtggaagtcatgccagccgcctggaagatcgtccgccacgcgctggaaaaagccaacggcgaagccgagctacgcctcaacgccagcaaggataacgtcgcggttaccgcgcacggcagctatgtactggatgtgcgcttccccgattggctggacgatgccgagctggacattctgctcaacaacacccctggcgtggttgagcatggcgtatttcgtggcctcgccagcctggtcctgattgccgaccagggacaggtagatgtggtgcatgcatga

SEQ ID NO: 2858 - DNA, 693 bp, Methylophaga thiooxidans DMS010
atgacagcgcaaaacatcatgaacccaaaacagcgtgtagcagtacatgccgcgaaccttgtagaagcagacatgatcgttggtttgggaaccggttcgactgcaaatttatttattgaggcactggcaaaacgcaatcgtaacgaacaccttaaagtgaccacggtcagcagttcagcgataagtgccgtcaaggcaaaagaggcgggattaccggttgtctcgattgattcgcttgattatctggatatgtatgtggatggtgccgatgaggtgacaccggatctcaccttactcaaaggcagggggcaagaccttgtcagagaaaaactattggcttcggctgccgatcaattttatgtgttagtggatgaaagcaaactggttgagcatatcggtcaaaatttcccggtacctgttgaggtgttacccgaggcatggaagctggttttagcgcaacttaaacagcacggtggggttggtgaattgagaatgaacgcggcgggggacaatgtcgcgtttaccgctcacggcagcttggttttggatatgagctttgagcatattgacagccttgaactgacgatgctgctggataccattgctggcgtggttgaacacggcattttcagtgacttagcttctgccgtctttattggtggagaacaggaagtcgaggaacattggcgttag

SEQ ID NO: 2859 - DNA, 675 bp, Methylophilales bacterium HTCC2181
atgaacgataaagaattagttgcagacgcggctcttgattatgttaaaaataacagtatcgtaggtcttgggacaggatcaacggctgatatatttattaacgctcttgctaaaaagatttctgctgaatcgctcaatataaaagttgtcgcaagctcaacatcaactcatgaaaaagctaatgccgcaggattaaattacatttctatagaccagataaccgagcttgatttatatatagatggtgctgatgaaatcacagaaaatttagacattctcaaaggcaggggctacgatttagtccgtgagaaaattctggcaagagccagcaagagctttatagtgataggcgatcaatcaaagattgtatctaaaatcggtgaaaagtattcaattcctattgaaataacgccaattgcatggaaaataactaaaattcttgttgaaaaattagcaataaaatgtgaggtaagagaaaatctaactaaaaatgcttttgcaataacctcctatgggaattacgttttagactgtgaatttaacgaaacaaaccttaaaaagctaggagatgaaatcgcaagtattcctggcgtatttgagcatggcttatttatagatatgtgtgggcttgccctaattgctagcaacggtcagattacaaaaatcactacctaa

SEQ ID NO: 2860 - DNA, 672 bp, beta proteobacterium KB13
atggaagataaagaaattattgctataaaagcactcgattatgtaaccgataattctatgatcggattagggaccggatcaacagcaaatttttttattaaacaccttgccaataaaattaagaatgaaagattaaatatccaggttgtggcaagctccaccgtatctgaaatagaagcccaaagaaataaattaaatttgattggtatcgatacactagagactcttgatctctatgtggatggtgcggacgaaattacgaatgatttaaatgtactaaaaggacgtggctatgatttagtgaaagagaagatacttgcccagagtgctaagaaatttatcataattgcagaccattcaaagagggttaatcgtattggagaaaattatccaattcctattgaggtcttaaaaagtacttggagattaagtaaaaaaattctggataaatttggtcagggaagcttaagaaaaaatgcagctggagatgcatatgccatctcatctgctgggaattatatttttgattactcttttgatgaaatgcctttaagagatttacatgaaaaaatcttatctagcccaggggttattgaaactggtattttttatgccatcactgactgtgcccttattgttgataatgggcacattgaaatactttctaaatag

SEQ ID NO: 2861 - DNA, 708 bp, Vibrio sp. MED222
atggcacaacgctttattgaaaaccaaagccaagactgcctgcgaactaaggctgcaaaagtagccttagagcaagtcctaaaaacgctaacaccttctagcgtgattggtatcggcactggtgcaacagttgaagtcttcattcaactattgaaagaaagtggcgctgagtttgctcattgcgtatccagttcggttcgctcaagtcgagctttatcctctgcaggcctgaatgagatatccatatctgaatgtggccgtgttgatttctacattgatggcattgatgaaggtcttacaaccggcatgaccgtgaaaggtggtggtgcagcactggctcgtgaaaaagtactcgcgacgcttgctctaagcttcatcaccatcgcagatagcggtcgattggtcactcaactcggaaagttcccactccctgtagaggttttacctgccgcacaaaccgctgtgtttaatgccttacaaagccttggtggacacccgacgttgcgccaagactgcaccactgataacggcaatatcattctcgatgttgctcatttggacatcgctgaaccaaagcgattagaactccaaattaacgctattcctggcgtcgtcgagaacggtattttcgcgcaaagaacggccgatttcatggctttttcgaatgcagaaggtacgtatttattatcaaagcaacacgttcaatag

SEQ ID NO: 2862 - DNA, 810 bp, Vibrio splendidus
ttggtgaatcagcaccagcagaacaactcttcgaaatgtttggatttacggttgaaaatatcgttgaaaaatccctatcggttctggagaagtaatatgagcatggcacaacgctttattgaaaaccaaagccaagactgcctgcgaactaaggctgcaaaagtagccttagagcaagtcctaaaaacgctaacaccttctagcgtgattggtatcggcactggtgcaacagttgaagttttcattcaactattgaaagaaagtggcgctgagtttgctcattgcgtatccagttcggttcgctcaagtcgagctttatcctctgcaggcctgaatgagatatccatatctgaatgtggccgtgttgatttctacattgatggcattgatgaaggtcttacaaccggcatgaccgtgaaaggtggtggtgcagcactggctcgtgaaaaagtactcgcgacgcttgctctaagcttcatcaccatcgcagatagcggtcgattggtcactcaacttggaaagttcccactccctgtagaggttttacctgccgcacaaaccgctgtgtttaatgccttacaaagccttggtggacacccgacgttgcgccaagactgcaccactgataacggcaatatcattctcgatgttgctcatttggacatcgctgaaccaaagcgattagaactccaaattaacgctattcctggcgtcgtcgagaacggtattttcgcgcaaagaacggccgatttcatggctttttcgaatgcagaaggtacgtatttattatcaaagcaacacgttcaatag

SEQ ID NO: 2863 - DNA, 705 bp, Vibrio orientalis
atgagcatggcaaagcgatttatcgaaatggatagctcagattgcctgcgtactaaggctgcgaaagcggccttagaccaagtgctgagagtgttaacgccatcgtctgtgatcggtattggtactggcgcgacggtagagatatttattcaattgcttaaacaaagcggcgcagagttttctcactgcgtgtcgagttcagagcgttccagcaaagcgcttcaacaagcaggtttaagcgagcagcctatctcttcttgcgagcgtgtcgatgtctatgttgatggtatcgatgaagggttaagcagcggcgaaaccgtcaaaggtggcggggcagcgttagcgcgtgaaaaggttctagcaaccatggcgatgagctttatcactatcgctgacagtgggcgtttaaaacttgctttagggacgtttccgctgccgattgaagtgcttccagcggcagagttagcggttacgcacgcactgcaaagtctaggtggaacgccagtgcgcagagaagggtgcacaactgataatggcaacatcatacttgactgttctgggctggatttaagcgaaccacaggctttagaagtgtcattgaacagcattcctggcgtggttgaaaacggtatttttgcccgccgaaaagctgactatatggcgttttctgatgatggtggtgtgcattggttagcgcgaaattga

SEQ ID NO: 2864 - DNA, 705 bp, Vibrio shilonii AK1
atgaatatgatcagttatcccatggacacacctgcatcaacctgtctgcgagctaaagcagctcaggttgccttagaacatgtaatgaaggcgctgacaccttcttccgttataggaattgggactggggcgaccgttgaagtgtttatccagttgttgaagcacagtggagcaacgttctctcattgcgtatccagttcaaagcgctcgagtgccgcattagcagcagcagggatcaatgagctaccgatcgaccaatgtgaccgtgtggatttttacgttgatggtattgatgaagggctaagcaatggtacgacggttaagggaggcggtgcagctttagcgcgagaaaaagtgctagcaacattagcaatgagctttatcactattgctgatagtggtcgcctaaaagagtcgcttggtgagtttccattgcctattgaagtattgccagcggcagagttagcagtgcttagagctctgcagagtctaggtggaaacccaattcgacgtaagaactgcgtcacggacaacggcaatctcatcatcgattgtgccggtctagacctctcagattccacagccaccgaattgtcactaaacagcattccaggtgtagtagaaaacgggatattcagtcgtagaaaggcagatttcatggcgttctcaggtgaatccggtgtggagtggttttgccgaaactga

SEQ ID NO: 2865 - DNA, 636 bp, Cardiobacterium hominis
atgctggcggccaaagcggcgctgcattatatcgaagacggtatcacattgggggtcggcagcggctcgacggtcaattgcttcatcgaagcgctcggcgcggcaaaaatgcagttcgccgacatcgtcaccgcctcggacgaaagcacgcgccgccttgaggcgctcggctaccgcgtgagcgatttgaacagcgtcggccgcattgacgtgtacgtcgatggctgcgacgaaatcaacccgcacaaggcgatgatcaaaggcggcggcgcggcgctgacccgcgagaaaatcgtcgccgcctgttcggccaaattcgtctgcatcgtcgatgaaagcaagcaggtgccggtgctggggcgcttcccgctgccggtggaagtcatcccgatggcgcgcagcttcgtcgcgcgcgagctggtgaaactgggcggcgaaccgcgctggcgcgaaaacgtcgttaccgacaacggcaactggattctggacgtctatcacctcgaaatcgccgaaccctacaagctggaagaagcgattaacaacatccccggcgtggtaaccaacggcattttcgcccgccaggcggcggatgtggtgattaccgcctatcaaagcgggcggattggcacccgttga

SEQ ID NO: 2866 - DNA, 657 bp, Dichelobacter nodosus
atgaatcaacagcttctcaaggaaaaagtcgctgctgccgtattagaacatgtgcctgaaaatattacgttgggcgtgggcagcggttcaacggtgttgtgttttattgaggcgttaaaacaggcaaaaagacaatttcgcgatattgttgccgcttcggaaacgtccagcaaagcattggaagcggcgggatttcgggtgcgcgatttaaatgcctgcgatccgccggatatttatgtggacggcgccgatgaaattaatgatgacaaaatcatgataaaaggcggcggcgcggcgttgacacgggaaaaaatcatcgcgtcggcggcaaaagaatttatttgcatcattgatgaatcaaaaaaagtggcgcaattaggacgttttccagttgccgttgaagtgattccgatggcgagaagttacgttgcgcgggaaattgtgaaattaggcgccgaaccgcgctggcggcagggcgtggtgacggataatggtcattggattttagatgtgcattatttagatttaacggctgccgaacggatggaagcgcgtattaacacgattgccggcgtggtggaatgcggcatttttgcgcaaagacgggcggataaagttttaatgagccaaagcgacggggaaattgtgctttggtaa

SEQ ID NO: 2867 - DNA, 660 bp, Psychrobacter sp. PRwf-1
atgagtcagcaacttaagcttaaacaagaggtcgcaaaagcggcattggcttatatcgatgatggtatgattttgggtgtgggcacaggcagtacggtcaactgcttaattgagcttttgcctcaggtcaacctaaaaggcgctgtggcaagctcacaggtgacccaagataagcttgaagcgcttggcattgaagttatggacttaaactatgtgggcgagcttgacctgtatatcgatggcgcagatgaggtcaatccaaacctgcaactgatcaaaggcggtggcggcgctttaactcgcgaaaaaattgtagccgccgcttcaaaacaattcatttgtttagtagatgaaagcaaatgggtgacacagttagggcgagagtttccggtaccgattgaggtgttgccccaagcgcgctcttatgtggcacgccaattggttaaaatgggcggtgagcctgtgtaccgtgaagacttcattaccgattacggcaatgtaattttggatacttataatctagacatcacgagtgccagtgagtttgaagcgcgtttgaacaatattgtgggcgtggtatgtaacggtatctttgcggccaatcaagctgataagctgctaattgccaaatcaacaggtgttgagacgttacagcgctaa

SEQ ID NO: 2868 - DNA, 660 bp, Psychrobacter arcticus 273-4
atgagtgatcagcaagcacaaaagcaagccgcagccaaagccgctctacgctatattgaagatgatatgatacttggcgtggggacgggcagtacggtgaactgtctgattgagttattaccgacattaaagcttgctggcgcggttgcaagctcgcaggtgacagaagatagattgcgtgcacttggtatcgagattgttgatttaaactttgcaggtcagcttgatgtgtatattgatggtgctgacgaagtaaacgcgcatttgcaactgattaaaggtggcggcggtgcgctgacacgcgaaaaaatcgtcgccgcagcttccaataagtttgtctgcatggtcgatgagagtaaaagtgttgagatactggggcgcgctttcccagtaccaatagaggtattgccccaagcacgttcttatgtggcgcggcaattagcccgtatgggcggcgagccggtttatcgtgaagattttgtcacggattatggcaatgtgattttggatacttacgatttggatgtcagtaatccactagcacttgaacagcagttaaacaatatcgtcggtgtggtttgtaatggtatctttgctgccaatcaagcagacgttttgctcaaagcaagcagtaacggggttgaaatacttaaccgttaa

SEQ ID NO: 2869 - DNA, 660 bp, Psychrobacter cryohalolentis K5
atgagtgatcagcaagcacaaaagcaagccgccgcccgcgccgccttacgctatatcgaagatgatatgatacttggcgtagggacaggaagtacagtgaactgtctgattgagttattaccaacagtaaagctcgctggcgcagttgcaagttcacaggtgacagaagatagattgcgtgcacttggtatcgaaattgttgacttaaattttgccggtcagctcgatgtatatattgatggtgctgatgaagtaaacgcgcatttgcaactgattaaaggtggcggtggtgcgctcacgcgtgaaaaaatcgttgccgcggcatcgaacaaatttgtttgtatggttgacgccagtaaaagtgtcgagatactagggcgcgaattcccagtgccgatagaggtattgccacaagcccgctcatatgtggcgcgcgagttggccaaaatgggcggtgagcctgtttatcgtgaagactttgtcaccgattatggcaatgtgattttggatacttatgatttagatgtcagtaatccaatagcacttgaacagcagcttaataatatcgtcggtgtggtctgtaatggtatctttgctgccaatcaagccgatgtgttgttaaaagccagcagtaatggggttgaagtgctgactcgataa

SEQ ID NO: 2870 - DNA, 690 bp, Enhydrobacter aerosaccus SK60
atgagtacgatgaatgcaagcacgcaacaacaacaaaaacaagccgtggcagcagacgcgttaaaatatatcgaatcaggcatgattttgggcgtggggacgggcagtaccgtcaactgtctcattgaattattgccaaaagttaacctaaagggcgctgtggcaagctcaaaagtcaccgaagataagctcaaagcgctcggtattgaggtgatggatttaaatttcacgggcgagttagacttatatattgatggtgctgatgaagtgaacgagcacttacagctagtcaaaggcggtggcggcgctttaacccgtgaaaaaattgttgccgctgcttctaagcagtttatttgcatggttgatgaaagcaaatgggtgcagcaattaggcgttggctttccactaccgattgaagtattgccgcaagcgcgctcgtatgtggcgcgcgagttggttcagcttggcggtgagccggtataccgtgaaggatttgtcaccgattatggcaatttgattttggatgtttatggcttagatatcggcttggacattgagaaggtagcagcgtttgaagcaaaattaaacaatatcgtaggggtggtgtgtaatgggctatttagcgcacggcgcgctgatatcttgctgatggcaacggcagatggcgtaaaaaaattaacagccaagtaa

SEQ ID NO: 2871 - DNA, 672 bp, Acinetobacter sp. ATCC 27244
atgagtctatatgcaacccaagatgaaaaaaaacaagctgcggctaaagcagctttaaaacatttgcctaaaggcggcattttgggcgtaggaactggaagtacggttaactttttaattgatttgttacctgaattgcaattagaagcagcagttgcgagttcaaatgcaacagcagaacgccttaaggaattgggtatcgaagttgttgatatgaactctgtaggcggcctagatgcttatgtagatggagctgatgagatagatcgtcatatgcatatgatcaaaggtggtggtgccgcgttgacacgtgagaaaattgttgcttctattgccaaaaaatttatttgtatagttgatgattcgaaatgggttgagcaattaggacgtgattttccgttacctgttgaagtgatcccgatggcacgttcagctgtcgcacgtaaaattgtcgctttaggcggtgatcctgtatatcgtgaaggtgttgtgactgataatgggaatgtgattttggatgtttataatttaaatatcctcaatccaattgagttagagaaaacattaaataacatcccaggtgttgtaaccaatggtattttcgcactcaatgcagcaacgatcgcaattgttgcaaccaataatggaattgaagagcgtgtagcgcagtaa

SEQ ID NO: 2872 - DNA, 672 bp, Acinetobacter junii
atgagtctatatgcaacccaagatgaaaaaaaacaagctgcggcaaaagcagctttaaagcatttgcctaaaggcggcattttgggcgtaggaacaggaagtaccgttaattttttaattgatttattacctgaattgcaattagaagctgcagttgcgagttcaaatgcgacagcagagcgcttaaaaaaacttggcatcgaagttgtagatatgaattcagtaggtggtctagatgcttatgttgatggtgcagatgaaattgatcgtcatatgcacatgatcaaaggtggcggtgctgctttaactcgtgagaaaattgttgcttcaattgcgaaaaaatttgtatgtattgttgatgactcaaagtgggttgagcaattaggtcgtgattttcctttacctgttgaagtcattccgatggcgcgatcagctgttgcacgtaaaattgtagctttaggcggtgatcctgtttatcgtgaaggtgttgtgacagataacggaaatgtaattttggatgtttataacttaaatattttaaatgcgattgagttagagaaagcactcaataatattcctggtgttgtgacaaatggaatttttgctttaaatgcagcttctattgcaatcgtagctaccaataatggtatcgaagaacgtactgcacaataa

SEQ ID NO: 2873 - DNA, 672 bp, Acinetobacter sp. ADP1
atgagtctatatgctacccaagatgagaaaaaacaagcagcggcaaaagctgctttaaaacacttaccaaaaggggggattttgggggtaggaacaggaagtaccgtcaattttctgattgaacttttacctgaattacagcttgaagcggcggttgctagctcggaagcaacagctaaacgcctaaaagaattgggtatcgaagtggttgatatgaaccatgtgggtggattggatgcttatgtcgatggtgcagatgaaattgaccgtcatatgcatatgattaaaggggggggggcggcactcacacgtgaaaaaattgtggcatcgattgcaaagaaatttgtgtgtattgttgatgattcaaaatgggtagagcagttaggtcgcgattttccattgccagttgaagtgattccaatggcgcgttctgctgttgcacgcaaacttgtgagtttaggtggagatcccgtatatcgcgaaggcgtggttacagacaacggaaacgtaattttagacgtttataacctgaatattttaaacgcacttgagcttgaaaaaaccattaatgatattcctggtgtagtgaccaatggtatttttgcattaaacgcagcatccattgccattgttgcgaccaataatggtattgaagagcgtacagcagtttaa

SEQ ID NO: 2874 - DNA, 672 bp, Acinetobacter radioresistens
atgagtctgtataccacccaagatgaaaaaaaacaggcagctgccaaagcggcgctaaaacatttgcctcgaggcggtattttgggcgtaggcacagggagcacggttaatttcctgatcgagttattgccagagctgcaacttgaagcagcagtggccagttctaatgcaacagcagagcgactgaaaaaactgggcattgaagtggttgacatgaaccatgttggcggtttggatgcctacgtcgatggtgcagatgaaatcgaccgtcatatgcatatgattaaagggggcggtgcagcactgactcgtgaaaagattgttgcttcaattgctaagaaatttgtttgtattgtagatgactcgaagtgggtagaacagctgggccgtgattttcctttgcctgtagaagtcattcctatggcacgttctgcggtagcacgtaaactggtaagtctgggcggcgatccggtatatcgtgaaggggtgattacagataatggtaatgtgattctggatgtctataatctgaatatcttgaatgcactcgaacttgaaaaaaccatcaataatattccgggagtagtaaccaacggtatatttgcgatcaacaaagctgatattgcaattgtggctaccaataatggcattgaagaacgtacagccatttaa

SEQ ID NO: 2875 - DNA, 672 bp, Acinetobacter sp. RUH2624
atgagcctatatgcaacccaagatgaaaagaaacaagctgctgcgaaagctgctttaaaacacttacccaaaggtggcattttgggggtaggaactggaagtactgtaaattttctaattgacttattgcctgaactacaattagaagcagcagtggcaagttctcaagcaacagcagatcgtcttaaaaaattaggtatcgaagtggttgatatgaaccatgtaggcagccttgatgcttatgttgatggtgcagatgagattgatcgtcacatgcatatgatcaaaggcggcggcgcagcattaactcgtgaaaaaattgtagcttcaattgctaaaaagtttgtatgtatcgttgatgattcaaaatgggttgatcaacttggtcgtgatttcccattaccagtagaagtaattccaatggcgcgctctgctgtagctcgtaaattggttagcttaggtggtgatccggtttatcgtgaaggtgtggtaacagataacggaaacgttattttagatgtatttaatttgaacatcttaaatgcaattgatttggaaaagacaatcaacaatattccgggtgttgtgactaacggtatttttgcgttaaatccagcaacgattgcaattgttgcaacaaataatggtattgaagagcgtactgcacagtaa

SEQ ID NO: 2876 - DNA, 672 bp, Acinetobacter calcoaceticus
atgagtctatacgcaacccaagatgaaaagaaacaagctgctgcgaaagctgctttaaaacacttacccaaaggtggcattttgggggtggggactggaagtacagtaaactttctaattgatttattgcctgaattacagttagaagctgctgtggcaagttctcaggcaactgctgatcgtcttaaaaaattaggcattgaagttgtagacatgaaccatgttggtggtttagatgcctatgttgatggtgcagatgaaattgatcgtcatatgcatatgattaaaggtggtggtgctgcattaacacgcgaaaaaattgtagcttcaattgcaaagaaatttgtttgtattgttgatgattcaaagtgggttgatcaacttggccgtgatttccctttaccagttgaagtcattccaatggctcgttcggcagttgctcgtaaactagtcgctttaggtggtgatccggtttatcgtgaaggggtcgtaacagataacggtaatgtgattttggatgtttttaatcttaatattttaaatgcgattgatgtagaaaaaaccattaataacattccaggtgttgtgactaatggtattttcgctctgaacccagcaacgattgcaattgttgcaacaaataatggtattgaagagcgcacagcacagtaa

SEQ ID NO: 2877 - DNA, 672 bp, Acinetobacter baumannii
atgagcctatatgcaacccaagatgaaaagaaacaagctgctgcgaaagctgctttaaaacacttacccaaaggtggcattttgggggtaggaactggaagtactgtaaatttcctgattgatttattgcctgaactacaattagaagcagcagtagcaagttctcaagcaacagcagatcgtcttaaaaaattaggcatagaagtggttgatatgaaccatgtgggtagccttgatgcttatgttgatggtgcagatgagattgatcgtcacatgcatatgattaaaggcggcggcgcagcattaactcgtgaaaaaattgtagcctcaattgctaaaaagtttgtatgtatcgttgatgattcaaaatgggttgatcaacttggtcgtgatttcccattaccagtagaagtgattccaatggcgcgttctgctgtagctcgtaaattagtaagcttagggggtgatccggtttatcgtgaaggtgtggtaacagataacggaaacgttattttagatgtatttaatttgaacatcttaaatgcaattgatttggaaaagacaattaataatattccgggcgttgtgactaacggtatttttgcgttaaatccagcaacgattgcaattgttgcaacaaatgatggtattgaagagcgtactgcacagtaa

SEQ ID NO: 2878 - DNA, 672 bp, Acinetobacter baumannii
atgagcctatatgcaacccaagatgaaaagaaacaagctgctgcgaaagctgctttaaaacacttacccaaaggtggcattttgggggtaggaactggaagtactgtaaacttcctgattgatttattgcctgaactacaattagaagcagcagtggcaagttctcaagcaacagcagaccgtcttaaaaaattaggcatagaagtggttgatatgaaccatgtgggtagccttgatgcttatgttgatggtgcagatgagattgatcgtcatatgcatatgattaaaggcggcggcgcagcattaactcgtgaaaaaattgtagcctcaattgctaaaaagtttgtatgtatcgttgatgattcgaaatgggttgatcaacttggtcgtgatttcccattacctgtagaagtgattccaatggcgcgttctgctgtagcgcgtaaattggtaagcttagggggtgatccggtttatcgtgaaggtgtggtaacagataacggaaatattattttagatgtatttaatttgaacatcttaaatgcaattgatttggaaaagacaattaacaacattccgggtgttgtgactaacggtatttttgcgttaaatccagcaacgattgcaattgttgcaacaaatgatggtattgaagagcgtactgcacagtaa

SEQ ID NO: 2879 - DNA, 672 bp, Acinetobacter baumannii
atgagcctatatgcaacccaagatgaaaagaaacaagctgctgcgaaagctgctttaaaacacttacccaaaggtggcattttgggggtaggaactggaagtactgtaaatttcctgattgatttattgcctgaactacaattagaagcagcagtagcaagttctcaagcaacagcagatcgtcttaaaaaattaggcatagaagtggttgatatgaaccatgtgggtaaccttgatgcttatgttgatggtgcagatgagattgatcgtcatatgcatatgattaaaggcggcggcgcagcattaactcgtgaaaaaattgtagcctcaattgctaaaaagtttgtatgtatcgttgatgattcgaaatgggttgatcaacttggtcgtgatttcccattaccagtagaagttattccaatggcgcgttctgctgtagctcgtaaattggtaagcttagggggtgatccggtttatcgtgaaggtgtggtaacagataacggaaacgttattttagatgtatttaatttgaacatcttaaatgcaattgatttggaaaagacaattaataatattccgggcgttgtgactaacggtatttttgcgttaaatccagcaacgattgcaattgttgcaacaaatgatggtattgaagagcgtactgcacagtaa

SEQ ID NO: 2880 - DNA, 672 bp, Acinetobacter baumannii
atgagcctatatgcaacccaagatgaaaagaaacaagctgctgcgaaagctgctttaaaacacttacccaaaggtggcattttgggggtaggaactggaagtactgtaaatttcctgattgatttattgcctgaactacaattagaagcagcagtagcaagttctcaagcaacagcagatcgtcttaaaaaattaggcatagaagtggttgatatgaaccatgtggttagccttgatgcttatgttgatggtgcagatgagattgatcgtcacatgcatatgattaaaggcggcggcgcagcattaactcgtgaaaaaattgtagcctcaattgctaaaaagtttgtatgtatcgttgatgattcaaaatgggttgatcaacttggtcgtgatttcccattaccagtagaagtgattccaatggcgcgttctgctgtagctcgtaaattggtaagcttagggggtgatccggtttatcgtgaaggtgtggtaacagataacggaaacgttattttagatgtatttaatttgaacatcttaaatgcaattgatttggaaaagacaattaataatattccgggcgttgtgactaacggtatttttgcgttaaatccagcaacgattgcaattgttgcaacaaatgatggtattgaagagcgtactgcacagtaa

SEQ ID NO: 2881 - DNA, 672 bp, Acinetobacter lwoffii
atgagtctatatgcaacccaagatgagaaaaaacaagcagcagctaaagccgctttaaaacacttgccaaaagggggcattttaggcgtaggtacaggcagtactgtaaactttttaattgacttattacctgagctgcaattggaagctgcggtagccagttcagaagcaactgcacagcgcttaaaaaagctcggtattgaagtagtggatatgaactctgtcagtggtttagatgcctatgtcgatggcgcagacgaaattgatcgtcatatgcatatgatcaaaggtggcggcgcagcattgacacgtgaaaaaattgttgcctctattgcgaaaaaatttgtgtgtatcgtggatgattcaaaatgggttggacaattgggtcgtgagttcccgcttcctgtagaagtgattccaatggcacgttctgcggttgcgcgtaaaattgtatctttgggtggcgatcctgcttatcgtgaaggtgtggtaactgacaacggtaacgtgattctagacgtgtacaacctgaatattctaaatgcgcttgaactggaaaaaaccttaaacgatattccgggcgtggtgtgtaacgggatctttgcgattaataaagcagatatcgccattgtcgcgacggataacggaattgaagagcgtactgcggtttaa

SEQ ID NO: 2882 - DNA, 672 bp, Acinetobacter johnsonii
atgagtctgtatgctacccaagatgaaaaaaagcaagctgctgcaaaagctgccttaaagcacttacctaaaggtggcattttaggggtgggtacaggcagcaccgtcaatttcttaattgagcttttgcccgagcttcagcttgaggcggctgtggcaagttcagaagcaacggctgagcgcttaaagaaattaggcattgaagtggttgatatgaactctgtaggcggtttagatgcctatgtagatggtgcagacgaaattgaccgtcatatgcatatgatcaaaggtggtggtgccgcactgactcgcgagaaaatcgtggcttcaattgcgagaaaatttgtttgtatcgttgatgactctaagtgggttgatcaattggggcgtgacttcccacttccgattgaagtgattccaatggctcgttcagctgtggcacgtaaaattgtagcgctcggtggtgatcctgcttaccgtgaaggcgtggtgacggataatggtaacgtgattttagacgtttataacttaaatatcttgaatgcgcttgagcttgaaaaaaccattaacgacattccaggtgtggtgtgtaatggtatttttgcaatcaataaagcagatgtggcagttgttgcaacagacagcggtattgaagaacgtaccgctgtttaa

SEQ ID NO: 2883 - DNA, 675 bp, Francisella philomiragia
atgttttttaataaaaaaaataatcaagatgaattaaaaagagctgcagctatagaagctgcaaaacatattaaatcagaaattgttttaggagttggtacaggaagtactgtagcttttctgattgaagaacttgtaaattacaaagataaaataaaatcagttgtatcaagttctgaagattctactaaaaaacttaaagcattaggttttgatgtagttgatcttaactatgctggtgagattgatttatatattgatggtgctgatgagtgtaataaccacaaagaactaattaaaggtggtggtgctgctcttacgcgtgagaaaatatgtgttgcagcagcaaaaaaattcatttgtattattgatgaatctaaaaaagtaaacactctaggagagtttcctcttcctgtagaagttatcccaatggctagaagctatgttgctagagagatagttaaattaggtggtcaacctgtatatagagaacaaactattactgacaatggcaatgttattctcgatgtatataacctaaaaatagacaaccctctaaaacttgaaactgagttaaatcaaataactggtgttgtgactaatggtatctttgctcttaaacctgctgacacggtaattatggctaggaaagatggaagtattaagaatttttaa

SEQ ID NO: 2884 - DNA, 675 bp, Francisella philomiragia
atgttttttaataaaaaaaataatcaagatgagttaaaaaaagctgcagctatagaagctgcaaaacatattaaatcagaaattgttttaggagttggtacaggaagtactgtagcctttctgattgaagaacttgtaaattacaaagataaaataaaatcagttgtatcaagttctgaagattctactaaaaaacttaaagcattaggttttgatgtagttgatcttaactatgctggtgagattgatttatatattgatggtgctgatgagtgtaataaccacaaagaactaattaaaggtggtggtgctgctcttacgcgtgagaaaatatgtgttgccgcagcaaaaaaattcatttgtattattgatgaatctaaaaaagtaaatactctaggagagtttcctcttcctgtagaagttatcccaatggctagaagttatgttgccagagaaatagttaagctaggtggtcaacctgtatatagagagaaaacaattactgataatggtaatattattctagatgtatacaatctaaaaatagacaatcctctaaagcttgaaactgaactaaatcaaattacaggtgttataactaatggtatctttgcccttaaacctgctgacactgtaattatggctaagaaagatggaagtattgaaagtttttaa

SEQ ID NO: 2885 - DNA, 675 bp, Francisella tularensis
atgttttttaataaaaaaaataaccaagatgagttaaaaaagcttgccgcaactgaagctgcaaaaagtattactacagaaattactttaggagtcggtacaggaagtactgttggatttttaatcgaagaacttgtaaactatagagacaagatcaaaactgtagtatcaagctcggaagattcaacccgcaaactcaaagcgcttggttttgatgtagttgatcttaattatgctggtgagattgatttatacattgatggtgcagatgagtgcaacaatcacaaagaactcatcaaaggtggtggtgcggctctgacacgtgagaaaatttgtgtggctgctgctaagaaatttatctgtatcattgatgaatcaaaaaaagttaatacattaggtaattttcctcttcctatagaagttatcccaatggcaagaagctatatagcacgtcaaatagtaaagcttggcggtcaaccagtatatagagaacagacaattacagataatggtaatgttattctggatgtatataatctaaaaattgataaccctctaaaacttgaaacagaactaaatcaaatcacaggcgttgtcactaatggcatcttcgctttaaaacctgctgatactgtgattatggctacaaaagatagtaatattgttgtactttaa

SEQ ID NO: 2886 - DNA, 675 bp, Francisella novicida U112
atgttttttaataaaaaaaataaccaagatgagttaaaaaagcttgccgcaactgaagctgcaaaaagtattactacagaaattactttaggagtcggtacaggaagcactgttggatttttaatcgaagaacttgtaaactatagagacaagatcaaaactgtagtatcaagctcggaagattcaacccgcaaactcaaagcgcttggttttgatgtagttgatcttaattatgctggtgagattgatttatacattgatggtgcagatgagtgcaacaatcacaaagaactcatcaaaggtggtggtgcggctctgacacgtgagaaaatttgtgtggctgctgctaagaaatttatctgtattattgatgagtcaaaaaaagttaatacattaggtaatttccctcttcctatagaagttatcccaatggcacgaagctatgtagcacgtcaaatagtaaagcttggcggtcaaccagtatatagagaacagacaattacagataatggtaatgttattctggatgtatataatctaaaaattgataaccctctaaaacttgaaacagaactaaatcaaatcacaggcgttgtcactaatggcatcttcgctttaaaacctgctgatactgtgattatggctacaaaagatagtaatattgttgtactttaa

SEQ ID NO: 2887 - DNA, 726 bp, Francisella tularensis
ttgtcaaaggaagtatttttagtaacatatttagtaagagaaagttttaaaatgttttttaataaaaaaaataaccaagatgagttaaaaaagcttgccgcaactgaagctgcaaaaagtattactacagaaattactttaggagtcggtacaggaagtactgttggatttttaatcgaagaacttgtaaactatagagacaagatcaaaactgtagtatcaagctcggaagattcaacccgcaaactcaaagcgcttggttttgatgtagttgatcttaattatgctggtgagattgatttatacattgatggtgcagatgagtgcaacaatcacaaagaactcatcaaaggtggtggtgcggctctgacacgtgagaaaatttgtgtggctgctgctaagaaatttatctgtatcattgatgagtcaaaaaaagttaatacattaggtaattttcctcttcctatagaagttatcccaatggcaagaagctatatagcacgtcaaatagtaaagcttggcggtcaaccagtatatagagaacagacaattacagataatggtaatgttattctggatgtatataatttaaaaattgataaccctctaaaacttgaaacagaactaaatcaaatcacaggcgttgtcactaatggcatcttcgctttaaaacctgctgatactgtgattatggctacaaaagatagtaatattgttgtactttaa

SEQ ID NO: 2888 - DNA, 675 bp, Francisella novicida GA99-3549
atgttttttaataaaaaaaataaccaagatgagttaaaaaagcttgccgcaactgaagctgcaaaaagtattactacagaaattactttaggagtcggtacaggaagcactgttggatttttaatcgaagaacttgtaaactatagagacaagatcaaaactgtagtatcaagctcggaagattcaacccgcaaactcaaagcgcttggttttgatgtagttgatcttaattatgctggtgagattgatttatacattgatggtgcagatgagtgcaacaatcacaaagaactcatcaaaggtggtggtgcggctctgacacgtgagaaaatttgtgtggctgctgctaagaaatttatctgtattattgatgagtcaaaaaaagttaatacattaggtaatttccctcttcctatagaagttatcccaatggcacgaagctatgtagcacgtcaaatagtaaagcttggcggtcaaccagtatatagagaacagacaattacagataatggtaatgttattctggatgtatataatctaaaaattgataaccctctaaaacttgaaacagaactaaatcaaatcacaggcgttgtcactaatggcatcttcgctttaaaacctgctgatactgtaattatggcaaagaaagatggtaagattgagagattttag

SEQ ID NO: 2889 - DNA, 651 bp, Legionella pneumophila
gtgagtgaattaaaaatcaaagcagccaaagcagctatagcttatattgaagatgatatggttataggtgttggaacaggctctacagttaatttttttataaaagaactggcagcaatcaaacataagatagaggcttgtgtagccagttcaaaagcaaccgaggcattgcttcgggcagaaggtatcccagtaattgatttaaattcagtacaggatttacctatctatgttgatggcgctgatgaagtcaatgaacgcggtgaaatgataaagggggggggaggagctctgactcgagagaaaattgtagcgaatgtagccacacaatttatttgtattgtcgatgaatccaaggttgtgaaacgtttaggggaatttcccgttgctgtggaagtcattccaatggcccgtagttttgttgcacgacaaattgttaaattagggggagaccctgaatacagagaaggtttcgttactgataatggtaatattattctggatgtgtttaatctgaatttctcaacacctatggccttagaagacagtcttaatgtaatcccgggtgtcgttgaaaatggagtgtttgccaaacgcttggcagataaagtgttagtggcttcagcaagcggtgtgaataatttaaaatag

SEQ ID NO: 2890 - DNA, 651 bp, Legionella pneumophila
gtgagtgaattaaaaatcaaagcagccaaagcagctatagcttatattgaagatgatatggttataggtgttggaacaggctctacagttaatttttttataaaagaactggcagcaatcaaacacaagatagaggcttgtgtagccagttcaaaagcaaccgaggcattgcttcgggcagaaggtatcccagtaattgatttaaattcagtacaggatttacctatttatgttgatggcgctgatgaagtcaatgaacgcggtgaaatgataaaggggggcggaggagctctgactcgggagaaaattgtagcgaatgtagccacacaatttatttgtattgtcgatgaatccaaggttgtgaaacgtttaggggaatttcctgttgctgtggaagtcgttccaatggcccgtagttttgttgcacgacaaattgttaaattaggtggagaccctgaatacagagaaggtttcgttactgataatggtaatattattctggatgtgtttaatctgaatttctcaacacctatggccttggaagacagtcttaatgtaatcccgggtgtcgttgaaaatggagtgtttgccaaacgtttggcagataaagtgttagtggcttcagcaagtggtgtgaataatttaaaatag

SEQ ID NO: 2891 - DNA, 651 bp, Legionella pneumophila
gtgagtgagttaaaaatcaaagcagccaaagcagctatagcttatattgaagatgatatggttataggtgttggaacaggctctaccgttaatttttttataaaagaactggcagcaatcaaacataagatagaggcttgtgtagccagttcaaaagcaaccgaggcattgcttcgggcagaaggtatccctgtaattgatttaaattcagtacaggatttacctatctatgttgatggcgctgatgaagtcaatgaacgcggtgaaatgataaaggggggcggaggagctctgactcgggagaaaattgtagcgaatgtagccacacaatttatttgtattgtcgatgaatccaaggttgtaaaacgtttaggggaatttcccgttgctgtggaagtcattccaatggcccgtagttttgttgcacgacaaattgttaaattagggggagaccctgaatacagagaaggcttcattactgataatggtaatattattctggacgtgtttaatctgaatttctcaacacctatggccttggaagacagtcttaatgtaatcccgggtgtcgttgaaaatggagtgtttgccaaacgtttggcagataaagtgttagtggcttcagcaagtggtgtcaataatttaaaatag

SEQ ID NO: 2892 - DNA, 651 bp, Legionella pneumophila
gtgagtgaattaaaaatcaaagcagccaaagcagctatagcttatattgaagatgatatggttataggtgttggaacaggctctacagttaatttttttataaaagaactggcagcaatcaaacataagatagaggcttgtgtagccagttcaaaagcaaccgaggcattgcttcgggcagaaggtatccctgtaattgatttaaattcagtacaggatttacctatctatgttgatggcgctgatgaagtcaatgaacgcggtgaaatgataaaggggggcggaggagctctgactcgagagaaaattgtagcgaatgtagccacacaatttatttgtattgtcgatgaatccaaggttgtaaaacgtttaggggaatttcccgttgctgtggaagtcattccaatggcccgtagttttgttgcacgacaaattgttaaattagggggagaccctgaatacagagaaggtttcgttactgataatggtaatattattctggatgtgtttaatctgagtttctcaacacctatggccttggaagacagtcttaatgtaatcccgggtgtcgttgaaaatggagtgtttgccaaacgtttggcagataaagtgttagtggcttcagcaagtggtgtgaataatttaaaatag

SEQ ID NO: 2893 - DNA, 651 bp, Legionella longbeachae
atgagtgatttaaaaattaaagctgcaaaagcggcgctggattttattgaggatgacacaattgttggtgtaggcacaggctctacagttaattactttattaaagaactggctactattaagcataaaatcgatgcttgtgttgcgagctctaaagcaaccgaagctttattaagacaagaagggataccagttattgatttaaattcagtacaggacttgccagtttatattgatggtgctgatgaagtaactgagcatggtgagatgataaaaggaggggggggagctttgaccggcgaaaaaattgtagcccaactcgctcaaaaattcatttgcattgcggatgattcaaaacaagtgcgccatttagggggatttcctgtagcagttgaagtacttccaatggcaagaagcatggttgcccgggaactcgtaaaattgggtggtgatccagaatatagagagggttttgtaaccgataatggcaatattattctcgatgtttttaattttacaatcaatgagcctatggatttggaagagcgtattaatcgcataacgggtgttgtcgaaaatggtatatttgctcatcgcatagcggatgtgattttattagggtctcaagatggagtgaagcgactgaaatag

SEQ ID NO: 2894 - DNA, 672 bp, Neisseria sicca
atggctactcaagacgaattgaaacgcattgccgccgagaaagcggtggaattcgtacctgaaaacgaatacatcggtatcggctccggctcgaccgtcaatatgtttatcgaagcgttgggcaaaagcggcaaaaaaatcaaaggcgcggtttcgacttctaaaaagtccagcgaactgatggcgcaatacgacattcccgaagtatcgctgaatgatgtgatggggctggctgtctatgttgacggtgcggacgaagtgaaccatatgctgcaaatgattaaaggcggcggcggcgcgcatttaaacgaaaaagttgtcgccagcgcgtccgacaaattcatctgtatcgccgacgagagcaaatatgtttcgcgtttgggcaaattcccgctgcccgtagaagtgttgcccggcgcgcgttcgctggtgtcgcgcaaacttttggcaatgggcggacagcctgagttacgcctgaactacaccaccttccacggcaaccaaatcattgatgtctatgacttgcatatcgaccgtccgctgactatggaagatgaaatcaaccgcatcaccggcgttctcgaaaacggcatcttcgcccgcaacgccgcggatgtgttgattttgggtacagagcagggcgtcaaagtcatcaaacccggacaaaactag

SEQ ID NO: 2895 - DNA, 672 bp, Neisseria mucosa
atggctactcaagatgaattgaaacgcattgccgccgaaaaagcggtggaattcgtacctgaaaacgaatacatcggtatcggttcaggctcgaccgtcaatatgtttatcgaagcgttgggcaaaagcggcaaaaaaatcaaaggcgcggtttcgacttctaaaaagtccagcgaactgatggcgcaatacgacatccccgaagtatcgctgaatgatgtgatgtacctcgctgtctatatcgacggtgcggacgaagtgaaccatatgctgcaaatgattaaaggcggcggcggcgcgcatctgaacgaaaaagtcgtcgccagcgcgtccgacaaattcatctgtatcgccgacgagagcaaatatgtatcgcgtttgggcaaattcccgctgcccgtagaagtattgcccggtgcgcgttcgctggtgtcgcgcaaacttttggcaatgggcggacaacctgaattgcgcttggattgcaccactttccatggcaaccaaatcgtcgatgtctatgacttgaatatcgaccgtccgttgactatggaagatgaaatcaaccgcattaccggcgttgtcgaaaacggcatcttcgcccgtaacgccgcggatttgttgattttaggaacagagcagggcgccaaagtcatcaaacccggacaaaattaa

SEQ ID NO: 2896 - DNA, 672 bp, Neisseria meningitidis
atgacgacacaagacgaactcaagcgcatcgccgccgaaaaagcagtcgaattcgtacccgaaaacgaatacatcggcatcggtaccggttcgaccatcaactttttcatcgaagccttgggtaagagcggcaaaaaaatcaaaggcgcggtatctacttccaaaaaatccagtgaactgcttgcccaatatgatattcccgtcgtttccctgaacgaagtatcggggttggcggtctatattgacggtgcggatgaagtgaaccacgccctgcaaatgattaaaggcggcggcggcgcacacctcaacgaaaaaatcgtcgccagcgcatccgaaaaattcgtctgcattgcggatgaaagcaaatatgtttcacgtttgggcaaattccctctgcctgtggaagtcgtcgaaagcgcgcgctctcttgtttcgcgcaaactgctcgctatgggcggacagcccgaactgcgtatcggctacaccacgttttacggcaaccaaatcgtcgatgtccacggcttgaatatcgatcagccgctgacgatggaagacgaaatcaacaaaatcaccggcgtgctcgaaaacggcatattcgcccgcgatgccgccgatgtgttgattttggggacggaagagggtgcgaaagtcatctatccctgccaagggtaa

SEQ ID NO: 2897 - DNA, 672 bp, Neisseria meningitidis
atgacgacacaagacgaactcaagcgcatcgccgccgacaaagcagtcgaattcgtacccgaaaacgaatacatcggcatcggtaccggttcgaccatcaactttttcatcgaagccttgggtaagagcggcaaaaaaatcaaaggcgcggtatctacttccaaaaaatccagtgaactgcttgcccaatatgatattcccgtcgtttccctgaacgaagtatcggggttggcggtctatattgacggtgcggatgaagtgaaccacgccctgcaaatgattaaaggcggcggcggcgcacacctcaacgaaaaaatcgtcgccagcgcatccgaaaaattcgtctgcattgcggatgaaagcaaatatgtttcacgtttgggcaaattccctctgcctgtggaagtcgtcgaaagcgcgcgctctcttgtttcgcgcaaactgctcgctatgggcggacagcccgaactgcgtatcggctacaccacgttttacggcaaccaaatcgtcgatgtccacggcttgaatatcgatcagccgctgacgatggaagacgaaatcaacaaaatcaccggcgtgctcgaaaacggcatattcgcccgcgatgccgccgatgtgttgattttggggacggaagagggtgcgaaagtcatctatccctgccaagggtaa

SEQ ID NO: 2898 - DNA, 672 bp, Neisseria gonorrhoeae
atgacgacacaagacgaactcaagcgcatcgccgccgaaaaagcagtcgaattcgtacccgaaaacgaatacatcggcatcggtaccggttcgaccatcaatttcttcatcgaagccttgggcaaaagcggtaaaaaaatcaaaggcgcggtttcaacctccaaaaaatccggcgaactgcttgcccggtacgacattcccgtcgtgtccctgaacgaagtgtccggtttggcggtctatatcgacggtgcggacgaagtgaaccacgccctgcaaatgattaagggcggcggcggcgcgcacctcaacgaaaaaatcgtcgccagcgcatcagaaaaattcgtctgcattgcggacgaaagcaaatatgtttcccggctgggcaaattcccactgcccgtggaagccgtcgaaagcgcgcgctcccttgtttcgcgcaaactgcttgccatgggcggacagcccgaactgcgtatcggctacaccacgttttacggcaaccaaatcgtcgatgtccacggcttgaatatcgatcagccgctgacgatggaagatgaaatcaacaaaatcaccggcgtactcgaaaacggcatattcgcccgcgatgccgccgatgtgttgattttggggacggaagagggtgcgaaagtcatctatccctgccaagggtaa

SEQ ID NO: 2899 - DNA, 672 bp, Neisseria gonorrhoeae
atgacgacacaagacgaactcaagcgcatcgccgccgaaaaaacagtcgaattcgtacccgaaaacgaatacatcggcatcggtaccggttcgaccatcaatttcttcatcgaagccttgggcaaaagcggtaaaaaaatcaaaggcgcggtttcaacctccaaaaaatccggcgaactgcttgcccggtacgacattcccgtcgtttccctgaacgaagtgtccggtttggcggtctatatcgacggtgcggacgaagtgaaccacgccctgcaaatgattaagggcggcggcggcgcgcacctcaacgaaaaaatcgtcgccagcgcatcagaaaaattcgtctgcattgcggacgaaagcaaatatgtttcccggctgggcaaattcccactgcccgtggaagtcgtcgaaagcgcgcgctcccttgtttcgcgcaaactgcttgccatgggcggacagcccgaactgcgtatcggctacaccacgttttacggcaaccaaatcgtcgatgtccacggcttgaatatcgatcagccgctgacgatggaagatgaaatcaacaaaatcaccggcgtactcgaaaacggcatattcgcccgcgatgccgccgatgtgttgattttggggacggaagagggtgcgaaagtcatctatccctgccaagggtaa

SEQ ID NO: 2900 - DNA, 672 bp, Neisseria meningitidis
atgacgacacaagacgaactcaagcgcatcgccgccgaaaaagcagtcgaattcgtacccgaaaatgaatatatcggcatcggtaccggctcgaccatcaactttttcatcgaagccttgggtaagagcggcaaaaaaatcaaaggcgcggtatctacttccaaaaaatccggcgaactgcttgcccagtacgatattcccgtcgtttctttgaacgaagtatcggggttggcggtctatatcgacggtgcggatgaagtgaaccacgccctgcaaatgattaaaggcggtggcggcgcgcacctcaacgaaaaaatcgtcgccagcgcgtccgaaaaattcatctgcattgcggatgaaagcaaatatgtttcacgtttgggcaaattccctctgcctgtggaagtcgtcgaaagcgcgcgctctcttgtttcgcgcaaactgctcgctatgggcggacagcccgaactgcgtatcggctacaccacgttttacggcaaccaaatcgtcgatgtccacggcttgaatatcgatcagccgctgacgatggaagacgaaatcaacaaaatcaccggcgtgctcgaaaacggcatattcgcccgcgatgccgccgatgtgttgattttggggacggaagagggtgcgaaagtcatctatccctgccaagggtaa

SEQ ID NO: 2901 - DNA, 672 bp, Neisseria meningitidis
atgacgacacaagacgaactcaagcgcatcgccgccgaaaaagcagtcgaattcgtacccgaaaatgaatatatcggcatcggtaccggctcgaccatcaactttttcatcgaagccttgggtaagagcggcaaaaaaatcaaaggcgcggtatctacttccaaaaaatccggcgaactgcttgcccagtacgatattcccgtcgtttctttgaacgaagtatcggggttggcggtctatatcgacggtgcggatgaagtgaaccacgccctgcaaatgattaaaggcggtggcggcgcgcacctcaacgaaaaaatcgtcgccagcgcgtccgaaaaattcatctgcattgcggatgaaagcaaatatgtttcacgtttgggcaaattccctctgcctgtggaagtcgtcgaaagcgcgcgctctcttgtttcgcgcaaactgctcgctatgggcggacagcccgaactgcgtatcggctacaccacgttttacggcaaccaaatcgtcgatgtccacggcttgaatatcgacaaaccgctgacgatggaagacgaaatcaacaaaatcaccggcgtactcgaaaacggcatattcgcccgcgatgccgccgatgtgttgattttggggacggaagagggtgcgaaagtcatctatccctgccaagggtaa

SEQ ID NO: 2902 - DNA, 672 bp, Neisseria lactamica
atgacgacacaagacgaactcaagcgcatcgccgccgaaaaagcagtcgaattcgtacccgaaaatgaatatatcggcatcggtaccggctcgaccatcaactttttcatcgaagccttgggtaagagcggtaaaaaaatcaaaggcgcggtatctacttccaaaaaatccagcgaactgcttgcccggtacgacattccggtcgtttccctgaacgaagtgtccggtttggcggtctatatcgacggtgcggacgaagtcaaccacgccctgcaaatgattaagggcggcggcggcgcgcacctcaacgaaaaaatcgtcgccagcgcatcagaaaaattcatctgcattgcggatgaaagcaaatatgtttcacgtttgggcaaattccctctgcccgtagaagtcgtcgaaagcgcgcgctcccttgtttcgcgcaaactgctcgctatgggcggacagcctgaattgcgtatcggctacaccacgttttacggcaaccaaattgtcgatgtccacggcttgaatatcgacaaaccgctgacgatggaagatgaaatcaacaaaatcactggcgtgctcgaaaacggcatattcgcccgagatgccgccgacgtgttgattttaggtacggaagagggcgcgaaagtcatctatccctgccaagggtaa

SEQ ID NO: 2903 - DNA, 672 bp, Neisseria meningitidis
atgacgacacaagacgaactcaagcgcatcgccgccgaaaaagcagtcgaattcgtacccgaaaacgaatacatcggcatcggtaccggctcgaccatcaactttttcatcgaagccttgggtaagagcggcaaaaaaatcaaaggcgcggtatctacttccaaaaaatccagtgaactgcttgcccaatatgatattcccgtcgtttccctgaacgaagtatcggggttggcggtctatattgacggtgcggatgaagtgaaccacgccctgcaaatgattaaaggcggcggcggcgcacacctcaacgaaaaaatcgtcgccagcgcatcagaaaaattcgtctgcattgcggacgaaagcaaatatgtttcacgtttgggcaaattccctctgcccgtggaagtcgtcgaaagcgcgcgttcccttgtttcgcgcaaactgctcgctatgggcggacagcctgaattgcgtatcggctacaccactttttacggcaaccaaatcgtcgatgtccacggcttgaatatcgacaaaccgctgatgatggaagacgaaatcaacaaaatcaccggcgtactcgaaaacggaatattcgcccgcgatgccgccgatgtgttgattttggggacggaagagggtgcgaaagtcatctatccctgccaagggtaa

SEQ ID NO: 2904 - DNA, 672 bp, Neisseria cinerea
atggcaacacaagacgaactcaagcgcattgcagcggaaaaggcagtcgaattcgtaccagaaaacgaatatattggcatcggtaccggttcgaccatcaatttcttcatcgaagccttgggtaagagcggcaaaaaaatcaaaggcgcggtatctacttccaaaaaatccagcgaactgcttgcccagtacgacattcccgttgtttctttgaacgaagtatcggggttggcggtctatatcgacggtgcggacgaagtgaaccacgccctgcaaatgattaaaggtggcggcggtgcgcacctcaacgagaaaattgtcgccagcgcatcagaaaaattcatctgcattgcggacgaaagcaaatatgtttcacgtttgggcaaattccctctgcctgtggaagtcgtcgaaagcgcgcgttcgctcgtgtcgcgccgcctgcttgccatgggcgggcagcccgaactgcgtatcggctataccactttctacggtaaccaaattgtcgatgtccacggtttgaatatcgatcagccgctgacgatggaagatgaaatcaacaaaatcaccggcgtactcgaaaacggaatattcgcccgcgatgccgccgacgtgttgattttggggacggcagcaggtgcgaaagtcatttatccctgccaagggtaa

SEQ ID NO: 2905 - DNA, 672 bp, Neisseria flavescens
atggcaactcaagacgaactcaaacgtattgccgccgaaaaagcggtggaatttgttcctgaaaacgaatacatcggtatcggtaccggctctaccatcaacttctttatcgaagccttgggtaaaagcggtaagaaaatcaagggtgccgtgtctacttctaaaaaatccagcgagcttttggcgaaatacgagattccagaagtttcactgaatgaagtgatgggtttggcggtttatgttgacggcgcagacgaagtcaaccacgcgctgcaaatgattaaaggcggcggcggtgcgcatttgaacgaaaaaatcgtggccagcgcatccgataaatttgtctgtatcgccgatgaaagcaaatatgtttcccgtttgggtaaattcccattgcctgtagaagtcgttgaaaatgcccgttcgctggtgtcgcgcaaactgcttgccatgggcggacagcctgagttgcgtgtcggctatactactttctatggcaaccaaatcgttgatgttcacggactcaatatcgaccaagccctgaaaatggaagacgaaatcaataaaatcaccggcgtactcgaaaacggtatttttgcccgcgatgccgccgatgtgttggttttgggtacggcagaaggcgcaaaagtcatcctgccttgtcaggattaa

SEQ ID NO: 2906 - DNA, 684 bp, Kingella oralis
atgtgcaaaatgagcaacttcacccaagaccaactcaaacaactcgccgccgccaaagcggtggaatttgtgcccgaaaacgaatacatcggcatcggcacaggcagcaccgtaaacttctttatccaagcgctcgggcaaagcggcaagaaaatcaagggcgcggtaaccacttcgctcaaaagcgcggagctgatggagcaatacggcatcccgcaaatccagctcaacgaagtaacgcgcttgggcgtgtatattgacggcgcggatgaaatcaaccacatgatgcaaatgataaaaggcggcggcgcggcattgttgcccgaaaaaatcgtcgccacgctgtccgaccaatttatctgcatcgccgacgaaagcaaatatgtgcgcaagctgggcaagtttcccctaccggtggaagtgattccgatggcgcgttccatggtggcgcgcaaaatcgtgaaactgggcgggcagcctgaattacgcatcggctgcaaaaccctgcacggcaacgaaattttggatgtgcacgggctggacctttccgagccgatgaaaatggaagacacgctcaaccgcatcacgggcgtggtggaaaacggcttgtttgcccaccgctatgccgatttgctgatactcgccaaaaaagacggcgcggaagtgattcaagcgcacgtttga

SEQ ID NO: 2907 - DNA, 669 bp, Eikenella corrodens
atgtccgcccaagaccaactcaaacgcaccgccgcccaaaaagccctcgaattcgtgcccgaaaatgcctacatcggcatcggcaccggcagcaccgtaaactttttcatcgaagagctggccaatagcggcatccgcatcaaaggtgccgtttccacctccaaagctaccagcgaacttttgaaacaacacggcatccccgaagtgccgctcaccgaggcggacgagctgcccgtgtatatcgacggcgccgacgaagtcaaccacagcctgcaaatgattaaaggcggcggcggcgcgctgttggccgaaaaaatcgtggccagcgccgccgaaaaattcgtctgcatcgtagacgagagcaaatacgtttccaggctgggcaaattcccgctgccgatcgaaatcatccccgccgcccgctcgctggtgtcgcgccagctgctcaaatacggcggcagcccgcagctgcgcttgaatttcaccaccgacagcggccataaaatcatcgatgtgcacaatatgccgatcaacgagccgctcaaactggaagacgaactcaaccgcatccccggtatcgtggaaaacggcctgtttgcccgccatcctgcccacgtgctgattattggccgggcagaaggcgcagaagtgatcaaaatcggcagctga

SEQ ID NO: 2908 - DNA, 639 bp, unknown
  Uncultured marine gamma proteobacterium EBAC31A08
atgagtggctcaaagataaatgttgctaaacaagctatagaatatatcaaaaataatcttcatcctgagatgattttaggtattggaaccggctcaacagttaatttttttatagaagaactaaaggagcataggcacaaatttgctggagctgtttctagttcagatgcttcatcaaaattattaaatgaaaatgggatagaggtctttagccttaatgatgtagttgatatagcttattacatagatggtgcagatgaggtgtctcctgaaaattgtcttattaaaggtggtggtggcgcacatactagagaaaagatagttgcttctgcctctaacgagtttatatgtatagttgatcagtcaaagatggttaatcttttgggagcttttccactgcctatagaggtgatacctgaaagtaggagccttgttgcaagaaaaataatctcgatcggtggaatacccacatatagaactggatttataacagaccaaggtaatcacattttagatatctctaatatggatatttcaaaccccactgaaatggaagctttgattaataatattcctggagttgtagataatggaatatttgcagcaaacaagcctaaaactgtattagtttctaagtaa

SEQ ID NO: 2909 - DNA, 648 bp, Stenotrophomonas maltophilia
atgtccgaagccaagcgcctggccgccgagaaagccatcgagtacgttgaagacggcatgatcgtcggtgtcggcaccggttccaccgtggcctatttcatcgatgccctggcccgcatccagcaccgcatcaagggtgccgtgtccagctccgaacagagcaccgcgcgcctgaagcagcacggcatcgaggtgatcgagctgaaccacagcggcaatctgtcgctgtacgtggacggcgccgatgagtgcgatgccaacaagtgcctgatcaagggcggcggtgccgcgctgacccgcgagaagatcatcgccgaggccagcgagcgcttcatctgcatcgtcgacccgagcaagcaggtgccggtgctgggtaaattcccgctgccggtggaggtgattccgatggcgcgcagcctgatcgcccgccagatccgcgacatgaccggcggccagccgacctggcgcgaaggcgtggtgaccgacaacggcaaccagatcctggacatccacaacctgcagatcaccgatccggaaaagctggagcgcgagctcaaccagctgccgggtgtggtgtgcgtcggcctgttcgcgcgccgtcgcgccgatgtggtgatcgtcggcggcgagccgccggtcgtgctctga

SEQ ID NO: 2910 - DNA, 648 bp, Stenotrophomonas maltophilia
atgtccgaagccaagcgcctggccgccgagaaagccatcgagtacgttgaagacggcatgatcgtcggtgtcggcaccggttccaccgtggcctatttcatcgatgccctggcccgcatccagcaccgcatcaagggcgctgtttccagctccgagcagagcaccgcgcgcctgaagcagcacggcatcgaggtgatcgagctgaaccacagcggcaacctgtcgctgtacgtcgatggcgccgatgagtgcgacgccaacaagtgcctgatcaagggcggcggcgccgcgctgacccgcgagaagatcatcgccgaggccagcgagcgcttcatctgcatcatcgacccgagcaagcaggtgccggtgctgggcaggttcccgctgccggtggaagtgatcccgatggcgcgcagcctggtcgcccgccagatccgcgacatgaccggcggccagccgacctggcgtgaaggcgtggtcaccgacaacggcaaccagatcctggacatccacaacctgcagatcaccgatccggaaaagctggagcgcgagctcaaccagctgccgggcgtggtctgcgtcggcctgttcgcccgccgccgcgccgatgtggtgatcgtcggcggcgagccgccggtcgtgctctga

SEQ ID NO: 2911 - DNA, 648 bp, Stenotrophomonas sp. SKA14
atgtccgaagccaagcgcctggccgccgagaaagccatcgaatacgtcgaagacggcatgattgtcggtgtcggcaccgggtccaccgtggcctatttcatcgatgccctggcccgcatccagcaccgcatcaagggcgcagtgtccagctccgagcagagcaccgcgcgcctgaagcagcacggcatcgaggtgatcgagctgaaccacagcggcaacctgtcgctgtacgtggacggcgccgacgagtgcgacccgaacaagtgcctgatcaagggcggcggtgccgcgctgacccgcgagaagatcatcgccgaggccagcgagcgtttcatctgcatcgtcgacccgagcaagcaggtgcccgtactgggtgcgttcccgctgccggtggaggtgatcccgatggcacgcagcctggtcgcccgccagatccgcgacatgaccggcggccagccgacctggcgcgaaggcgtggtcaccgacaacggcaaccagatcctggatatccacaatctgcagatcaccgatccggaaaagctggagcgcgagctcaaccagctgccgggcgtagtctgcgtgggcctgttcgcgcgccgtcgcgccgacgtggtgatcgtcggcggcgagccgccggtcgtgctctga

SEQ ID NO: 2912 - DNA, 726 bp, Xanthomonas oryzae
ttggggattcgctcaatgcccgccgccgttccgctccaacgaatcccgaatttccaatccccaatcccgagccccacaatgtccgaagcaaaacgcctggccgccgaaaaagcgatcgattacgtggaagacggcatgatcgtcggagtcggtaccggctcgacggtggcctacttcatcgacgcgcttggccacatcggccatcgcatcaagggcgcagtctccagctccgaacagagcaccgcgcgcctgcgccagcacggcatcgaagtgctggacctcaatcacaccggcaatctgtcgctgtacgtggacggcgccgacgagtgcgacccgaaccgctgcctgatcaagggcggcggcgcagcgctgacgcgcgagaagatcatcgccgaggccagcgagcgcttcatctgcatcgtcgaccccagcaagcaggtgccggtgctgggcaaatttccgctgccggtggaagtgattccgatggcgcgcagcctggtggcccgacagatcctggcgctgaccggcggccagccggtgtggcgcgatgtcgtgctgaccgacaacggcaacgtggtgctggacgtgcacaacctgcagatcaccgacccggtcgcgctggagcgcagcttgaaccagattcctggcgtggtctgcgtgggtctgttcgcgcgacgcccggccgatgtggtgatcgtcggtggcgaaccgccgagggtactctga

SEQ ID NO: 2913 - DNA, 693 bp, Xanthomonas axonopodis
ttgacgaatctcgactccccaatcacgaatcccgagctcttacccatgtccgaagcaaaacgcctggccgccgagaaagcgatcgattacgtggaagacggcatgatcgtcggagtgggcaccggttcgacggtggcttacttcatcgacgcgctgggccgcatcggccatcgcatcaagggcgccgtgtccagctccgaacagagcaccgcgcgcctgcgccagcatggcatcgaggtgctggacctcaatcacaccggcaatctgtcgctgtacgtggacggtgccgacgagtgcgacccgaaccgctgcctgatcaagggaggcggcgcagcgctgacgcgcgaaaagatcatcgccgaagccagcgagcgcttcatctgcatcgtcgacccgagcaagcaggtgccggtgctgggcaagttcccgctgccggtggaagtgattccgatggcgcgcagcctggtcgcccggcagatcctggcgctgaccggcggccagccggtgtggcgcgatggcgtggtgaccgacaacggcaacgtggtgctggacgtgcatcacctgcaagtcaccgacccggtgggcctggagcgcagcttgaaccagattcctggcgtggtctgcgtgggtttgttcgcgcggcgcccggccgacgtggtgatcgtgggcggcgagccaccgcaggtgatctga

SEQ ID NO: 2914 - DNA, 648 bp, Xanthomonas axonopodis
atgtccgaagcaaaacgcctggccgccgagaaagcgatcgattacgtggaagacggcatgatcgtcggagtgggcaccggttcgacggtggcttacttcatcgacgcgctgggccgcatcggccatcgcatcaagggcgccgtgtccagctccgaacagagcaccgcgcgcctgcgccagcatggcatcgaggtgctggacctcaatcacaccggcaatctgtcgctgtacgtggacggtgccgacgagtgcgacccgaaccgctgcctgatcaagggaggcggcgcagcgctgacgcgcgaaaagatcatcgccgaagccagcgagcgcttcatctgcatcgtcgacccgagcaagcaggtgccggtgctgggcaagttcccgctgccggtggaagtgattccgatggcgcgcagcctggtcgcccggcagatcctggcgctgaccggcggccagccggtgtggcgcgatggcgtggtgaccgacaacggcaacgtggtgctggacgtgcatcacctgcaagtcaccgacccggtgggcctggagcgcagcttgaaccagattcctggcgtggtctgcgtgggtttgttcgcgcggcgcccggccgacgtggtgatcgtgggcggcgagccaccgcaggtgatctga

SEQ ID NO: 2915 - DNA, 648 bp, Xanthomonas campestris
atgtccgaagcaaaacgcctggccgccgaaaaagcgatcgattacgtggaagacggcatgatcgtcggagtgggcaccggctcgacggtggcttacttcatcgacgcgctgggccgcatcggccatcgcatcaagggcgcagtgtccagctccgaacagagcaccgcgcgcctgcgccagcatggcgtcgaggtgctggacctcaatcacaccggcaatctgtcgctgtacgtggacggcgccgacgagtgcgacccgaaccgttgtctgatcaagggcggcggggcagcgctgacgcgcgagaagatcattgccgaggccagcgagcgcttcatctgcatcgtcgaccccagcaagcaggtgccggtgctgggcaagttcccgctgccggtggaagtgattccgatggcgcgcagcttggtcgcccgccagatcctggcgctcaccggcggccagccggtgtggcgcgatggcgtggtcaccgacaacggcaacgtggtgctggacgtgcatcacctgcagattaccgacccggtgggcctggagcgcagcttgaatcagattcccggcgtggtctgcgtgggtttgttcgcgcggcgcccggccgatgtggtgatcgtgggcggcgagccaccacaggtgatctga

SEQ ID NO: 2916 - DNA, 648 bp, Xanthomonas oryzae
atgtccgaagcaaaacgcctggccgccgaaaaagcgatcgattacgtggaagacggcatgatcgtcggagtcggtaccggctcgacggtggcctacttcatcgacgcgcttggccacatcggccatcgcatcaagggcgcagtctccagctccgaacagagcaccgcgcgcctgcgccagcacggcatcgaagtgctggacctcaatcacaccggcaatctgtcgctgtacgtggacggcgccgacgagtgcgacccgaaccgctgcctgatcaagggcggcggcgcagcgctgacgcgcgagaagatcatcgccgaggccagcgagcgcttcatctgcatcgtcgaccccagcaagcaggtgccggtgctgggcaaatttccgctgccggtggaagtgattccgatggcgcgcagcctggtggcccgacagatcctggcgctgaccggcggccagccggtgtggcgcgatgtcgtgctgaccgacaacggcaacgtggtgctggacgtgcacaacctgcagatcaccgacccggtcgcgctggagcgcagcttgaaccagattcctggcgtggtctgcgtgggtctgttcgcgcgacgcccggccgatgtggtgatcgtcggtggcgaaccgccgagggtactctga

SEQ ID NO: 2917 - DNA, 648 bp, Xanthomonas oryzae
atgtccgaagcaaaacgcctggccgccgaaaaagcgatcgattacgtggaagacggcatgatcgtcggagtcggtaccggctcgacggtggcctacttcatcgacgcgcttggccacatcggccatcgcatcaagggcgcagtctccagctccgaacagagcaccgcgcgcctgcgccagcacggcatcgaagtgctggacctcaatcacaccggcaatctgtcgctgtacgtggacggcgccgacgagtgcgacccgaaccgctgcctgatcaagggcggcggcgcagcgctgacgcgcgagaagatcatcgccgaggccagcgagcgcttcatctgcatcgtcgaccccagcaagcaggtgccggtgctgggcaaatttccgctgccggtggaagtgattccgatggcgcgcagcctggtggcccgacagatcctggcgctgaccggcggccagccggtgtggcgcgatggcgtggtgaccgacaacggcaacgtggtgctggacgtgcacaacctgcagatcaccgacccggtcgcgctggagcgcagcttgaaccagattcctggcgtggtctgcgtgggtctgttcgcgcgacgcccggccgatgtggtgatcgtcggtggcgaaccgccgagggtactctga

SEQ ID NO: 2918 - DNA, 648 bp, Xanthomonas oryzae
atgtccgaagcaaaacgcctggccgccgaaaaagcgatcgattacgtggaagacggcatgattgtcggagtcggtaccggctcgacggtggcctacttcatcgacgcgctgggccgcatcggccatcgcatcaagggcgcagtgtccagctccgaacagagcaccgcgcgcctgcgccagcatggcatcgaggtgctggacctcaatcacaccggcaatctgtcgctgtacgtggacggtgccgacgagtgcgacccgaaccgctgcctgatcaagggcggcggcgcagcgctgacgcgcgagaagatcatcgccgaggccagcgagcgcttcatctgcatcgtcgaccccagcaagcaggtgccggtgctgggcaaatttccgctgccggtggaggtgattccgatggcacgcagcctggtggcccggcagatcctggcgctgaccggcggccagccggtgtggcgcgatggcgtggtgaccgacaacggcaacgttgtgctggacgtgcacaacctgcggatcaccgacccggtcgcgctggagcgcagcttgaaccagcttcccggcgtggtctgcgtgggtctgttcgcgcgacgcccggccgatgtggtgatcgtcggtggcgaaccgccgcgggtactctga

SEQ ID NO: 2919 - DNA, 648 bp, Xanthomonas campestris
atgtccgaagcaaaacgcctggccgccgagaaggcgatcgattacgtggaagacggcatgatcgtcggggtcggcaccggctcgacggtggcgtatttcatcgacgcactcggccgcatcggccatcgcatcaagggtgcggtgtccagctcggaacagagcaccgcgcggctgcgccagcacggcatcgaggtgctggacctcaaccacaccggcacgctgtcgctgtatgtggatggcgccgacgagtgcgacccgaaccgctgcctgatcaagggcggcggcgcggcgctcacgcgcgagaagatcattgccgaagcgagcgagcgcttcatctgcatcgtcgacccgagcaagcaggtgccggtgctgggcaacttcccgctgccggtggaggtgatcccgatggcgcgcagcctggtggcccggcagatcctggcgctcacgggcgggcagccggtctggcgtgacggcgtggtcaccgacaacggcaacgtggtgctggatgtgcacaacctgcacatcaccgacccggtggcgctggagcgtaacttgaatcagattcccggcgtggtctgcgtgggtctgttcgcgcgccgcccggccgacgtggtgatcgtcggcggcgagacaccgcgcgtgctgtaa

SEQ ID NO: 2920 - DNA, 714 bp, Xylella fastidiosa
gtgaactcaacacagccagccaatgcctgtgcgccttcccacatccccatcatcattgataaccccatgagcgaagcaaaacggcgcgccgccgaaaaggccatcgaatacgtcgagaacgatatgattatcggcgtcggcaccggctcaacagtcgcctacttcatcgacgcactaggacacaccccaaaacgcatcaaaggtgcagtatccagctccgaacagagcacagcacatttaaaacaacacggaattgaagtcctggaactcaatcataccggaacactcccactctatgtggacggtgcagacgagtgcgacccttacaaacgccttatcaaaggaggcggcgcatcattaacacgcgagaagatcatcgctgaagcaagcaaacaattcatttgtatcatcgacccaaacaaacaggtagcaacactaggcaagttcccactacccatcgaagtgatcccaatggcacgcagcttggttgcaaggcaaatcatggcacgtaccgacggtcaaccagtatggcgtgaaggggtcattacagataacggcaacgttatcctggatgtacatcacttatgcatcaccgacccggtaaagctagagcaagaactcaatcaaatcccaggggtcgtctgcgtcggcctgttcgcccgtcgctgtgcggacctagttatcatcggcagcgaaccgccgcacatactctga

SEQ ID NO: 2921 - DNA, 738 bp, Xylella fastidiosa
atggaaattgctactgtcactagagtgaactcaacacaaccagccaatgcctgtgcgccttcccacatccccatcatcattgataaccccatgagcgaagcaaaacggcgcgccgccgaaaaggccatagaatacgtcgagaacgatatgattatcggcgtcggcaccggctcaacagtcgcctacttcatcgacgcactaggacgcaccccaaaacgcatcaaaggtgcagtatccagctccgaacagagcacagcacatttaaaacaacacggaattgaggtcctggaactcaatcataccggcacactcccactctatgtggacggtgcagacgagtgcgacccgtacaaacgccttatcaaaggaggcggcgcatcattaacacgcgagaagatcatcgctgaagcaagcaaacaattcatttgtatcatcgacccaaacaaacaggtagcaacactaggcaagttcccactacccatcgaagtgatcccaatggcacgcagcttggttgcaaggcaaatcatggcacgtaccgacggtcaaccagtatggcgtgaaggggtcattaccgataacggcaacgttatcctggatgtacatcacttatgcatcaccgacccggtaaagctagagcaagaactcaatcaaatcccaggggtcgtctgcgtcggcctgttcgcccgtcgctgtgcggacctagttatcatcggcagcgaaccgccgcacatactctga

SEQ ID NO: 2922 - DNA, 738 bp, Xylella fastidiosa
atggaaactgctactgtcactagagtgaactcaacacagccagccaatgcctgtgcgccttcccacatcccaatcatcattaataaccccatgagcgaagcaaaacggcgcgccgccgaaaaggccatcgaatacgtcgagaacgatatgattatcggcgtcggcaccggctcaacagtcgcctacttcatcgacgcactaggacgtacccccaaacgcatcaaaggtgcagtatccagctccgaacagagcacagcacatttaaaacaacacgggatcgaggtcctggaactcaatcatactggcacactccccctctatgtagacggtgcagacgagtgcgacccgtacaaacgccttatcaaaggaggcggcgcatcattaacacgcgagaagatcatcgctgaagcaagcaaacaattcatttgtatcatcgacccaaacaaacaggtagcaacactaggcaagctccccctacccatcgaagtgatcccaatggcacgcagcttggttgcaaggcaaatcatggcacgtaccgacggtcaaccagtatggcgtgagggggtgattaccgataacggcaacgttatcctggatgtacatcacttacgcatcaccgacccggtaaagctagagcaagaactcaatcaaatcccaggggtcgtctgcgtcggcctgttcgcccgtcgctgtgcagacctagttatcatcggcagcgaaccgccgcacatactctga

SEQ ID NO: 2923 - DNA, 648 bp, Xylella fastidiosa
atgagcgaagcaaaacggcgcgccgccgaaaaggccatcgaatacgtcgagaacgatatgattatcggcgtcggcaccggctcaacagtcgcctacttcatcgacgcactaggacgtacccccaaacgcatcaaaggtgcagtatccagctccgaacagagcacagcacatttaaaacaacacgggatcgaggtcctggaactcaatcatactggcacactccccctctatgtagacggtgcagacgagtgcgacccgtacaaacgccttatcaaaggaggcggcgcatcattaacacgcgagaagatcatcgctgaagcaagcaaacaattcatttgtatcatcgacccaaacaaacaggtagcaacactaggcaagctccccctacccatcgaagtgatcccaatggcacgcagcttggttgcaaggcaaatcatggcacgtaccgacggtcaaccagtatggcgtgagggggtgattaccgataacggcaacgttatcctggatgtacatcacttacgcatcaccgacccggtaaagctagagcaagaactcaatcaaatcccaggggtcgtctgcgtcggcctgttcgcccgtcgctgtgcagacctagttatcatcggcagcgaaccgccgcacatactctga

SEQ ID NO: 2924 - DNA, 648 bp, Xylella fastidiosa
atgagcgaagcaaaacggcgcgccgccgaaaaggccatagaatacgtcgagaacgatatgattatcggcgtcggcaccggctcaacagtcgcctacttcatcgacgcactaggacgcaccccaaaacgcatcaaaggtgcagtatccagctccgaacagagcacagcacatttaaaacaacacggaattgaggtcctggaactcaatcataccggcacactcccactctatgtggacggtgcagacgagtgcgacccgtacaaacgccttatcaaaggaggcggcgcatcattaacacgcgagaagatcatcgctgaagcaagcaaacaattcatttgtatcatcgacccaaacaaacaggtagcaacactaggcaagttcccactacccatcgaagtgatcccaatggcacgcagcttggttgcaaggcaaatcatggcacgtaccgacggtcaaccagtatggcgtgaaggggtcattaccgataacggcaacgttatcctggatgtacatcacttatgcatcaccgacccggtaaagctagagcaagaactcaatcaaatcccaggggtcgtctgcgtcggcctgttcgcccgtcgctgtgcggacctagttatcatcggcagcgaaccgccgcacatactctga

SEQ ID NO: 2925 - DNA, 648 bp, Xylella fastidiosa
atgagcgaagcaaaacggcgcgccgccgaaaaggccatcgaatacgtcgagaacgatatgattatcggcgtcggcaccggctcaacagtcgcctacttcatcgacgcactaggacacaccccaaaacgcatcaaaggtgcagtatccagctccgaacagagcacagcacatttaaaacaacacggaattgaagtcctggaactcaatcataccggaacactcccactctatgtggacggtgcagacgagtgcgacccttacaaacgccttatcaaaggaggcggcgcatcattaacacgcgagaagatcatcgctgaagcaagcaaacaattcatttgtatcatcgacccaaacaaacaggtagcaacactaggcaagttcccactacccatcgaagtgatcccaatggcacgcagcttggttgcaaggcaaatcatggcacgtaccgacggtcaaccagtatggcgtgaaggggtcattacagataacggcaacgttatcctggatgtacatcacttatgcatcaccgacccggtaaagctagagcaagaactcaatcaaatcccaggggtcgtctgcgtcggcctgttcgcccgtcgctgtgcggacctagttatcatcggcagcgaaccgccgcacatactctga

SEQ ID NO: 2926 - DNA, 648 bp, Xylella fastidiosa
atgagcgaagcaaaacggcgcgccgccgaaaaggccatcgaatacgtcgagaacgatatgattatcggcgtcggcaccggctcaacagtcgcctacttcatcgacgcactaggacacacccccaaacgcatcaaaggtgcagtatccagctccgaacagagcacagcacatttaaaacaacacggaattgaagtcctggaactcaatcataccggcacactcccactctatgtggacggtgcagacgagtgcgacccgtacaaacgccttatcaaaggaggcggcgcatcattaacacgcgagaagatcatcgctgaagcaagcaaacaattcatttgtatcatcgacccaaacaaacaggtagcaacactaggcaaattcccactacccatcgaagtgatcccaatggcacgcagcttggttgcaaggcaaatcatgacacttaccgacggtcaaccagtatggcgtgaaggggtcattaccgataacggcaacgttatcctggatgtacatcacttatgcatcaccgacccggtaaagctagagcaagaactcaatcaaatcccaggggtcgtctgcgtcggcctgttcgcccgtcgctgtgcggacctagttatcatcggcagcgaaccgccgcacatactctga

SEQ ID NO: 2927 - DNA, 690 bp, Acidovorax sp. JS42
atgactgcacccacatccctttcccaagacgaactcaagaccctggtcggccaagctgcactgcaatatgtggtgccgggcgaactggtgggcgtggggaccggctctaccgtcaacaagttcattgacgcgctggcatctatcaaggacagcatccgcggcgcggtttccagctccgaagccagtacggcgcggctgaaggcgctgggcatccccgtgctggacgccaacgatgtgcgctcgctgtcggtgtacatcgatggcgccgacgagatcgacggcaacggctacatggtcaagggcggaggggcggccctcacgcgcgagaagatcgtcgccgcgctggcacggcgctttgtgtgcatagcggacgagtccaagctggtgaacgtgctgggcgcgttcccgctgccggtggaggtcattccgatggccgccgcgtacatcgcgcggcgcttcgagtcgctgggggggcaggcgacgctgcgtctcaaggatggccaaccgctcgtgaccgacaacggccaacacatactggatgtgcgcggcctcaccatcagcgatccgctggcgttcgagaccgaggtgaatcaatggccgggggtggtgacggtgggcgtgtttgcgctgcagaaggccaacgtctgcctgctgggcacggcacagggcgtgcgtacgctgtccctgtaa

SEQ ID NO: 2928 - DNA, 690 bp, Diaphorobacter sp. TPSY
atgactgcacccacatccctttcccaagacgaactcaagaccctggtcggccaagctgcactgcaatatgtggtgccgggcgaactggtgggcgtggggaccggctctaccgtcaacaagttcattgacgcgctggcatctatcaaggacagcatccgcggcgcggtttccagctccgaagccagcacggcgcggctgaaggcgctgggcatccccgtgctggacgccaacgacgtgcgcttgctgtcggtgtacatcgatggcgccgacgagatcgacggcaacggctacatggtcaagggcggaggggcggccctcacgcgcgagaagatcgtcgccgcgctggcacggcgctttgtgtgcatagcggacgagtccaagctggtgaacgtgctgggcgcgttcccgctgccggtggaggtcattccgatggccgccgcgtacatcgcgcggcgcttcgagtcgctgggggggcaggcgacgctgcgtctcaaggatggccaaccgctcgtgaccgacaacggccaacacatactggatgtgcgcggcctcaccatcagcgatccgctggcgttcgagaccgaggtgaatcaatggccgggggtggtgacggtgggcgtgtttgcgctgcagaaggccaacgtctgcctgctgggcacggcacagggcgtgcgtacgctgtccctgtaa

SEQ ID NO: 2929 - DNA, 699 bp, Comamonas testosteroni
atgacgacatctgctgcacctctttctcaagatgaactgaaaactttggtcggacaagctgccctgaaatatgtggtcgccggtgaaattgtgggcgtgggcacaggctccacggtcaacaaattcattgatgcactggccactatcaaggatcagattcctggcgccgtctccagctccgtggccagtaccgagcgcctgaaggccctgggcatcaaggtgttcgatgccaatgaagtcaccagtctggctgtctatatcgacggtgccgacgagattgacggcaagggccatatggtcaagggcggtggtgcggcgctgacgcgcgagaagatcgtggcggcgctggctcagcgttttgtctgcattgccgatgagtccaagcgcgtgccggtgctgggtaattttccgctgcccgtggaggtcattcccatggcggctgcccagatcgctcggcgctttgaagccatgggcgctgacgtgacggcgcagattcgcatgaaggatggtgcgccgctggtgaccgacaacggccagcatattctggatgtccgtggtctgaagatcgccgagccgctggccttcgagtccgaagtcaaccagtggcccggcgtcgtgaccgtcggcgtgtttgcccaccagaaggctgcggtgtgcctgctgggaaccgcacaaggcgtgcagacgctggaatactaa

SEQ ID NO: 2930 - DNA, 735 bp, Comamonas testosteroni
atggagataatcgcaggattacctggattttccctcatgacgacatctgctgcacctctttctcaagatgaactgaaaactttggtcggacaagctgccctgaaatatgtggtcgccggtgaaattgtgggcgtgggcacaggctccacggtcaacaaattcattgatgcactggccactatcaaggaccagattcccggtgccgtctccagctccgtggccagtaccgagcgcctgaaggccctgggcatcaaggtgttcgatgccaatgaagtcaccagtctggccgtctacatcgacggtgccgacgagatcgacggcaagggccatatggtcaagggcggcggtgcggcgctgacgcgcgagaagatcgtggcggcgctggctcagcgttttgtctgcattgccgatgagtccaagcgcgtgccagtgctgggcaattttccgctgcccgtggaagtcattcccatggcggctgcccagatcgcccgtcgctttgaagccatgggcgctgacgtgacggcgcagattcgcatgaaggatggtgcgccgctggtgaccgacaatggccagcatattctggatgtccgcggcctgaagatcgccgagccgctggccttcgagtccgaagtcaaccagtggccaggcgtggtgaccgtcggcgtgtttgctcaccagaaggctgcggtgtgcctgctgggaaccgctcaaggcgtgcagacgctggaatactga

SEQ ID NO: 2931 - DNA, 693 bp, Delftia acidovorans SPH-1
atgacgacatctgctgcctctttttcccaagatgaactcaaagccctggtcgggcaagccgccctggcctatgtggtgcccggcgaaatcgtcggcgttggcaccggctccacggtcaacaagttcatcgatgcactggccaccatcaaggaccagatcccgggcgccgtgtccagctccgtggccagcaccgagcgcctgaaggcgctgggcatcaacgtgctggatgccaacgaagtcgccagcctttcggtctacatcgacggagccgacgagatcgacggccgcggctacatggtcaagggtggcggcgccgcgctgacgcgcgagaagatcgtcgctgcgctggccgagcgctttgtctgcattgccgatgcctccaagcgcgtcgaggtactcggagactttccgctgcctgtggaggtgattcccatggcggctgcacagattgcgaaccacttcaaggccatgggtggccgtgccgagatccgcatgaaggacggcgcgcccctggtgacggacaacggccagcacattcttgatgtgcgtggcctgaagatcgccgagcccctggccttcgagtccgaggtcaaccagtggcccggcgtggtgaccgtgggagtgtttgcgcaccagaaggcatcggtctgcctgctgggcacgcccgagggcgtgcagacgctcaactattga

SEQ ID NO: 2932 - DNA, 768 bp, Verminephrobacter eiseniae EF01-2
atgacgaccacgccccctttgcctcggcaattgccccggggcctgacccaagacgaactcaagacccgcgtcggccaggccgctttgcgctatgtgctgccgggcgatatcgtgggggtgggcacgggctctaccgtgaacaagttcatcgatgctctggcgggcatgaaagagcagatcaagggcgccgtgtccagttcggtggcaagcaccgaacgcctgcaggccctgggcatcgcggtgttcgatgccaatgccgtgccgtcgctatcggtctgcatcgacggggccgacgaaatcgatggccagggccatatgctcaagggcggcggcgccgcgttgacgcgcgagaagatcgtggcagcgctggccgagcgcttcgtctgtattgccgacgagtcgaaactggtgcgcacactggggcaatttcccctgcccgtcgaggtgatcccgatggcggccaggcacatcgcccgccgttttgcagccatgggcgggcaggccagtctgcggctcaggaacgggcaggcgctggtgaccgacaacggccagcatatcctcgatgtcaagggactgtcgatcaccgacccgctggcgttcgagtcgcaagtcaaccaatggccgggcgtggtgaccgtgggggtgtttgcgcaccagaaggcatcggtctgcctgttgggcacggcccagggggtcaagaccctggtttacccggggccggacaggccggagccggcgacccgccgatgctccgcatcaaaccattag

SEQ ID NO: 2933 - DNA, 693 bp, Acidovorax delafieldii
atgacgacttcctctcccctgacccaagacgaactcaaggccctggtgggccaggctgccctgcagtatgtggtgcccggcgacatcgtgggggtgggcaccggctccacggtcaacaagttcatcgacgccctggcgggcatgaaggaccagattcggggcgccgtctccagttcgatcgcgagcacggagcgcctcaaggcgctggggattgcggtattcgatgccaatgatgtcgaatcgctggcggtgtacatcgacggtgcggacgaagtcgacggccagggatacatggtgaaaggcggcggcgccgcactcacgcgcgagaaaattgtggcggcactggcgcgccgtttcgtctgcatcgtcgacgaatccaagctcgtgccttcgctggggcgctttcccttgccggtggaggtgattcccatggccgctcagcacatcgggcgacgcttcgccgcgctcggtggcgaagcgcgcttgcgcctcaaggacggtgaaccattggtgacagacaacggccagcacatcctggatgtgaccggcctttcgatcaccgaccccctggcattcgagtccgaggtgaaccagtggcctggcgtggtgacggtgggggtgttcgcgcaccagaaggcgtcggtttgccttatgggcacggcccaaggcgtggtgaagaccttcacctactga

SEQ ID NO: 2934 - DNA, 693 bp, Acidovorax citrulli AAC00-1
atgaccactcccgcacccctttcccaagatgaactcaaagccctggtgggccaggccgcgctgaaatacgtggtgcccggcgacatcgtcggcgtcggcacgggctcgacggtgaaccagttcatccaggcactgggttcgatgaaggaccgcatccggggcgcggtgtcgagttccgaggccagcacgcagcggctgcgtgcgctgggcattccggtcttcgacgccaacgaggtggagtccctgtccgtctatatcgatggcgcggacgagatcgatccgcgaggccacatggtcaagggcggtggcgctgcactcacgcgcgagaagatcgtggcggccctggcccggcagttcgtatgcatcgccgacgtctccaagctggtggagacgctgggccggtttccgcttccggtcgaggtgattcccatggcggcgcagcagatcgcgcgccggttcgccacgcggggcgggcaggcggtgttgcgccggggggcggacggacagccgctggtcacggacaaccagcagtacatcctcgacgtgaagggcctctcgatccaggatccgctggcgttcgagtcggaggtcagccagtggccgggcgtggtgacggtgggcgtcttcgcccatcagaaggccgacgtggcgctgatcggtgcgccggagggtgtccggactttcacgtactga

SEQ ID NO: 2935 - DNA, 693 bp, Acidovorax avenae subsp. avenae ATCC 19860
atgaccactcccgcatccctttcccaagatgaactcaaggccctggtaggccaggccgcgctgaagtacgtggtgcccggcgacatcatcggcgtcggcaccggctcgacggtgaaccagttcatccaggcgctgggcccgatgaaggacaaaatccggggcgcggtatcgagctccgaggccagcacgcagcggctgcgtgcgctgggcattccggtcttcgacgccaatgaggtggagtccctgtccgtctatatcgatggcgcggacgagatcgatccgcggggccacatggtcaaggggggcggcgctgcgctgacccgcgaaaagatcgtcgcggccctggccaggcagttcgtgtgcatcgccgatgcgtccaagctggtggagacgctgggccggttcccgctgccggtcgaggtgattcccatggcggcgcagcagatcacgcgccggttcgccgcgcggggcggccaggccgtgttgcgccggggagcggacggacagccgctggtcaccgacaaccagcagcacatcctcgatgtgacggggctgtcgatccaggatccgctggcgttcgaatcggaagtcaaccagtggccgggcgtggtgaccgtgggcgttttcgcccaccagaaggcccacgtggcgctgatcggtgcgccggagggcgtccggaccgtcacgtactga

SEQ ID NO: 2936 - DNA, 705 bp, Rhodoferax ferrireducens T118
atgacaaaccctatttcccaagctgcgggcgcgctttcgcaagatgaactcaaaaccctggtcggccaggccgcgctgcagtacgtggcgccgggcgaaatcgttggcgttggcaccggttctaccgtgaacaaattcatcgacgccctggccagcataagacatttgatcaagggtgcggtctccagttcggaagccagtaccctgcgcttgaaggccttgggcattcctgtctttgatgccaatgaggtggccgagttatcggtttatatcgatggtgccgatgagatcgacggccacggcaacatgatcaagggcggtggggcagcgctcacgcgcgagaagattgtggcggcgctcgccaaccaattcgtctgcatcgccgatgagtccaagctggttcagaccctgggccggtatcccttgccggtcgaaatcattcccatggcggcgcagcggatcacacagcagtttgctgcgctggggggccgggcgcaggtgcgtctcaaaggcgatcagccgctggtgacggataacggtcagattctccttgacgtgaccggattacagataagcgacccgctggccttcgagacgctggtcagtcagtggccgggtgtggtgacagtgggtgtttttgcctatcaaaaggcccaggtgtgcctcttgggcacggcccgaggggtcaagactttgactttctga

SEQ ID NO: 2937 - DNA, 750 bp, unknown
  Curvibacter putative symbiont of Hydra magnipapillata
attcctgctttcagatttcaactccctccattgtccctcaggacctttcaggctttcctcatgaccacacctgcactctcccaagatgaactcaaaaccctggtcggccaggccgccctgcagtacgtggtgcccggcgagatcgtgggcgtgggcaccggctccaccgtgaacaaattcattgacgcgctggccaccatcaaggaccagatcaagggcgctgtgtccagctcagtcgcgagcactgagcgcctgcaggcgctgggcatccaggtgtttgacagcaacgaggtggacaagctctcggtctatatcgacggtgccgacgagattgatggcgctggcaacatggtcaagggcggcggtgccgcgctgacccgcgaaaaaatcgtagccgcccaaagcgccaagttcgtgtgcattgcggatgagtccaagctggtgcaaacactgggcaagtttcccttgccggtggaggtcatccccatggcgacgcagcgcgtcatcgcccagtttgcagctaaaggtggcaaaggttccatccgcctgaaggacggcaaacccctagtgaccgacaacggccagtacatcgtggacgtaaccggcctgcagatcaccgacccacaggccttcgaagctgaggtgagccagtggcctggcgtggtgacggtgggtgtgttcgcctaccagcgcgcccaggtgtgcttgctgggcaccgccagtggtgtgaaaacgctggcgtttcaataa

SEQ ID NO: 2938 - DNA, 750 bp, Polaromonas naphthalenivorans CJ2
atgagttctgattgtcgcaaaatcccgcctcgtcccaacccgatcccccaaacctctccaaacctcgcaaggcacaccatgacccaagacgaactcaaaaccctggtcggccaggctgcgctgaattatgtggaagccggcagcatcgtcggcgtcggcaccggctccacggtcaacaaattcatcgacgcgttggcgaccatcaaagaccagattgccggcgccgtgtccagctcgaacgcctcgaccgagcggctgcaggcgctgggcatcaaggtgttcgatgcgaccgaggtggacgagctgggcgtctatattgacggcgccgacgagatcgaccacgccggctacatggtcaagggcggcggcgcggcgctgacgcgcgaaaaaatcgtcgccgcgcagtcgcgcaggttcatctgcattgccgacaagtccaaatacgtggccacgctgggcggctttcccttgccggtggaaatcattcccatggccacccggcgcattgcgcgccagtttgaagccatgggcggcgcggcgaccgtgcgccacaaggacggcaagccgctggtgaccgacaacggccagcacatcctggacgtgaccggcctgaagattgccgacccgctggccttcgagtccgaggtcagccagtggcccggcgtggtgacggtaggggtgtttgcgttccagaaggcccatgtgtgcctgctgggaacggacgacggggttgaaaccctggtgttttaa

SEQ ID NO: 2939 - DNA, 723 bp, Polaromonas sp. JS666
ttgtcgcaaaaaccaacctctcatccttacaagcccaacatgactcaagacgaactcaaagccctggtcggccaggccgccctgccatacgtggaacccggcagcattgtcggcgtgggcaccggctccactgtcaacaaattcatagatgcactggcaacgatgaaggaccgcattgccggcgcggtctccagttcggtggcgtctaccgaacgtctgcaggccatcggcatcaaggtgtttgatgccactgaggtggatgagctggccgtgtacatcgacggagccgacgagatcgaccacgcgggctacatgatcaagggtggtggcgcagcgctcacgcgcgaaaaaatcgtggcggcccagtcacgcaaatttgtctgtattgccgacgagtccaaactggtgcaaacgctgggcagctttcccttgccggtggaggtgattccgatggccgccaggcgcattgctcgccagtttgccgcgctgggcggtacggcgaccttgcggtctaaaggtggagcggagagcggcgaaccgctggtgaccgacaacggccagcatattctggacgtgacgggcctgaagatcaccgaccccttggggtttgagtcccaggtaaaccagtggccaggggttgttacggtgggggtgtttgccttccagaaggctcatgtgtgcctgctgggggcgtcggacggtgtcaggaccctggtgttttaa

SEQ ID NO: 2940 - DNA, 732 bp, Variovorax paradoxus
atgactgcacccgtttccccatcttccgccgacggcgccgcgaacggcgcgggcgccatcacccaggacgaactcaaggcgcaggtcggccgcgccgcgctggcctacgtggccaagggtgaaatcgtcggcgtgggcacgggctccacggtgaacaagttcatcgacgcgctggccaccatcaaggaccagatcaagggcgcggtgtccagctcggtggcctcgaccgagcgcctgcgcgccctgggcatcccggtgttcgacagcaacgaggtcgacgaactcggcgtctacatcgacggcgccgacgagatcgacccccgcggtttcatggtgaagggcggcggcgcagcgctcacgcgcgagaagatcgtggcggcgcagtcgcggcgcttcgtctgcatcgccgatgcatccaagctggtcgatacactcggcgcctttccgctgccggtggaggtgattccgatggcggcgcgccgcgtgatgcggcagttcgaggccatgggcggcatcgcacaggtgcgcgagaaggacggattgccgctcgtgaccgacaacggccagcacatcgtcgacgtgacggggctgcggatcagcgatccgctcgccttcgaatccgaggtgagccagtggcccggcgtggtcacggtcggcgtgtttgcccatcagaaggccgacgtgtgcctgctgggcacgcccgcgggcgtgcgaacgatgcagttcgactga

SEQ ID NO: 2941 - DNA, 663 bp, Leptothrix cholodnii
atgactcaagacgaactcaaggccctggtgggccaggccgccgtggcctacgtgcccgatggcagcgtggtcggcgtgggcaccggctccaccgtcaactgcttcatcgacgccctggccgccatcaaggaccgcatcgccggcgcggtatcgagctcggtgcgcagcaccgaacggctgcaggcgctgggcatcccggtgctcgacctctcgcaggtcgagcgcatcccggtctacatcgacggcgccgacgagatcgacccgcgcggccacatgatcaagggcggcggcgccgcactcacgcgcgagaagatcgtcgccgacctggccgagcgcttcgtctgcatcgccgacgccagcaagcgggtcgacgtgatggggcgctttccgctgccggtcgaggtgatcccgatggcggcggcgcaggtggcacggcgcttcggtgcggcctacggcggcctggcccgggtgcgcgagggcgtggtcaccgacaacggcaacctgatcctcgacgtcaccggcctgcacatcgccgacccgctggcgatggagaccgaggtcaaccagtggccgggcgtcgtctgcgtgggcatcttcgcccgccacaaggccgcggtctgcctgctaggcacgcctgaaggcgtgcgcacgctcaacttctga

SEQ ID NO: 2942 - DNA, 660 bp, Methylibium petroleiphilum PM1
atgaaccaggatgaactgaagaccctcgtcggccgcgctgcactcgagtacgtgcccgaaggcagcatcgttggcgtcggcaccggctcgaccgtcaactgcttcatcgacgcactggcgggtatcaaggagcgtatcgccggggccgtgtcgagctcggtcaagagcaccgagcggctgcgcgagaagggcatccgtgtgttcgaggccgccgcggtcgaatcgctgccggtctacatcgacggcgcagacgagatcgacccccacggctgcatgatcaagggcggtggcgcggcgctgacgcgagagaagatcgtggccgatctggccgagcgtttcgtctgcatcgccgatgcctccaagctggtggacgtgctggggcgctttccgttgccggtcgaggtgctgccgatggcggtgagccagatccagcggcgctttgcgaagctgggcgcgaccgcgaccgtgcgcgagggtgtgatcaccgacaacggtcagctgatcctcgatgttcagggcctgcgcatcggcgacccgctggccttcgagaccgaggtcaaccagtggcccggtgtggtgaccgtgggcgtgttcgcgcggcacaaggccagcgtctgcctgctgggcacgcccgaaggcgtgaagacgctgcgcttctga

SEQ ID NO: 2943 - DNA, 660 bp, Ralstonia metallidurans CH34
atgacgcaggacgagatcaaggccatggtcgcccgtgcggcgctgccgcacgtgctgcccggcagcatcatcggcgtgggtaccggatcgacggtgaaccacttcatcgacgcgctgtcctcgcttcgcgagggcatcgccggcgcggtgtcgagcagcaatgcgaccacggccaggctgcgcgggcatggcattcgagtcctcgaggccggcgaagtcgaacaactggctctgtacgtggatggcgccgacgagatcgacccgcacggtcacatgatcaagggtggcggtgcggcgctcacgcgcgagaagatcgtggccgacttggcgcagcgcttcctgtgcatcgccgacgcatccaagaaagtcgaggtgctgggacggttcccgctacccgtcgaggtgatcgacgtcgccgccacgcgcatcgcccgccgcttcgcggcgatcggcggccgtgccgttctgcgcaagggtgtcgtcaccgacaacggccacccgatcctcgacgtgcacggccttgccatcgccgacccgccggcgttggaggccgagatcaaccagtggcccggcgtggtgacggtcggactgttcgcgcgccaccgcgcccatgcgtgcctgctgggcacccccgagggtgtgctcacgctgcagttctga

SEQ ID NO: 2944 - DNA, 672 bp, unknown
  uncultured bacterium
atgacgcaagacgaaatgaaaaccctggtgggcctggcggccctggaccatgtgcaagccggcagcatcgtgggcgtgggcaccggctcgacggtggacaagttcatcgatgcgctgggcgccgcgctcaagaccgatccgcaacgcgtggtcggcgccgtgtccagctcggtgcgcagcacggagcgcctgcaatccctgggcgtgaaggtgctgccggccgaatcggtcagccgcctggcggtctacatcgacggcgccgacgagatcaaccaccagggcgacatgatcaagggtgggggcgctgccttgacccgcgaaaagatcgtggccgacctggccgagcgtttcgtgtgcatcgccgacgagaccaagctggtgcagaccctgggcaagttcccgctgcctgtcgaggtgatcccgatggcggccgcccaggtcatccgggcgtttgccgcccagggtggccaagccagggtgcgcgaaggcgtggtcaccgacaacggcaacctgatcgtggacgtgaccggcttgtcgatcaccgacccggcccggttggaatcagacgtgaaccaatggccgggcgtggtcaccgtgggcatctttgcccgcaaccgcgcctcggtgtgcctgttgggcacgccgaacggggtcaagaccctgaacttttaa

SEQ ID NO: 2945 - DNA, 678 bp, Oxalobacter formigenes
atggcccaagacgatctgaaactttctgttgcccgtgctgctgtaaaatatgttcccgaaggaaaaatcattggcgttggaaccggttccaccgccaatttttttattgatgagcttgccaaaatcaaggaccggattaccggagcggtagcctcgtcgaaagcgaccgccgaacggcttgccgcacatggcatccgggtcttcaacctgaccgaagtcgaggaaatacccgtctatatcgacggagccgacgaaatcacccgttccggcgcgatgatcaagggagggggcggagccctgacacgggaaaaaatcattgcctcggccgctgcccgattcatctgcatcgcagacgaatccaagctggtcgcgacactcggcaaatttccattgcccgttgaagtcataccgatggcttacaagctcgtcgccggaaaactggatgcactgggcggccgcgccgaactccggatacgggacgggaaaccgtttgtcaccgacaacggcaacctcattctcgacgtctttggactgcaaatcggccatccacttcggctggaagaaaaaatcaacaatttcaccggtgtcgtcaccgtcggcctgtttgcgcaaaggggcgccgacctttgccttctgggcagtcccgacggtgtcggaacactggaatttggcaactga

SEQ ID NO: 2946 - DNA, 678 bp, Oxalobacter formigenes
atgtcacaagacgatctgaagctttctgtcgcgcgcgcggctatacaatacattccggaaggaaagattatcggcgttggaacaggttccaccgccaatttttttatcgatgaactggccagaatcaaaaatcgcatcgtcggagcggttgcctcctccagggcaacagctgaccgtctcgcctcacacggcattaaagtattcgatttgaacgacatcacggaaccactccctgtctatatcgatggcgcagacgaaatcacagccaaaggggccatgatcaaagggggcggcggtgcattgacacgcgaaaaaatcatcgcatcggcttccgaaaaattcatttgtattgccgatgaatcgaaactggtcgatatactgggaaaatttcccctgcctgtcgaagtcattccaatggcatcacaactgatcgccagaaaactcgccgtattcgggggcaaaccggtattgcgcatgaaagaaggcaaaccatttgtaaccgataacggaaatgtcattctggatgtatcgggtctccagataaaagacccggcaaatctggaagaaaaaatcaacaatattgtcggagtcgttactgtcggactcttcgcccgcactggtgcaaacctgtgtctgatgggttgctccgacggagtgaaaacactcgcctttcaataa

SEQ ID NO: 2947 - DNA, 672 bp, Janthinobacterium sp. Marseille
atgactcaagacgaaatgaaacaagcggtggcgcgtgctgccatcgattacgtagtggcgggtgaaatcatcggcgtcggtaccggttccacggccaatttcttcattgatgaattgggcaagatcaaggatcgcatcaagggcgcggtcgcttcatccgaagcaacggcagaacgccttcgtgcacatggcattaccattttcgatttgaacgatatcgattcgatgtcggtatatatcgacggcgcggatgaaatcacggcgcaaggcgcgatgatcaaaggcggtggtgccgccctgacgcgtgaaaaaatcgtggcttcggtcgccaaaaaattcgtctgtatcgctgatggttccaagctggtcgacaagcttggcaagtttccgctgccggtggaggtgatcccgatggcgcaggcggtggtggcgcgcaagctggccgcacttggcggtgagccgcgtttgcgcgtgaaagacggtaaagcggtcgtcaccgataacggctgctacatcatcgatgtgctgggtttgcagattgaagatccggcgacgctcgaagcgcagatcaacgatatcgtcggtgtggtgacggtaggcttgtttgcccgtcgcggtgccgatatcgctttgctcggtacggctgatggcgtcaacagcttgagcttctga

SEQ ID NO: 2948 - DNA, 672 bp, Herminiimonas arsenicoxydans
atgacccaagatgaaatgaaacaagcagttgcccgcgctgcaatcgaatatgttgttccgggtgaaattattggggtcggtaccggctctactgccaattttttcatcgacgaactgggcaaaatcaaggatcgcatcaaaggcgcagtcgcttcatcggaagcgaccgcacaacgcctgaaatcgcatggcattgctgttttcgatctgaacgagatcgatgccatgtcggtatatatcgacggtgcggatgaaatcactgcgcaaggggcaatgatcaagggcggcggcgcggcactgacgcgtgaaaaaatcgttgcttctgtcgccaaacaatttgtttgcattgccgatggctcgaaactggtggatctgctgggcaatttccccttgccggtggaagtgattccgatggcgcaagcggtggtggcgcgcaagctggcggcactgggcggcgaaccgcgtctgcgattgaaggatggcaagccgctggtgaccgataatggctgcttcatcattgatgtgctgggcttgaagattcaagatcctgccgaactggaagcgcagatcaacaatatcgtcggggtggtaacggtcggcctgtttgcacggcgcggcgccgatattgccttgctcggcacggcagaaggcgtcaagcgtctgacgttctag

SEQ ID NO: 2949 - DNA, 687 bp, Ralstonia eutropha
atgactcaggatgaactcaaggcgctggtcgcgcaagctgccgccgactacgtgaagcaggaagtgcccgaaggggcagtgctcggggtgggcactggctccactgccaatctcttcattgacgccgtggcggcattcaaggagcgcttcgccggtgcggtgtcgagctccgaggcctccacgcgccgcctgcagcagcacggcttcaaggtgctggacctgaacgaagtcgacgagatcccggtgtatgtcgacggcgccgacgagatcgacgccagcggcgccatgatcaagggcggcggcggggcgctcacgcgcgagaagatcgtggcttcggtcgcgaagcgctttgtctgcatcgccgacggcagcaagctggtccagaccatgggcaccttcccgctgccggtcgaggtgattccgatggcacgtgcagcggtggcgcgcaagctgcaggccctgggtggccagccgcgtctgcgcatgaccaaggaaggcggcatctacaagaccgacaacggcaatgtgatcctggacgtggccggcctgaagatcgacgatccgcgcggcctggaacaggccgtcaaccaggtgccgggcgtggtcacggtgggcctgttcgcgttgcgcggcgcggatgtgttgctgctgggcaccggcgacggcgtgcagcgcactgactactga

SEQ ID NO: 2950 - DNA, 687 bp, Cupriavidus taiwanensis
atgactcaggatgaactcaaggcgctggtcgcgcaagccgccgccgactacgtgaagcaggaagtgcccgaaggggccgtgctcggcgtgggcaccggctccaccgccaaccttttcattgacgccgtggcggcgttcaaggaccgcttcgcgggtgcggtgtcgagctccgaggcttccacgcggcgcctgcagcagcacggattcaaggtgctggacctgaacgaggtcgacgagatcccggtgtatgtcgacggcgccgacgagatcgacgccagcggcgctatggtcaagggcggcggcggcgcgctcacgcgcgagaagatcgtcgcctcggtggccaggcgctttgtctgcatcgccgacggcagcaagctggtccagaccatgggcgcctttccgctgccggtcgaggtggtgccgatggcacgcgccgcggtggcgcgcaagctgcaggcgctgggcggccagccgcgcctgcgcatgaccaaggaaggcggcatctacaagaccgacaacggcaatgtgatcctcgacgtggcaggcctgaagatcgacgatccgcgcggcctggagcagaccatcaaccaggtgccgggcgtggtcacggtgggcctgttcgcgctgcgcggcgccgacgtgctgctgctgggcaccggcgacggcgtgcaacgcacggactactga

SEQ ID NO: 2951 - DNA, 687 bp, Ralstonia eutropha
atgactcaggatgaactcaaggcgctggtggcgcaagccgcggccgactacgtgaagcaggaagtcccggaaggcgccgtgctcggcgttggcaccggttccacggccaatcttttcattgacgccgtggcggcgttcaaggatcgcttcgcgggtgcggtatcgagctccgaggcgtccacgcgccggttgcaacagcatggcttcaaggtgctcgacctcaatgaagtcgacgatatccccgtctatgtcgacggcgccgacgagatcgacgcaagtggcgcgatgatcaagggcggtggcggcgcgctgacccgcgagaagatcgtggcctcggtcgccggccgtttcgtctgcatcgcggacggcagtaagctcgtcgaaacgatgggcgccttcccgctgcccgtcgaagtgattccgatggcacgcgcggcggtcgcgcgccaagtcgccgcgcttggcggccagccccgcctgcgcatgaacaaggacggcggcatttacaagaccgacaatggcaatgtgattctggacgtaagcggcctgaaaatcaccgatccgcgcgggttggaacagtcgatcaaccagattcccggcgtcgtgaccgtgggcctgttcgcgctgcgcggtgcgaacgtgctgctgctcggcacgggcgagggcgtgcagcgcaccgattactga

SEQ ID NO: 2952 - DNA, 687 bp, Ralstonia metallidurans CH34
atgactcaggatgaactcaaggcgctggtcgcgcaagctgccgctgactatgtgaagcaggaagtgcccgaaggcgccgttctcggcgtgggcaccggctccaccgccaatctcttcatcgacgccgtggcggcgttcaaggagcgcttttcgggcgcggtgtcgagttccgaggcctccacacgccgcttgcaacagcacggtttcaatgtgctcgatctgaacgaggtcgacagcattcccgtctatgtcgacggtgctgacgagatcgacaactcgggcgcgatgatcaagggcggcggcggtgcgctgacgcgcgagaagatcgttgcctcggtggcggaccgattcgtctgcattgccgacggcagcaagctggtgccgacgatgggcgcgtttccgctgccggtcgaggtgatcccgatggcacgcgcagcggtggcccgtagcctggcggcactaggcggtcagccgcgtctgcgcatgaccaaggaaggcggcatctacaagaccgacaacggcaacgtcattctggatgtctcgggcctgaagatcgagaacccgaaggcgctggagcagcaaatcaaccagctacccggcgtggtgaccgttggtctgttcgctctgcgcggagcaaatgtgctgttgctgggtaccgaacagggcgtgcagcgctcggattactga

SEQ ID NO: 2953 - DNA, 687 bp, Ralstonia pickettii
atgacgcaggatgaactgaaggcgctggtggcacaagccgccgcagactacgtattggccaacgtgcccgagggcgccgtgctgggtgtcggcaccggctcgacggccaacctgttcatcgacgcgatggcgccgcacaaggcacgcttcgccggtgcggtgtccagctccgaggcttcgacgcgccgcctacagggccacggctttacggtgctcgatctgaacgaagtcgacgccatccccgtctacgtggacggcgctgacgagatcgacgcctcgggcgccatgatcaagggcggcggcggtgcgctcacgcgcgaaaagatcgttgcctcggtcgccagcgtgtttgtctgcatcgccgatggaagcaagcttgtcgagacgatgggtgccttcccgctgccggtggaagtggtgcccatggcacgtgcggccgtggcgcgccaactggctgcgctgggcggtcagccgcgcctgcgcatgaccaaggaaggccagatctacaagaccgataacggcaacgtgatcatcgatgtggtgggcctgcgcattgccgatccgaagggcctggaatcggtggtcaacgagattccgggcgtggtgacggtcggcctgtttgccaagcgcggcgccaatgtgctgctgctggggaccgaagcgggcgtgcagcgtcgcgatttctga

SEQ ID NO: 2954 - DNA, 687 bp, Ralstonia pickettii
atgacgcaggatgaactgaaggcgttggtggcacaggccgccgcagactacgtattggccaacgtgcccgagggcgccgtgctgggtgtcggcaccggctcgacggccaacctgttcatcgacgcgatggcgccgcacaaggcgcggttcgccggcgcggtgtccagctcggaggcgtcgactcgccgcctgcagggccacggcttcacggtgctcgatttgaatgaggtcgatactattcccgtgtacgtggatggcgccgacgagatcgacgcttccggcgccatgatcaagggcggcggcggtgcgctcacgcgtgaaaagattgttgcctcggtggccaacgtgttcgtttgcatcgctgacggcagcaagctcgttgagacgatgggtgctttcccgttgccggtggaagtggtgccgatggcgcgcgccgccgtggcccgccaactggctgcgctgggcggtcagccgcgcctgcgcatgaccaaggagggccagatctacaagaccgataacggcaacgtgattctcgacgtgaccggcctgcgcattgccgatccgaagggcctggaatcggtggtcaacgagattccgggcgtggtgacggtcggcctgtttgccaagcgcggcgccaatgtgctgctgctggggaccgaagcgggcgtgcagcgtcgcgatttctga

SEQ ID NO: 2955 - DNA, 687 bp, Ralstonia solanacearum
atgacgcaggacgaactgaaggcactggtggcgcaagccgccgcagactacgtattggccaacgtgcccgagggcgccgtgctgggggtcggcaccggttcgaccgccaacctgttcatcgacgcgatggcgccgcacaaggcgcgctttgccggcgcggtatcgagttcggaggcatcgacgcggcgcctgcagggccatggctttgcggtgctggacctcaacgaggtcgacacgattcccgtctacgtggacggcgccgacgagatcgacgacaccggtgccatgatcaagggcggcggcggggcactgacgcgcgagaagatcgtcgcctcggtggccggacagttcgtctgcattgccgatggcagcaagctggtcgatgtgctcggcgcgtttccgctgccggtggaagtggtgccgatggcacgcgctgccgtggcgcgccaactggcggcactgggcggccagccgcgcctgcgcatgaccaaggaaggccagatctaccagaccgacaacggcaatgtgatcctggatgtggtcggcctgcggatcggcgagccgaagacgctggaagcgcagatcaacgacattcccggcgtggtgacggtgggcctgttcgccaagcacggcgccaatgtgctgctgctggggaccgagacgggcgtgcagcgccgcgatttctga

SEQ ID NO: 2956 - DNA, 687 bp, Ralstonia solanacearum
atgacgcaggatgaactgaaggcgctggtggcccaggccgccgccgactacgtattggccaacgtgcccgagggcgccgtgctgggtgtcggcaccggttcgaccgccaacctgttcatcgacgcgatggcgccgcacaaggcgcgcttcgccggcgcggtgtcgagctcggaggcgtcgacgcgccgtctgcagggccacggttttgccgtgctggatctgaacgaggtcgatacgattcccgtctacgtggacggtgccgacgagatcgatgacacgggcgccatgatcaagggcggcggcggcgcgctgacgcgcgagaagatcgtcgcgtcggtggcaggacggttcgtctgcatcgccgacggcagcaagctggtcgatgtgctcggcgctttcccgctgccggtggaagtggtgccgatggcacgcgccgcagtagcgcgccagctggcggcgctgggcggccagccgcgcctgcgcatgaccaaggaaggccagatctaccagaccgacaacggcaatgtgatcctggatgtctccggcctgcggatcggcgagccgaagacgctcgaggcgcagatcaacgatattcccggcgtggtgacggtcggcctgttcgccaagcgcggcgccgatgtgctgctgctgggcaccgaagcgggcgtgcagcgccgcgacttctga

SEQ ID NO: 2957 - DNA, 837 bp, Ralstonia solanacearum
atgcgagtccgtggcgcgggccggcgggggccgccgggcgtggtggctaaatcgattgtactccgcgcgcccggcgccgccaggcgggggagagccgtcgcagtgatccggtacactaccgggttttccgattccgaccgggttttcgcgatgacgcaggacgaactgaaggcactggtggcgcaggccgccgcagactacgtattggccaacgtgcccgagggcgccgtgctgggggtcggcaccggttcgaccgccaacctgttcatcgacgcgatggcgccgcacaaggcgcgctttgcgggcgcggtatcgagttcggaggcatcgacgcgccgcctgcagggtcatggctttgcggtgctggacctcaacgaggtcgacacgattcccgtctacgtggacggcgccgacgagatcgacgacaccggcgccatgatcaagggcggcggcggggcgctgacgcgcgagaagatcgtcgcctcggtggccggacagttcgtctgcattgccgatggcagcaagctggtcgatgtgctcggcgcgtttccgctgccggtggaagtggtgccgatggcacgcgctgccgtggcgcgccaactggcggcactgggcggccagccgcgcctgcgcatgaccaaggaaggccagatctaccagaccgacaacggcaatgtgatcctggatgtggtcggcctgcggatcggcgagccgaagacgctggaagcgcagatcaacgacattcccggcgtggtgacggtgggcctgttcgccaagcacggcgccaatgtgctgctgctggggaccgagacgggcgtgcagcgccgcgatttctga

SEQ ID NO: 2958 - DNA, 813 bp, Burkholderia sp. H160
gtgtcccaaggtgtccggcaaaccagcgcgcgcgacgccaccaagcgcgcccgaaccgagccctctccacgccactccggtaaactaggggtttttcacgcttctcccgcctctcccatgactcaagacgaactcaagcaactggtcggccaggccgccgccgattacgtgaacgccaacgtgccgcaaggctcggtgatcggcgtcggcacgggctccaccgcgaactgcttcatcgacgcgctggccgccaccaaatcccgctatcgcggtgcggtgtcgagttcgctcgccaccaccgcgcgtttgcaatcgcacggcatcaaggtgctcgacctgaacgagatcgactcgctgccggtgtacgtcgatggcgccgacgaaatcgatcgcagcggcgcgatgatcaagggcggcggcggcgcgctcacgcgcgagaagatcgtcgcatcggtgtcggacgtattcgtctgcatagcggatgcgagcaaggtcgtcgagacgctcggcaacttcccgctgccgatcgaagtcgtgccgatggcgcgcaccgcgatcggccgccgcgtgacggcgctcggcggcgtgcccgtcgtgcgcgtgacgaaagagggcgtgccgttcatcaccgacaacggtaacgagatcatcgacgtgaagggcctaaagatcagcgacccgcgcacgctcgaagcgcagatcaacgcgtggcccggcgtcgtgacggtcggtctgttcgcgggacgcggcgcgaacctgtgtctgctcggcaccgacaccggcgtgcaaacgatcacgtacgaccagaattaa

SEQ ID NO: 2959 - DNA, 879 bp, Burkholderia dolosa AUO158
atgcgggcgatccggacgcgcagaccgatgcgatcgcccaggcgctgctcgacaagtatttccccgacacgccgcccgcagacgacgcgcgctgaacgcgcggcgcggacgcgacgaaaaagggcggccggactgccgagtccggtaaactgccggtttttcgcaatccagcagcatcacgactccatgactcaagacgaactcaaacgcctggtcggccaggcagcggccgactatgtgatccagcacgtgccggaaggcacggtgatcggcgtcggcaccggctcgacggcgaactgcttcatcgacgcgctcgcggccgtcaagtcgcgttatcgcggcgccgtgtcgagctccgtcgcgacgaccgaacgcctgaagtcgcacggcatcaaggtattcgatctgaacgacgtcgaatcgctgcaggtgtacgtcgacggcgccgacgagatcgacgcgagcggcgcgatgatcaagggtggcggcggcgcgctgacgcgcgagaagatcgtcgcgtcggtggccgacacgttcgtctgcatcgccgacgcgagcaagcgcgtgccggtgctcggcgcgtttccgctgccgatcgaagtcgtaccgatggcgcgcacggcgatcggccgtcgcgtgaccgcgctcggcggcgtaccggtgctgcgtgtgacgaaggacggcgcgccgtacatcaccgacaacggcaacgagatcatcgacgtgaaggggctgcagattaccgatccgcgcggtttcgaggcaaaggtcaatgcgtggccgggcgtcgttacggtgggcttgttcgcagaacgcggcgcaaatctgtgcttgctcggtactgaaaccggcgtcgaaacgatcatttattcggcctga

SEQ ID NO: 2960 - DNA, 696 bp, Burkholderia phytofirmans PsJN
atgactcaagacgaactcaagcaactggtcggccaggccgccgccgactacgtgaacgccactgtgcccgaaggcgcggtgatcggcgtcggcaccggctccaccgcgaactgtttcatcgacgcgctggctggcaacaaggcgcgctatcgcggcgcggtgtcgagttcgctcgccaccaccgcgcgcctgcaaacgcacggcatcaaggtgttcgacctcaacgaaatcgattcgctgcccgtgtacgtggacggcgccgacgagatcgaccgcagcggcgcgatgatcaagggcggcggcggcgcgctgacgcgcgaaaagatcgtcgcgtcggtgtcggacgtgttcgtgtgcatcgccgacgccagcaagctggtcgagacgctcggcactttcccgctgccgatcgaagtggtgccgatggcgcgtaccgcgatcggccgccgcgtgacggcgctcggcggcgtgccggtggtgcgcgtcacgaaagaaggcgtgccgttcattaccgacaatggcaacgagatcatcgacgtcaagggtctgcgtatcagcgacccgcgcacgctggaaacgcacatcaacgcatggccgggcgtggtaacggtgggtctgttcgccgcccgtggcgcgaacctgtgcctgctcggcacggacaccggcgtcgagacgatcgagtacagcaagggctga

SEQ ID NO: 2961 - DNA, 696 bp, Burkholderia xenovorans LB400
atgactcaagacgaactcaaacaactggtcggccaggccgccgccgactacgtcaacgccaacgtgcccgaaggctcggtgatcggcgtcggtaccggctccaccgctaactgcttcatcgacgcgctggccgccggcaagacgcgctatcgcggcgcggtgtcgagctcgctcgccaccaccgcgcggctgcagtcgcacggtttcaaggtgctcgatctcaacgaaatcgattcgctgccggtgtacgtggacggcgccgacgagatcgatcacagcggtgcgatgatcaagggcggcggcggcgcgctcacgcgcgagaagatcgtggcgtcggtgtcggacgtgttcgtatgtatcgcggacgccagcaagctggtggaaacgctcggcagtttcccgctgccgatcgaagtggtgccgatggcgcgcacctcgatcggccgccgcgtcacggcactcggcggcgtgccggtggtgcgcgtcactaaagaaggcgtgccgttcattaccgacaacggcaatgagatcatcgacgtcaagggtttgcgcatcagcgacccgcgcacgctggaaacgcatgtcaacgcgtggccgggcgtggtgacggtgggattgttcgcgagccgtggcgctgatctgtgtctgctcggcacggacaccggcgtcgacacgatcaggttcagcaagggttga

SEQ ID NO: 2962 - DNA, 696 bp, Burkholderia sp. CCGE1002
atgactcaagacgaactcaagcaactggtcggccaggccgccgccgattatgtgaacgccaacgtgccgcaaggctcggtgatcggcgtcggcacgggctccaccgcgaactgtttcatcgacgcgctggccgccaccaaatcccgctatcgcggcgcggtgtcgagttcgctcgccaccaccgcgcgtctgcaatcgcacggcttcaaggtgttcgacctgaacgagatcgactcgctgccggtgtacgtcgacggcgccgacgaaatcgatcgcagcggcgcgatgatcaagggcggcggcggcgcgctcacgcgcgagaagatcgtcgcatcggtgtcggaagtattcgtctgcatcgcggatgcgagcaaggtcgtcgagacgctcggcaagttcccgctgccgatcgaagtggtgccgatggcgcgcaccgcgatcggccgccgcgtgacggcgctcggcggcgtgcccgtcgtgcgcgtgacgaaagagggcgcgccgttcatcaccgacaacggcaatgagatcatcgacgtgaagggcttgagcatcagcgacccgcgtacgctcgaggcgcatatcaatgcatggcccggcgtcgtcacggtcggcctgttcgcgggccgcggcgcaaatctgtgcctgctcggcaccgacaccggcgtgcaaacgatcacgtacggccagaactaa

SEQ ID NO: 2963 - DNA, 696 bp, Burkholderia sp. CCGE1001
atgacccaagacgaactcaagcaactggtcggccaggccgccgccgactatgtcctcgccaacgtgcccgaaggctcggtgatcggcgtcggtaccggctccaccgcgaactgcttcatcgacgcgctggccgccaacaaggcgcgctatcgcggtgccgtgtcgagttcgctcgccaccaccgcgcggctccagtcgcacggcatcaaggtgctcgatctgaacgagatcgattcgttgcccgtctatgtggacggcgcggacgagatcgaccacagcggcgcgatgatcaagggcggcggcggcgcgctcacgcgcgagaaaatcgtcgcgtcggtgtcggacgtgttcgtctgtatcgcggatgcaagcaagctcgtcgagacgctcggcaacttcccgctgcctgtcgaagtcgtgccgatggcgcgcaccgcgatcggccgccgcgtgacggcgctcggcggcgtcccggtcgtgcgtgtcacgaaagaaggcacgccgttcatcaccgataacggcaacgagatcatcgacgtcaaaggtctgcgtattaccgacccctgcgcgctcgaaacgcagatcaacgcatggccgggcgtcgtgacagtcggcctcttcgcgggccggggcgccagtctttgtctgcttggcacggacaccggcgtgcaaaccatcgagtaccgcaaggactga

SEQ ID NO: 2964 - DNA, 696 bp, Burkholderia phymatum STM815
atgactcaagacgaactcaagcaactggtcggccaggcggccgccgactacgtgatcgccaacgtgcccgaaggcacgatcatcggcgttggcaccggctcgaccgcgaactgtttcatcgacgcgctcgccgcgcacaaagcgcgctttcgcggcgccgtgtccagctcggtcgcgacgacggcgcgcctgcaatcgcacggtattccggtgttcgacctgaacgacatcgaatcgctgcccgtctacgtcgacggcgccgacgaaatcgatcatggtggcgcgatgatcaagggcggtggcggcgcgctcacgcgcgagaaaatcgtcgcgtcggtggcggagaaattcctctgcatcgccgacgcgagcaaggtcgtcgacgtgctcggccagtttccgctacccgtcgaagtcgtgccgatggcgcgcacggcaatcggccgccgtgtgacggccttgggcggcgtgccaatcgtgcgtgtgacgaaggacggcgcgccgttcttgactgacaacggcaatgagatcatcgacgtcaaaggcctgcgcatcaccgatccgcgcacgctcgaagcgcacgtcaacgcgtggccgggtgtggtgacggtgggcctgttcgcggcgcgcggcgcggatctctgcctgctcggcacgcagaagggtgtcgagacgatcgtctacccgaatcgctga

SEQ ID NO: 2965 - DNA, 696 bp, Burkholderia thailandensis Bt4
atgacccaagacgaactcaaacgcctcgtcggcgaggccgccgcccgatacgtgaccgacaacgtgccgcaaggcgcggtgatcggcgtcggcacgggctcgaccgccaactgcttcatcgacgcgctcgcggccgtcaaggatcgctatcgcggcgcggtgtcgagttcggtggcgacgaccgagcgcctgaagtcgcacggcatccgggtgttcgatctgaacgagatcgaatcgctgcaggtgtatgtcgacggcgctgacgagatcgacgaaagcggcgcgatgatcaagggcggcggcggcgcgcttacgcgcgagaagatcgtcgcttcggtcgcggaaacgttcgtctgcatcgccgatgcgagcaagcgcgtcgcgatgctcggccagtttccgctgcccgtcgaggtcgtgccgatggcgcgcaccgcgatcggccgccggcttgccgcgctgggcggcgtgcccgtgctgcgcgtgaagcaggacggcacgccgtacgtgaccgacaacggcaacgagattctcgacgtgaagggcttgcggatcgacgatccgcgcgcgctcgaagcggcgatcaacggctggcccggcgtcgtgacggtcggcctgttcgcgcaacgcggcgcggatctctgcctgctcggcaccgagcacggcgtcgagacgctccgttacgcggcacgttaa

SEQ ID NO: 2966 - DNA, 696 bp, Burkholderia thailandensis TXDOH
atgacccaagacgaactcaaacgcctcgtcggcgaggccgccgcccgatacgtgaccgacaacgtgccgcaaggcgcggtgatcggcgtcggcacgggctcgaccgccaactgcttcatcgacgcgctcgcggccgtcaaggatcgctatcgcggcgcggtgtcgagttcggtggcgacgaccgagcgcctgaagtcgcacggcatccgggtgttcgatctgaacgagatcgaatcgctgcaggtgtatgtcgacggcgccgacgagatcgacgaaagcggcgcgatgatcaagggcggcggcggcgcgcttacgcgcgagaagatcgtcgcttcggtcgcggaaacgttcgtctgcatcgccgatgcgagcaagcgcgtcgcgatgctcggccagtttccgctgcccgtcgaggtcgtgccgatggcgcgcaccgcgatcggccggcggcttgccgcgctgggcggcgtgcccgtgctgcgcgtgaagcaggacggcacgccgtacgtgaccgacaacggcaacgagattctcgacgtgaagggcttgcggatcgacgatccgcgcgcgctcgaagcgacgatcaacggctggcccggcgtcgtgacggtcggcctgttcgcgcaacgcggcgcggatctctgcctgctcggcaccgagcacggcgtcgagacgctccgttacgcggcacgttaa

SEQ ID NO: 2967 - DNA, 696 bp, Burkholderia thailandensis MSMB43
atgacacaagacgaactcaaacgcctcgtcggcgaggccgctgcccgatacgtgaccgacaacgtgccgcaaggcgcggtgatcggcgtcggcacgggctcgaccgccaactgcttcatcgacgcgctcgcggccgtcaaggaccgctatcgcggcgcggtgtcgagttcggtggcgacgaccgagcgtctgaagtcgcacggcatcaaggtgttcgatctgaacgagatcgaatcgctgcaggtgtatgtcgacggcgccgacgagatcgacgaaagcggcgcgatgatcaagggcggcggcggcgcgctcacgcgcgagaagatcgtcgcttcggtcgccgaaacgttcgtctgcatcgccgacgcgagcaagcgcgtcgcggtgctcggccagttcccgctgcccgtcgaggtcgtgccgatggcgcgcaccgcgatcggccgccggctcgccgcgctgggcggcgtgcccgtgctgcgcgtgaagcaggacggcgcgccgtacgtcaccgacaacggcaacgagatcctcgacgtgaagggcctgcggatcgacgatccgcgcgcgctggaagcgacggtcaacggctggcccggcgtcgtgacggtcggcctgttcgcgcaacgcggcgcggatctctgcctgctcggcaccgagcatggcgtagagacgctccgttatgcgacgcgttaa

SEQ ID NO: 2968 - DNA, 708 bp, Burkholderia thailandensis E264
ttgacgcttctcatgacccaagacgaactcaaacgcctcgtcggcgaggccgccgcccgatacgtgaccgacaacgtgccgcaaggcgcggtgatcggcgtcggcacgggctcgaccgccaactgcttcatcgacgcgctcgcggccgtcaaggatcgctatcgcggcgcggtgtcgagttcggtggcgacgaccgagcgcctgaagtcgcacggcatccgggtgttcgatctgaacgagatcgaatcgctgcaggtgtatgtcgacggcgccgacgagatcgacgaaagcggcgcgatgatcaagggcggcggcggcgcgcttacgcgcgagaagatcgtcgcttcggtcgcggaaacgttcgtctgcatcgccgatgcgagcaagcgcgtcgcgatgctcggccagtttccgctgcccgtcgaggtcgtgccgatggcgcgcaccgcgatcggccgccggcttgccgcgctgggcggcgtgcccgtgctgcgcgtgaagcaggacggcacgccgtacgtgaccgacaacggcaacgagattctcgacgtgaagggcttgcggatcgacgatccgcgcgcgctcgaagcggcgatcaacggctggcccggcgtcgtgacggtcggcctgttcgcgcaacgcggcgcggatctctgcctgctcggcaccgagcacggcgtcgagacgctccgttacgcggcacgttaa

SEQ ID NO: 2969 - DNA, 708 bp, Burkholderia mallei
ttgacgcttcccatgacacaagacgaactcaaacgcctcgtcggcgaggccgctgcccgatacgtgaccgaaaacgtgccgcagggcgcggtgatcggcgtcggcacgggctcgaccgccaactgcttcatcgatgcgctcgcggccgtcaaggatcgctatcgcggcgcggtgtcgagttcggtggcgacgaccgagcgcctgaagtcacacggcatcaaggtgttcgatctgaacgagatcgaatcgctgcaggtgtatgtcgacggcgccgacgagatcgacgggagcggcgcgatgatcaagggcggcggcggcgcgctcacgcgcgagaagatcgttgcttcggttgccgaaacgttcgtgtgcatcgccgatgcgagcaagcgcgtggcggtgctcggccagttcccgctgcccgtcgaggtggtgccgatggcgcgcaccgcgatcggccgccggctcgccgcgctgggcggcgtgcccgtgctgcgcgtgaagcaggacggcgcgccgtacgtgaccgacaacggcaacgagattctcgacgtgaagggcctgcggatcgacgatccgcgcgcgctcgaagcggcgatcaacggctggcccggcgtcgtgacggtcgggctgttcgcgcaacgcggcgcggatctctgcctgctcggcaccgagcgcggcgtcgagacgctccgttacgctgcgcattaa

SEQ ID NO: 2970 - DNA, 696 bp, Burkholderia pseudomallei
atgacacaagacgaactcaaacgcctcgtcggcgaggccgctgcccgatacgtgaccgaaaacgtgccgcagggcgcggtgatcggcgtcggcacgggctcgaccgccaactgcttcatcgatgcgctcgcggccgtcaaggatcgctatcgcggcgcggtgtcgagttcggtggcgacgaccgagcgcctgaagtcacacggcatcaaggtgttcgatctgaacgagatcgaatcgctgcaggtgtatgtcgacggcgccgacgagatcgacgggagcggcgcgatgatcaagggcggcggcggcgcgctcacgcgcgagaagatcgttgcttcggtcgccgaaacgttcgtgtgcatcgccgatgcgagcaagcgcgtggcggtgctcggccagttcccgctgcccgtcgaggtggtgccgatggcgcgcaccgcgatcggccgccggctcgccgcgctgggcggcgtgcccgtgctgcgcgtgaagcaggacggcgcgccgtacgtgaccgacaacggcaacgagattctcgacgtgaagggcctgcggatcgacgatccgcgcgcgctcgaagcggcgatcaacggctggcccggcgtcgtgacggtcgggctgttcgcgcaacgcggcgcggatctctgcctgctcggcaccgagcgcggcgtcgagacgctccgttacgctgcgcattaa

SEQ ID NO: 2971 - DNA, 696 bp, Burkholderia pseudomallei
atgacacaagacgaactcaaacgcctcgtcggcgaggccgctgcccgatacgtgaccgaaaacgtgccgcagggcgcggtgatcggcgtcggcacgggctcgaccgccaactgcttcatcgatgcgctcgcggccgtcaaggatcgctatcgcggcgcggtgtcgagttcggtggcgacgaccgagcgcctgaagtcacacggcatcaaggtgttcgatctgaacgagatcgaatcgctgcaggtgtatgtcgacggcgccgacgagatcgacgggggcggcgcgatgatcaagggcggcggcggcgcgctcacgcgcgagaagatcgttgcttcggtcgccgaaacgttcgtgtgcatcgccgatgcgagcaagcgcgtggcggtgctcggccagttcccgctgcccgtcgaggtggtgccgatggcgcgcaccgcgatcggccgccggctcgccgcgctgggcggcgtgcccgtgctgcgcgtgaagcaggacggcgcgccgtacgtgaccgacaacggcaacgagattctcgacgtgaagggcctgcggatcgacgatccgcgcgcgctcgaagcggcgatcaacggctggcccggcgtcgtgacggtcgggctgttcgcgcaacgcggcgcggatctctgcctgctcggcaccgagcgcggcgtcgagacgctccgttacgctgcgcattaa

SEQ ID NO: 2972 - DNA, 696 bp, Burkholderia pseudomallei
atgacacaagacgaactcaaacgcctcgtcggcgaggccgctgcccgatacgtgaccgaaaacgtgccgcagggcgcggtgatcggcgtcggcacgggctcgaccgccaactgcttcatcgatgcgctcgcggccgtcaaggatcgctatcgcggcgcggtgtcgagttcggtggcgacgaccgagcgcctgaagtcacacggcatcaaggtgttcgatctgaacgagatcgaatcgctgcaggtgtatgtcgacggcgccgacgagatcgacgggagcggcgcgatgatcaagggcggcggcggcgcgctcacgcgcgagaagatcgttgcttcggtcgccgaaacgttcgtgtgcatcgccgatgcgagcaagcgcgtggcggtgctcggccagttcccgctgcccgtcgaggtggtgccgatggcgcgcaccgcgatcggccgccggctcgccgcgctgggcggcgtgcccgtgctgcgcgtgaagcaggacggcgcgccgtacgtgaccgacaacggcaacgagattctcgacgtgaagggcctgcggatcgacgatccgcgcgcgctcgaagcggcgatcaacggctggcccggcgtcgtgacggtcgggctgttcgcgcaacgcggcgcggatctctgcctgctcggcaccgagcgcggcgtcgagacgctccgttacgctgagcattaa

SEQ ID NO: 2973 - DNA, 708 bp, Burkholderia oklahomensis C6786
ttgacgcttctcatgacacaagacgaactcaaacgcctcgtcggcgaggccgctgcccaatacgtgatcgacaacgtgccggaacgcgcggtgatcggcgtcggcacaggctcgaccgccaactgcttcatcgatgcgctcgcggccgtcaaggaccgctatcgcggcgcggtgtcgagctcggtggcgacgaccgagcgcctgaagtcgcatggcatcaaggtcttcgacctgaacgagatcgagtcgctgcaggtgtacgttgacggcgccgacgagatcgacggcggcggcgcaatgatcaagggcggcggcggcgcgctgacgcgcgagaagatcgtcgcttcggtcgccgaaacgtttgtctgcatcgccgacgcgagcaagcgcgtcgcggtgctcggccagttcccgctgcccgtcgaggtcgtgccgatggcgcgcaccgcgatcggccgccggctcgccgcgctcggcggcgtgcccgtgctgcgcgtgaagcaggacggcacgccgtacgtcaccgacaacggcaacgagatcctcgacgtgaagggcctgcgcatccaagatcctcgcgcgctcgaagcgacgatcaacggctggcccggcatcgtgacggtcggcctgttcgccgagcgcggcgcggacctgtgcctgctcggcaccgaacacggcgtcgagacgctccgctacgtcaagcgttaa

SEQ ID NO: 2974 - DNA, 696 bp, Burkholderia oklahomensis EO147
atgacacaagacgaactcaaacgcctcgtcggcgaggccgctgcccaatacgtgatcgacaacgtgccggaacgcgcggtgatcggcgtcggcacaggctcgaccgccaactgcttcatcgatgcgctcgcggccgtcaaggaccgctatcgcggcgcggtgtcgagctcggtggcgacgaccgagcgcctgaagtcgcatggcatcaaggtcttcgacctgaacgagatcgagtcgctgcaggtgtacgttgacggcgccgacgagatcgacggcggtggcgcaatgatcaagggtggcggcggcgcgctgacgcgcgagaagatcgtcgcttcggtcgccgaaacgtttgtctgcatcgccgacgcgagcaagcgcgtcgcggtgctcggccagttcccgctgcccgtcgaggtcgtgccgatggcgcgcaccgcgatcggccgccggctcgccgcgctcggcggcgtgcccgtgctgcgcgtgaagcaggacggcacgccgtacgtcaccgacaacggcaacgagatcctcgacgtgaagggcctgcgcatccaagatcctcgcgcgctcgaagcgacgatcaacggctggcccggcatcgtgacggtcggcctgttcgccgagcgcggcgcggacctgtgcctgctcggcaccgaacacggcgtcgagacgctccgctacgtcaagcgttaa

SEQ ID NO: 2975 - DNA, 693 bp, Burkholderia ambifaria AMMD
atgactcaagacgaactcaaacgcctggtcggccaggcggccgccgattatgtgatccagaacgtgccggaaggcgccgtgatcggcgtcggcaccggctcgaccgccaactgcttcatcgacgcgctcgcggccgtcaaagcgcgctatcgcggcgccgtgtcgagctcgctcgcgacgaccgagcgcctgaaatcgcacggcatcaaggtgttcgacctgaacgagatcgagtcgctgcaggtgtacgtcgacggcgccgacgagatcgacgcaagcggtgcaatgatcaagggcggcggcggtgcattgacgcgcgaaaagatcgttgcgtcggtggccgatacgttcgtctgcatcgcggacgccagcaagcgcgtgccggtgctcggcgcatttccgctgccgatcgaggtcgtgccgatggcgcgcacggcgatcggccggcgcgtgactgcgctcggcggcgtgccggtgctgcgcgtgacgaaggacggcgcgccgtacatcaccgacaacggcaacgagatcatcgacgtgaaggggctgcagatcgccgatccgcgcggtttcgaagcgcaggtcaacgcgtggccgggcgtcgtgacggtcggcctgttcgccgagcgcggcgcgaatctgtgcctgctcggcacgccgaacggcgtcgagacgatcgtttatcccgcttaa

SEQ ID NO: 2976 - DNA, 696 bp, Burkholderia cenocepacia AU 1054
atgactcaagacgaactcaaacgcctcgtcggccaggccgccgccgattacgtgatccagaacgtgccggaaggcgccgtgatcggtgtcggcaccggctcgaccgccaactgcttcatcgacgcgctcgccgccgtcaaatcgcgctaccgcggcgccgtgtcgagctcgattgccacgaccgaacgcctgaaatcgcacggcatcaaggtgttcgacctgaacgagatcgagtcgctgcaggtgtacgtcgacggcgccgacgagatcgacgcgggcggcgcgatgatcaagggcggcggcggcgcgctgacgcgcgagaagatcgtcgcatcggtggccgacacgttcgtctgcatcgcggacgccagcaagcgcgtgccggtgctcggcgcgttcccgctgccgatcgaggtcgtgccgatggcgcgcacggcgatcggccggcgcgtgaccgcgctcggcggcgtgcccgtgctgcgcgtgacgaaggacggcgcgccctacatcaccgacaacggcaacgagatcatcgacgtgaagggcctgcagatcgccgatccgcgcggtttcgaagcgcaggtgaacgcatggccgggcgtcgtgacggtcggtctgttcgccgaacgcggcgcgaatctgtgcttgcttggcacggaaaacggcgttgaaacgatcgtttatccggctggctaa

SEQ ID NO: 2977 - DNA, 696 bp, Burkholderia cenocepacia J2315
atgactcaagacgaactcaaacgcctcgtcggccaggccgccgccgattacgtgatccagaacgtgccggaaggcgccgtgatcggcgtcggcaccggctcgaccgccaactgcttcatcgacgcactcgccgccgtcaagtcgcgctatcgcggcgccgtgtcgagctcggtcgccacgaccgaacgcctgaaatcgcacggcatcaaggtgttcgacctgaacgagatcgacgcgctgcaggtgtacgtcgacggcgccgacgagatcgacgccggcggcgcgatgatcaagggcggcggcggcgcgctcacgcgcgagaagatcgtcgcgtcggtggccgatacgttcgtctgcatcgcggacggcagcaagcgcgtgccggtgctcggcgcgttcccgctgccgatcgaggtcgtgccgatggcgcgtacggcgatcggccggcgcgtgaccgcgctcggcggcgtgcccgtgctgcgcgtgacgaaggacggcgcaccgtacattaccgacaacggcaacgagatcatcgacgtgaagggcctgcagattgccgatccgcgcggtttcgaagcgcgggtgaacgcatggccgggcgtcgtgacggtcggcctgttcgccgagcgcggcgcgaatctgtgcttgctcggcacggaaaacggcgttgaaacgatcgtttatccggctgcttga

SEQ ID NO: 2978 - DNA, 693 bp, Burkholderia ambifaria IOP40-10
atgactcaagacgaactcaaacgcctggtcggccaggcggccgccgattacgtgatccagaacgtgccggaaggcgccgtgatcggcgtcggcactggctcgaccgccaactgcttcatcgacgcgctcgcggccgtcaaatcgcgctatcgcggcgccgtgtcgagttcgctcgcgacgaccgagcgcctgaaatcgcacggcatcaaggtgttcgacctgaacgaggtcgagtcgctgcaggtgtacgtcgacggggccgacgagatcgacgcaagcggtgcaatgatcaagggcggcggcggtgcattgacgcgcgagaagatcgttgcgtcggtggccgatacgttcgtctgcatcgcggacgccagcaagcgcgtgccggtgctcggcgcattcccgctgccgatcgaggtcgtgccgatggcgcgcacggcgatcggccggcgcgtgaccgcgctcggcggcgtgccggtgctgcgcgtgacgcaggacggcgcaccgtacatcaccgacaacggcaacgagatcatcgacgtgaaggggctgcagatcgccgatccgcgcggtttcgaagcgcaggtcaacgcgtggccgggcgtcgtgacggccggcctgttcgccgagcgcggcgcgaatctgtgcctgctcggcacggcgaacggcgtcgagacgatcgtttatcccggttga

SEQ ID NO: 2979 - DNA, 693 bp, Burkholderia ambifaria MEX-5
atgactcaagacgaactcaaacgcctggtcggccaggcggccgccgattatgtgatccagaacgtgccggaaggcgccgtgatcggcgtcggcaccggctcgaccgccaactgcttcatcgacgcgctcgcggccgtcaaatcgcgctatcgcggcgccgtgtcgagctcggtcgcgacgaccgagcgcctgaaatcgcacggcatcaaggtgttcgacctgaacgaggtcgagtcgctgcaggtttacgtcgacggggccgacgagatcgacgcaagcggtgcaatgatcaagggcggcggcggtgcgttgacgcgcgagaagatcgttgcgtcggtggccgacacgttcgtctgcattgcggacggcagcaagcgggtgccggtgctcggcgcattcccgctgccgatcgaggtcgtgccgatggcgcgcacggcgatcggccggcgcgtgaccgcgctcggcggcgtgccggtgctgcgcgtgacgaacgacggtgcgccgtacatcaccgacaacggcaacgagatcatcgacgtgaaggggatgcagatcgccgatccgcgcggtttcgaagcgcagatcaacgcgtggccgggcgtcgtgacggtcggtctgttcgccgagcgcggcgcgaatctgtgcctgctgggcacgccgaacggcgtcgagacgatcgtttaccccggctga

SEQ ID NO: 2980 - DNA, 693 bp, Burkholderia ambifaria MC40-6
atgactcaagacgaactcaaacgcctggtcggccaggcggccgccgattatgtgatccagaacgtgccggaaggcgccgtgatcggtgtcggcaccggctcgaccgccaactgcttcatcgacgcgctcgcggccgtcaaatcgcgctatcgcggcgccgtgtcgagctcggtcgcgacgaccgaacgcctgaaatcgcacggcatcaaggtgttcgacctgaacgagatcgagtcgctgcaggtgtacgtcgacggcgccgacgaaatcgacgcaagcggtgcaatgatcaagggtggcggcggtgcgctgacgcgcgaaaagatcgtcgcgtcggtggccgatacgttcgtctgcatcgcggacggcagcaagcgcgtgccggtgctcggcgcattcccgctgccgatcgaggtcgtgccgatggcgcgcacggcgatcggccggcgcgtgaccgcgctcggcggcgtgccggtgttgcgcgtgacgcaggacggcgcgccgtacatcaccgacaacggcaacgagatcatcgacgtgaaggggctgcagatcgtcgatccgcgcggtttcgaagcgcaaatcaatgcgtggccgggcgtcgtgacggtcggcctgttcgccgagcgcggcgcgaatctgtgcctgctcggcacgccgaacggcgtcgagacgatcgtttatcccggttaa

SEQ ID NO: 2981 - DNA, 696 bp, Burkholderia sp. 383
atgactcaagacgaactcaaacgcctcgtcggccaggccgccgctgattacgtgatccagaacgtgccggaaggcgccgtgatcggcgtcggcaccggctcgactgccaactgcttcatcgacgcgctcgccgtcgtcaaggcccgctatcgcggcgccgtatcgagctccgtcgccacgaccgaacgcctgaagtcgcacggcatcaaggtgttcgacctgaacgaggtcgactcgctgcaggtgtatgtcgacggcgccgacgagatcgacgcgagcggcgcgatgatcaagggcggtggcggcgcgctgacgcgcgagaagatcgtcgcgtcggtggccgatacgttcgtctgcatcgcggacgccagcaagcgcgtgccggtgctcggcgcgttcccgctgccgatcgaagtcgtgccgatggcgcgcacggcgatcggccggcgcgtgaccgccctcggcggcgtgccggtgctgcgcgtgacgaaggacggtgcgccctacatcaccgacaacggcaacgagatcatcgacgtgaaggggctgcagatcgccgatccgcgtggtttcgaagcgcaggtgaacgcatggccgggcgtcgtgacggtcggcctgttcgccgagcgcggcgcgaatctgtgcttgctcggcacggaaaacggcgttgaaacgatcgtttattcggctaattga

SEQ ID NO: 2982 - DNA, 696 bp, Burkholderia multivorans ATCC 17616
atgactcaagacgaactcaaacgcctggtcggccaggccgccgccgattacgtgatccagaacgtgccggagggcgcggtgatcggcgtcggcaccggctcgacggcgaactgcttcatcgacgcgctcgcggccgtcaaatcgcgctatcgcggcgccgtatcgagctccgtcgcgacgaccgagcgcctgaagtcgcacggcatcaaggtgttcgacctgaacgaagtggagtcgctgcaggtgtacgtcgacggcgccgacgagatcgacgcgagcggcgcgatgatcaagggcggcggcggcgcgctgacgcgcgagaagatcgttgcgtcggtcgccgacaccttcgtctgcatcgccgacgcgagcaagcgcgtgccggtgctcggcgcgttcccgctgccgatcgaagtcgtgccgatggcgcgcaccgcgatcggccggcgcgtgacggcgctcggcggcgtgccggtgctgcgcgtgacgaaggacggcgcgccgtacatcaccgacaacggcaacgagatcatcgacgtgaaggggctgcagatcgccgatccgcgcggcttcgaggcgcaggtcaatgcatggccgggcgtcgtgacggtcgggctgttcgccgcgcgcggcgcgaacctgtgcctgctcggcacggaacacggcgtggagacgatcgtgtatccggcgcgttga

SEQ ID NO: 2983 - DNA, 696 bp, Burkholderia multivorans CGD2M
atgactcaagacgaactcaaacgcctggtcggccaggccgccgccgattacgtgatccagaacgtgccggagggcgcggtgatcggcgtcggcaccggctcgacggcgaactgcttcatcgacgcgctcgcggccgtcaaatcgcgctatcgcggcgccgtatcgagctccgtcgcgacgaccgagcgcctgaagtcgcacggcatcgccgtgttcgacctgaacgaagtggagtcgctgcaggtgtacgtcgacggcgccgacgagatcgacgcgagcggcgcgatgatcaagggcggcggcggtgcgctgacgcgcgagaagatcgtcgcgtcggtcgccgacaccttcgtctgcatcgccgacgcgagcaagcgtgtgccggtactcggcgcgttcccgctgccgatcgaagtcgtgccgatggcgcgcaccgcgatcggccggcgcgtgacggcgctcggcggcgtgccggtgctgcgcgtgacgaaggacggcgcgccgtacatcaccgataacggcaacgagatcctcgacgtgaaggggctgcagatcgccgatccgcgcggtttcgaggcgcaggtcaatgcgtggccgggcgtcgtgacggtcgggctgttcgccgcgcgcggcgcgaatctgtgcctgctcggcacggaacacggcgtcgagacgatcgtttatccggcgcattga

SEQ ID NO: 2984 - DNA, 708 bp, Burkholderia multivorans ATCC 17616
atgacccatcccatgactcaagacgaactcaaacgcctggtcggccaggccgccgccgattacgtgatccagaacgtgccggagggcgcggtgatcggcgtcggcaccggctcgacggcgaactgcttcatcgacgcgctcgcggccgtcaaatcgcgctatcgcggcgccgtatcgagctccgtcgcgacgaccgagcgcctgaagtcgcacggcatcaaggtgttcgacctgaacgaagtggagtcgctgcaggtgtacgtcgacggcgccgacgagatcgacgcgagcggcgcgatgatcaagggcggcggcggcgcgctgacgcgcgagaagatcgttgcgtcggtcgccgacaccttcgtctgcatcgccgacgcgagcaagcgcgtgccggtgctcggcgcgttcccgctgccgatcgaagtcgtgccgatggcgcgcaccgcgatcggccggcgcgtgacggcgctcggcggcgtgccggtgctgcgcgtgacgaaggacggcgcgccgtacatcaccgacaacggcaacgagatcatcgacgtgaaggggctgcagatcgccgatccgcgcggcttcgaggcgcaggtcaatgcatggccgggcgtcgtgacggtcgggctgttcgccgcgcgcggcgcgaacctgtgcctgctcggcacggaacacggcgtggagacgatcgtgtatccggcgcgttga

SEQ ID NO: 2985 - DNA, 753 bp, Burkholderia multivorans CGD1
ttgcgcgagtccggtaaactggcggtttttccgcaatcctgcagcatcatccatcccatgactcaagacgaactcaaacgcctggtcggccaggccgccgccgattacgtgatccagaacgtgccggagggcgcggtgatcggcgtcggcaccggctcgacggcgaactgcttcatcgacgcgctcgcggccgtcaaatcgcgctatcgcggcgccgtatcgagctccgtcgcgacgaccgagcgcctgaagtcgcacggcatcgccgtgttcgacctgaacgaagtggagtcgctgcaggtgtacgtcgacggcgccgacgagatcgacgcgagcggcgcgatgatcaagggcggcggcggtgcgctgacgcgcgagaagatcgtcgcgtcggtcgccgacaccttcgtctgcatcgccgacgcgagcaagcgtgtgccggtactcggcgcgttcccgctgccgatcgaagtcgtgccgatggcgcgcacagcgatcggccggcgcgtgacggcgctcggcggcgtgccggtgctgcgcgtgacgaaggacggcgcgccgtacatcaccgataacggcaacgagatcctcgacgtgaaggggctgcagatcgccgatccgcgcggtttcgaggcgcaggtcaatgcgtggccgggcgtcgtgacggtcgggctgttcgccgcgcgcggcgcgaatctgtgcctgctcggcacggaacacggcgtcgagacgatcgtttatccggcgcattga

SEQ ID NO: 2986 - DNA, 705 bp, Burkholderia ubonensis Bu
atgactcaagacgaactcaaacgcctcgtcggccaggccgcggccgattacgtgatccagaacgtgccggaaggcgcggtgatcggcgttggcaccggctcgaccgccaactgcttcatcgatgcgctggccgccgtcaagtcgcgctatcgcggcgcggtgtccagctcggtcgcgacgaccgagcgcctgaaggcgcacggcatcacggtgttcgacctgaacgacgtcgaatcgctgcaggtgtacgtcgacggcgcggacgaaatcgacgcgagcggcgcgatgatcaagggcggcggcggcgcgctgacgcgcgagaagatcgtcgcgtcggtggctgacacgttcgtgtgcatcgccgacgcgagcaagcgcgtgccggtgctcggcgcattcccgctgccgatcgaagtggtgccgatggcgcgcaccgcgatcggccggcgcgtgacggcggccggcggcgtgccggtgctgcgcgtgacgaaggacggcgcgccgtacatcaccgacaacggcaacgagatcatcgacgtgaagggcctgcagatcgccgatccgcgcggcttcgaagcggaggtcaacgcatggccgggcgtcgtgacggtcggcctgttcgcggcgcgcggcgcgaacctgtgcctgctcggcacggagagcggcgtcgagactatcgtttatcccgacgtttgtaagaaatga

SEQ ID NO: 2987 - DNA, 693 bp, Burkholderia vietnamiensis G4
atgactcaagacgaactcaaacgcctggtcggccaggcggccgccgattatgtgatccagaacgtgcccgaaggcgcggtgatcggcgtcggcaccggctcgaccgccaactgcttcatcgatgcgctcgcggccgtcaagtcgcgctatcgcggcgccgtatcgagctccgtcgcgacgaccgagcggctcaaatcgcacggcatcaaggtgttcgatctgaacgagatcgacgcgctgcaggtgtacgtcgacggcgccgacgagatcgacgcgagcggcgcgatgatcaagggcggcggcggtgcgctgacgcgcgagaagatcgtcgcgtcggtggccgatacgttcgtctgcatcgccgacggcagcaagcgcgtgccggtgctcggcgccttcccgctgccgatcgaagtcgtgccgatggcgcgcacggcgatcggccggcgcgtcgccgcgctcggcggggtgccggtgctgcgcgtgacgaaggacggcgcgccgtacatcaccgacaacggcaacgagatcatcgacgtcaaagggctgcagatcgcggagccgcgcgcattcgaggcgaaggtcaacgcgtggccgggcgtcgtgacggtcggcctgtttgccgagcgcggcgcgaatctgtgcctgctcggcacggaaaacggcgttgaaacgattatttaccccgcttaa

SEQ ID NO: 2988 - DNA, 696 bp, Burkholderia glumae
atgactcaagacgaactcaagcgcctcgtcggccaggcggccgccgattatgtgctggcgaacgtgccggaaggctcggtgatcggcgtcggcaccggatccaccgcgaactgcttcatcgacgcgctggccgcgatcaagacgcgctatcgcggcgcggtgtcgagctcgatcgccaccacgcagcgtctggcatcgcacggcatccgcgtgttcgatctcaaccagatcgacggcctgcaggtctacgtggacggcgccgacgagatcgatgcgagcggcgcgatgatcaagggcggcggcggggcgctcacgcgcgagaagatcgtggcctcggtatcggccaccttcgtctgcattgccgacgcgagcaagcgcgtcgcgacactcggcgcgtttccgctgccggtggaagtggtgccgatggcgcgcaccgcgatcggccgccggctgaccgcgctgggcggcgtgccggtgctgcgcgtcacgggcgacggcacgccttacctgaccgataacggcaacgagatcctcgacgtgaaggggcttgccatcaccgatccgcgcgggttggaggccacggtcaacggctggcccggcgtcgtcacggtcggcctgttcgcccagcgcggcgccgatctgtgcctgctcggcggccccgccggcgtggagacgatcgattatcgcggcgtttaa

SEQ ID NO: 2989 - DNA, 711 bp, Polynucleobacter necessarius
atgaatcaagatcaactcaagcaaatggtaggtgaggcggccagagatgaggttcttaagttgcctgctggacaagttttgggcgtaggcactggctctacagccaattactttattgatgcacttgccctgcataagggtcattttgccggcacggtatctagctcgaatgcgactactgagcgcttgctcaagcatggctttaaagttcttgaccctaatgatgtgcaaggcttgcctgcatatgttgacggtgcagatgaaattgatccagccgggcacatgataaagggcggtggtggggtcctcactggagaaaaaatcattgcttctatggcaaagcaattcatttgtatttgtgactcctctaaacaagtacccgtgttgggtaactttgcactgccagtggaaattattccgctttcacaaggcgtcgtgagtcgggaattagaaaagtttggcggtagggtgactttacgcttggcgaaacatactcgtgccgatctcaatcaaacgcctagcgagccatttgtgacggataacggcggatggatcctggatgtcgcaggtctgcggattgccagtcctgctcagatggaagcgcagattaatcaaattgccggagtcattaccgttggtctgtttgccaaagaaaaggctaatattttgctagttagcaatgctgctggagtcgaaagaattcagttttag

SEQ ID NO: 2990 - DNA, 711 bp, Polynucleobacter necessarius
atgaatcaagatcaacttaagaaaatggtgggtgatgcggcacgtgatgaggtattaaagctgcctgctggacaaatattaggcgttggtacaggttcaacggctaattgttttattgatgccttagctcctcacaaagatcattttgcgggtactgtgtctagttccaatgccactaccgagcgcctacttaagcatggattcaaagtgttggatcccaacgatgttgttagcttacccgcttatgtcgatggtgcagatgaaattgatcctcagggccacatgattaaaggtggcggcggggctttaacccgtgaaaagattattgcatctatggcgcagcaatttatttgcatctgcgattcgtcaaagcaagtgcctgttttaggtaacttcgctctcccggtagaaattattccgcttgcaaaaggtgttgtcacgcgtgagctagaaaagcttggcgggaaagtcactttacgcttggctaagtctactcgtgcagatttaaaccaaacaccgagtgagccatttgtaaccgataacggtgggtggatactagatatcgctggactacagatcgctgaccctttaaagatcgagagtcaaatcaatcaaatcgctggtgtaatcacagtgggcttattcgccaaagaaaaagcaaacattttgctggtgagtaatgctgctggcgtagatcgcatcgtactttag

SEQ ID NO: 2991 - DNA, 663 bp, Thiomonas intermedia K12
atgacgcaagacgaactcaaacagcaggtcgccgcggccgcgctcacccaggtgccgcagggcgaaatcatcggagtcggcacgggctcgacggtgaattttttcatcgacgccctggctggcatcaagtaccagatcaaaggcgcggtgtcgagctccgagcgttccaccgagcgtctgcgcgcgcatggcatcacggtgtatgacctcaacgaggtggcgcagctttcggtctatgtcgatggcgccgacgaaatcgacgcctcgggcgcgatgatcaaaggcggcggcggcgcgctgacgcgcgaaaaaatcatcgccgaggccgcagagcgcttcatctgcatcgtcgatcaaagcaagctggtgccggtgctgggtcaatttcctttgccggtcgaagtcgtgccgatggcgcgggaactggtggcgcgccgcttgcgtgccctggggggcgatccgcgcgagcgttcaggctacgtgaccgataacggcaatctgattctggacgttcacggcctggagattgcgcagccgcgcgaatttgaaacccgtgtgaaccagattccgggtgtggtgaccgtgggcctgttcgcactgcgcgctgccaacgtcgccctgatcggcactgccgagggtgtgcagcggcgcgattttgtttga

SEQ ID NO: 2992 - DNA, 699 bp, Dechloromonas aromatica RCB
atgcgcagcaaaccattcaggagcatcaccatgacccaggacgaactcaagcaggccgttgcccaggccgccgccgattacgtggcgcagaccgccccggccggcagcattatcggcgttggcaccggctcgacggccaatttcttcatcgatgcgctggcgccgctcaaggacaagtacaagggcgccgtcgccagttcggaagcgacccgcaagcgcctcgaaggccatggcatcgcagtctacgacctcaatgatgttgaagatattcccgtctatgttgatggcgctgacgaaatcgacgccggcctgaacatgatcaagggtggtggcggtgcgctgactcgcgaaaagatcgtcgcggccgtggctcgtgagttcgtctgcatctgtgacggctccaagctggtcgacaccatgggcaagtttccactgccggttgaggtcatcccgatggcccgcgcccatgttgcccgcgaactggccaagctgggtggtacgccggtgctgcgcgagggttttgtgaccgataacggcaatatcattctcgacgtcaaaggcctgtcgattaccgacccgaaggggctggaagcgcaaatcaaccagatcaccggcgtcgtcaccaatgggctgtttgccgttcgcccggccaacctgttgctgctcggcacggctgacggcgtcaggaccattcgctga

SEQ ID NO: 2993 - DNA, 663 bp, Candidatus Accumulibacter phosphatis clade IIA str. UW-1
atgacccaggacgaaatgaagaaggcggtcgcgcacgcggccctcgcgcacgtggtcgacggaaagatcgtcggcgtcgggaccggctcgacggcgaactgcttcatcgatgcgctggcggccatcaagcaccgcatcggcggtgccgtcgcaagttccgaggcgaccaggcaacgactcgccagccatggcatcgcggtcttcgacctcgacgaggtcgaggaactgcccgtctatgtggacggcgcggacgagatcaacgcagcgatgcaaatgatcaagggcgggggtggcgcgctgacgcgcgagaagatcgtcgcggcagtcgcccggaagttcgtgtgcattgccgacggatcgaaactcgtaccggtgctcggtcgctttcctctgccggtcgaagtcattcccatggctcttggccatgtccgccgcgaactggccaagatcggcggcacgccgcttcggcgtgcgggcttcgtcaccgacaacggcaacctgatcgtcgatgtcggcggcttgccgattgccgatccggtcgaactggaaacgcgcatcaaccagatcgtcggcgtggtcaccaacggcctctttgcctgccgaccagcggacgtctgcctgctcggcacggctgacggcgtgcgcaccctgaccgccgcctga

SEQ ID NO: 2994 - DNA, 663 bp, Aromatoleum aromaticum EbN1
atgacccaggacgaactcaagaaggcagccgcgatcgcggcactcgactacgtcgaaaacggaatgatcgtcggcgtcggcaccggctcgaccgtcaatcatttcatcgacggtctggccggcatcaagggccggatcgcgggagcggtgtccagttcggaagccagcgcacgccgcctgcaggcccacggcatcccggttctggatctgaacgacatcaccgacctgccggtgtacgtggatggagccgacgagatcgatggcgggttttgcatgatcaagggcggaggcggcgcgctgacccgcgaaaagatcgtcgcggcggttgcgcgccggttcatctgcatctgcgacgcgagcaagaaggtcgcctgtctcggccgctttccgctgccggtcgagatcattccgatggcccgcgcctacgtcgaacgcgaactggtccggatcggcggtcggcccgaactgcgcgagggattcgtcaccgacaacggcaacctgatcgtggacgtgcacggcttgatgattacctcaccgcgcgcgctcgagaccgagctgaaccagattgtcggggtggtcaccaatggcctgttcgcgcgccgcggcgcggacgtgctgctgctggcaacgctcgccggggtcgagcgacaggttgcaaactga

SEQ ID NO: 2995 - DNA, 669 bp, Azoarcus sp. BH72
atgacccaggacgaactcaagaaagccgccgccctcgccgcactcgactatgtggaggacggaatgatcgtcggcgtcggcaccggctcgacggtgaaccacttcatcgacgggctggccggcatcaagcaccgtatccgcggcgccgtctccagttccgaggccagctccaaacgccttgccgcgcatggcattgcgctgctcgacctcaacgacgtggacgaactgccggtgtatatcgacggcgcggacgaaatcgaccacggcttcgcgatgatcaagggcggcggcggcgcgctcacgcgcgagaagatcgtcgctgcggtcgcacgccgctttgtctgcatctgcgacgaatccaagcgggtggacgtactgggccgctttccgctgccgatcgaggtcatcccgatggcgcgcagccaggtgatgcgtgcggcggcagcgctgggcgcgacgccgcggctgcgcgagggcttcgtgaccgacaacggcaacctgatcatcgacctccatggcctgtcgatcaccgacccgtgcgcaaccgagcaggccctgaacgcggtcgtgggcgtggtcaccaacggcctgttcgcggcgcgcggtgccgacaccctgctgctggccagcgcccaaggcgtgcgccggttcgagcgttccgcaacataa

SEQ ID NO: 2996 - DNA, 663 bp, Thauera sp. MZ1T
atgacccaggacgaactcaagaaagccgccgcctacgccgctctcgaccacgtggtcgaaggcagcatcgtcggcgtcggcaccggctccaccgtcaaccacttcatcgatgcgctcgccggcatgcgcgatcgcatccgcggcgcggtctccagctccgaagcgagcacgcaacgcctgcgcgcgcacggcatcgaggtgttcgacctcgacggcatcgagtcgctgccggtgtatgtagacggcgccgacgagatcgacggcggcttcgcgatgatcaagggcggcggcggcgcactgacccgcgagaagatcgtcgccgcagtgtccgagcgcttcgtgtgcatctgcgacgcgagcaagaaggtcgaggtgctcggccgcttcccgctgccgatcgaggtgatcccgatggcccgcagccacgtcgcccgcgagctgcgcgcgctcggcggcgagcccaggctgcgcgagggcttcgtcaccgacaacggcaacctgatcctcgacgtgcatgggctgtcgatcaccgaccccgtcaccatcgagatgcggatcaaccagatcgtcggtgtggtcaccaacgggctcttcgccgtgcgcggcgccgacgtgctgctgctcgccgcccccggcggcgtgcaacggctggacgcacggtga

SEQ ID NO: 2997 - DNA, 672 bp, Candidatus Ruthia magnifica str. Cm (Calyptogena magnifica)
atgactcaagacgagatgaaattcgctgttgcgcaagccgcacttaagcacgtagtaaaagatactattataggcgtgggtactggctctactactaatttttttattgatgcattggcaaaaataaaaaacgaaataaagggggctatcgcaagctctaaagcaactagacaacgattagagagttatgatataaaagtatttgaccttaatgaggtagaaactatttcagtttatattgatggtgcagatgaatcagatgatggcctaaatcttataaaaggtggaggtggtgcactcatgcgcgaaaaaattgtggcagcggtggctaatcaatttatttgtattgctgatgaatcaaagttagtgacaataatgggtgactttccactacctgttgaagttattccaatggcatctaattatgtcaaatatcaaatcagccaaagaattggtggaacgcctacagttagagaaaattttatcactgataatggtaacttaatccttgatattaaagatttaaaaatcaccaaccccaaagtaatggagacaaaactaaatagcattactggagttgtggctaatgggctttttgctaatcgtggcgcagatattttattattaggcacatctaatggcgtgaaaatcgtaacacgtctaattgggtaa

SEQ ID NO: 2998 - DNA, 663 bp, Candidatus Vesicomyosocius okutanii HA
atgactcaagacgaaatgaaattcactgtagcacaaaccgcgctcaagtacgtaataaaaaataccattataggcgtaggaaccggctctactgctaatttttttattgatgcgctatccactataaaaaacaatattaagggagctgttgcaagttctaaagcaactgcacagcgtttagaaaatcatggtattagagtatttgaccttaataaagtaacagccatttcaacttacattgatggtgctgatgaatcagacaataatttaaaccttataaaaggtggtggtggtgcactaacacgagaaaaaattgttgcagcagtggctcatcaatttatttgcattgccgatgaatcaaaattagtttcgattatgggtagttttccactacctattgaggttattccaatggcagctaattatgttaaaaatcagataagccaaaaaattggtggtatacctgaagttagaaaagactttatcactgataatggtaattttattcttgatattaaagatctgaaaatcactaatccaaaagcaatggaaacaaaattaaacagtattattggcgtagtaaccaatggactctttgctaatcgtggtgcaaacgttttattactaggtacaccaaatggcgtaaaaataataaccaattaa

SEQ ID NO: 2999 - DNA, 693 bp, unknown
  Uncultured SUP05 cluster bacterium
ttgaatattatagaatttatggagcgaattatgactcaagacgaaatgaagtttgccgtggcacaagaggcacttaaatacgtggtcaaagacactattataggcgtgggtaccggttcaacagcaaattttttcatcgatgcattggcaaccatgaaggatgatataaaaggttgcgttgccagttctgttgctactgctgaacgtttagaaggtcatggtattaaggtgtttgatctcaatgaagttgaagcaatatctgtctatatcgatggtgccgatgagtccgatgatggcctaaacctgattaaaggcggcggtggtgcactcactcgtgaaaaaatcgtagcagcagtggccgataaatttgtgtgtattgcagatgaatcaaaatttgtaaaaactatgggtgacttcccattgccggttgaagtgattccgatggcggcaaactatgttaaacaccaaatcactcgtcgcattggtggtacaccttttgttcgtgaaaattttgttaccgataatggcaatttgattttagacgttgaagggttaaaaattaccgatcctaaagctttagaaacagaactagacagcattgttggagtggtaacaaacggcttattcgctaatcgcggtgctaatgtattgttgctcggcacaccaactggcgtaacggtagtcggcgcttaa

SEQ ID NO: 3000 - DNA, 675 bp, unknown
  Uncultured SUP05 cluster bacterium
atggagcgaattatgactcaagacgaaatgaagtttgccgtggcacaagaggcacttaaatacgtggtcaaagacactattataggcgtgggtaccggttcaacagcaaattttttcatcgatgcgttggcaaccatgaaggatgacataaaaggttgcgttgccagttctgttgctactgctgaacgtttagaaggccatggtattaaggtatttgatctcaatgaagtggaggcaatatccgtctatatcgatggtgccgatgagtccgatgatggcctaaacctgattaaaggtggtggtggcgcactcactcgtgaaaaaatcgtagcagcagtggccgataaatttgtgtgtatcgcagatgaatcaaaatttgtaaaaactatgggtgacttcccattgccggttgaagtgattccgatggcggcaaactatgttaaacaccaaatcactcgtcgcattggtggtacgccttttgttcgtgaaaattttgttaccgataatggcaatttgattttagacgttgaagggttaaaaattaccgatcctaaagctttagaaacagaactagacagcattgttggagtggtaacaaacggcttattcgctaatcgcggtgctaatgtattgttgctcggcacaccaactggcgtaacggtagtcggcgcttaa

SEQ ID NO: 3001 - DNA, 669 bp, Mariprofundus ferrooxydans PV-1
atgacccaggacgaaatgaaacagaaagtggcggaagctgcgctggcatatgttaagccaggcaccattgtcggtgtcggcaccggctctacggcgaatatgtttattgatgcgctggcgagcatgaagggtgacattatcggtgcagtggccagttctgaagcaacagccgcgcgtctggcagggcatggtattacggtgctggatctgaatgaggcgcttacacaggtggcttcgctttctgtttacattgacggtgcggatgagtttgacgcgggcaagaatctgaccaagggcggcggcggtgcgctgacgcgcgaaaagattgtcgctgcagcatccgatgcctttatctgtatcgtcgatgaaagcaaacgggtggactgtctgggcgcattccctctgccgattgaagtgatcccgatggcgcgtgagctggtagccggtatagccagaaagctgggtggtaaccctgtgctgcgtgatggttttatcaccgataacggcaatctcatcattgatgtgcatggcctgaaaatcaccgatgcgcgggctctggaggatgaacttaacagcgtacctggcgtggtgactaacgggatcttctcgcatcagggcgcggatgtggtcctgatggggactccggccggagtggaaacgattcgctaa

SEQ ID NO: 3002 - DNA, 681 bp, Bordetella parapertussis
atgcttactcagcaagaactcaagcaacaagccgccgacgcggccctcgaattggtcgaacaggtagccgggccggacgtgatcatcggcgtgggcaccggctcgaccgccgatctgttcatcgatggcctggctcgcttcaagggcaggctgcgcggcacggtggccagttccgagcgcagcgcggcgcggctggccggccacggcctggcggtgctggacctcaacgatgtccagagcatgccgatctacgtggacggcgccgacgagatcgatcccaacctgcacatgatcaagggcggcggcggcgcgctgacgcgcgagaagatcgtggcctcggtggcccggcgctacatctgcatcgccgacgagtccaagctggtcgagcggctgggccgctttccgctgccggtggaggtcattcccatggcgcgcaacgccgtggcgcgcggcttgagccggctgggcggccagccggcgctgcgcgaaggcttcgttaccgacaatggcaacatcatcctggacgtggccggcctgtcgatcgccgacgcgccggggctggagaagaccatcaacgacattccgggcgtggtgacctgcggcctgttcgccctggccggcgccgatgtggcgctgctggccacccaggacggcatccgccgcctggagcgccgcggctga

SEQ ID NO: 3003 - DNA, 681 bp, Bordetella bronchiseptica
atgcttactcagcaagaactcaagcaacaagccgccgaagcggccctcgaattggtcgaacaggtagccgggccggacgtgatcatcggcgtgggcaccggctcgaccgccgatctgttcatcgatggcctggctcgcttcaagggcaggctgcgcggcacggtggccagttccgagcgcagcgcggcgcggctggccggccacggcctggcggtgctggacctcaacgatgtccagagcatgccgatctacgtggacggcgccgacgagatcgatcccaacctgcacatgatcaagggcggcggcggcgcgctgacgcgcgagaagatcgtggcctcggtggcccggcgctacatctgcatcgccgacgagtccaagctggtcgagcggctgggccgctttccgctgccggtggaggtcattcccatggcgcgcaacgccgtggcgcgcggcttgagccggctgggcggccagccggcgctgcgcgaaggcttcgttaccgacaatggcaacatcatcctggacgtggccggcctgtcgatcgccgacgcgccggggctggagaagaccatcaacgacattccgggcgtggtgacctgcggcctgttcgccctggccggcgccgatgtggcgctgctggccacccaggacggcatccgccgcctggagcgccgcggctga

SEQ ID NO: 3004 - DNA, 681 bp, Bordetella pertussis
atgcttactcagcaagaactcaagcaacaagccgccgacgcagccctcgaattggtcgaacaggtagccgggccggacgtgatcatcggcgtgggcaccggctcgaccgccgatctgttcatcgatggcctggcttgcttcaagggcaggctgcgcggcacggtggccagttccgagcgcagcgcggcgcggctggccggccacggcctggcggtgctggacctcaacgatgtccagagcatgccgatctacgtggacggcgccgacgagatcgatcccaacctgcacatgatcaagggcggcggcggcgcgctgacgcgcgagaagatcgtggcctcggtggcccggcgctacatctgcatcgccgacgagtccaagctggtcgagcggctgggccgctttccgctgccggtggaggtcattcccatggcgcgcaacgccgtggcgcgcggcttgagccggctgggcggccagccggcgctgcgcgaaggcttcgttaccgacaatggcaacatcatcctggacgtggccggcctgtcgatcgccgacgcgccggggctggagaagaccatcaacgacattccgggcgtggtgacctgcggcctgttcgccctggccggcgccgatgtggcgctgctggccacccaggacggcatccgccgcctggagcgccgcggctga

SEQ ID NO: 3005 - DNA, 678 bp, Bordetella petrii DSM 12804
atgctgactcaacaagaactgaagcaacaggcggctgacgcggccctggccctcatcgaacccctgctcgggcccgacgtgatcattggcgtgggcaccggctctacggccgacctgttcatcgacggcctggcccgctaccgggaccgcctgcgcggcactgtcgccagttccgagcgcagcgccgcgcgcctggctggccacggcatcaccgtgctggacctgaacgacgtgacctccatgccggtgtatgtggacggcgccgacgaaatcgacgcccgcctgcacatgatcaagggcggcggcggcgcgcagacgcgcgaaaaaatcgtggcctcggtggccgatcgctatatctgcatcgtcgatgaatccaagctggtcgagcggctgggcagcttcccgctgccggtcgaggttattcccatggcgcggcaggccgtggcgcgcgcgctggttgcgttgggcgggcaacctcgcctgcgcgaaggcttcaccaccgacaacggcaatatcatcctcgatgtggcgggcctgcagatcgacgacgcgcccgccctggagcttacggtcaacaacctgccgggcgtggtcacctgcggcctgttcgcccgccccggcgccgatgtggcgctgctggccacgcagaacggcatccgccggctcgaacggccctga

SEQ ID NO: 3006 - DNA, 675 bp, Bordetella avium
atgcttactcagcaacagctcaaacaacaggctgccgacgcggcgcttgaattcgtggaacaggtcgccggccccgatgtcatcatcggggtgggcactggctcgaccgccgatctcttcattgacgggctggcccgtttcgccgggcgcatccgcggcacggtcgccagttcagagcgcagcgcccagcgcctggcttcgcacggtttgctcgtgctggacctaaacgatgtccagtacatgccgatttatgtcgacggcgcggacgagatcgatgccaatctgcatatgattaaaggcggtggtggcgccctgacccgcgaaaaaatcgtggcgtccgtggccgagcgcttcatctgcattgcagatgagtccaagcttgtcgatcgcctgggtgcctttccgctgccgctggaggtgattcccatggctcgcgcagccgtggcgcgcagcttggcggcgttgggcggcgaaccccgtctgcgcgaaggtttcgtgaccgataacggcaatatcattcttgacgtgcatggcctgagcatcaacgatgctcccgcgctggaggcccgcgtgaacaatattccgggcgtggtaacctgcggcctgttctcgctggccggcgccgatgttgccttgctcgcaacccagaacggcatccgccgtctatcgcgctga

SEQ ID NO: 3007 - DNA, 654 bp, Limnobacter sp. MED105
atggatgctttaacactcaagaaaatggtggccaaggccgcactgacctatgttcaacctggcacagtactgggcgtgggcacgggttccacggtggattgtttcattgatgccttggccgagtcgggccttcaactcaagggggctgtgtcttcttcggtacgctccgagaaaaagctgcgtgaaatcggtgtgcccattgttgacatgaacgatgtagaaagcctgtcgatttacgtggatggcgccgatgaagtagacccggccaattgcttgatcaaaggtggtggcggtgccaacacccgagagaaaattgtggctgatatttcagacaagtttgtgtgcattgctgaccagtccaaactggtacaagttttgggggcctttcctttgccggttgaagtgttgcccatggcgagtaacgcgattgcccgcaaattgactgcgctgggtgggcaagtcaaagtgcgtgaaggtttcatcaccgacaatggcaacgtaattctggacgtggcaggtttgaaaattaccgacccggttgccatggaaaaagagattaatcactggccaggcgtggttaccaacgggctttttgcgattcgaaaggcagatgtggtgctaatcgcaacagcagacggcataaaaaccctttaa

SEQ ID NO: 3008 - DNA, 672 bp, Acidithiobacillus caldus ATCC 51756
atggacgttagggccctcaaggaaatggctgcggaagcggcgctcagttacattcagcccgggatggtggttggcgtgggcaccggcagtaccagcaatctgttcatcgacgccttgggacgcgcccagatacacgtcgaaggctatgtcgcctccagcctcgccaccgaggcccggctgaagtccctgggtctgccggtgctggacctcaacgccaccggagatattcccgtctacatcgatggcgccgatgaaatcgatccacactttcgtctcatcaagggcggaggcggtgcgctcacgcgggagaagatcgtcgcctcagccgcccggcgcttcatctgcattgccgacaacagcaaggacaagccggcattgggaagttttcccctgcccgtggaggtgatccccttcgctcgcagcttcgttgcccggcagctggtcaagctgggcggcagcccggtcttgcgcaaggatgtgaccacggacaatggtaatgtgattctggatgtgactggcctcgacctgaccgaccctctggccatggagatgcgcatcaacagcattcccggggtgttggacaacggtatctttgcgcaacgacgcgccgacgtggtgctcatgggcagtgaatcgggcctgatcagtcgcgcagcggacacgcaagcctga

SEQ ID NO: 3009 - DNA, 660 bp, Acidithiobacillus ferrooxidans ATCC 53993
atgaatactgacgcactcaaaaaaatggcggccgaagccgctctgcgctatatccagcccggcatggtcgtcggggtgggcactggctccaccaccaacttcttcatcgaagcattgggcgctgccaagattcatgtggacggctacgtcgcgtccagcatcgctaccgaaaaccgcctcaaggcacagggcctcaatgtgctcgaactgaatgccacgggcgatattccggtctatattgacggcgctgacgaggccgacccgcatttccgcctcatcaagggcggcggcggtgcccttacccgcgaaaagatcgtcgccagtgccgcccgactgttcgtgtgtattgcggatgacagcaaggatagacccatgctcggcaaattccccctccctgtggaagtgattccttttgcccgcagctttgtcgcccggcaactggtgaagatcggtggcagccccaccctgcgcagcggtatcaccacggacaacggcaatgtcatcctcgacgtcaccggactcgatttctccgatccgttgcggatggaagaaaccatcaatgcgatcccgggggtgctggataatggcatctttgcccatcggcgtgcggatgtgatgctgtttggcagcgcgggcggcgtcatcgaacgcaaggcataa

SEQ ID NO: 3010 - DNA, 696 bp, Escherichia coli
atgcgtgtgaaatttcataccacaggcgaaacgatcatgacgcaggatgaattgaaaaaagcagtaggatgggcggcacttcagtatgttcagcccggcaccattgttggtgtaggtacaggttccaccgccgcacactttattgacgcactcggtacaatgaaaggccagattgaaggggccgtttccagttcagatgcttccactgaaaaactgaaaagcctcggcattcacgtttttgatctcaacgaagtcgacagccttggcatctacgttgatggcgcagatgaaatcaacggccacatgcaaatgatcaaaggcggcggcgcggcgctgacccgtgaaaaaatcattgcttcggttgcggaaaaatttatctgtattgcagacgcttccaagcaggttgatattctgggcaaattcccgctgccagtagaagttatcccgatggcacgtagtgcagtggcgcgccagctggtgaaactgggcggtcgtccggaataccgtcagggcgtagtgaccgataacggcaacgtgatcctcgacgtccacggcatggaaatccttgacccgatagcgatggaaaacgccataaatgcgattcctggcgtggtgactgttggtttgtttgctaaccgtggcgcggacgttgcgctgattggcacacctgacggtgtcaaaactattgtgaaatga

SEQ ID NO: 3011 - DNA, 696 bp, Shigella dysenteriae
atgcatgtgaaatttcataccacaggcgaaacgatcatgacgcaggatgaattgaaaaaagcagtaggatgggcggcacttcagtatgttcagcccggcaccattgttggtgtaggtacaggttccaccgccgcacactttattgacgcgctcggtacaatgaaaggccagattgaaggggccgtttccagttcagatgcttccactgaaaaactgaaaagcctcggcattcacgtttttgatctcaatgaagtcgacagccttggcatctacgttgatggtgcagatgaaatcaacggccacatgcaaatgatcaaaggcggcggcgcggcgctgacccgtgaaaaaatcattgcttcggttgcggaaaaatttatctgtattgcagacgcttccaagcaggttgatattctgggcaaattcccgctgccagtagaagttatcccgatggcacgtagtgcagtggcgcgccagctggtgaaactgggcggtcgtccggaataccgtcagggcgtagtgaccgataatggcaacgtgatcctcgacgtccacggtatggaaatccttgacccgatagcgatggaaaacgccataaatgcgattcctggcgtggtgactgttggcttgtttgctaaccgtggcgcggacgttgcgctgattggcacacctgacggtgtcaaaaccattgtgaaatga

SEQ ID NO: 3012 - DNA, 696 bp, Citrobacter koseri ATCC BAA-895
atgcgcctgaattttcacaccacaggcgaaacgatcatgacgcaggatgaactgaaaaaagcagtaggatgggcggcacttcagtatgtacagcccggcaccattgtgggcgtaggtaccggttcaacagccgcgcactttattgatgcgctgggcacaatgaaaggtcagattgaaggggcggtgtccagctcggatgcatctactgaaaaactcaagagcctcggcattaccgttttcgatctgaatgaagtggacagcctgggcgtctatgttgatggcgcggatgagatcaacggccacatgcagatgattaaaggcggcggcgcggcgctgacgcgtgagaaaatcattgcttcggtggcgaagaaattcatctgcatcgcggatgcctccaaagaggtcgatattctgggtaaattcccgctgccggtggaagtgatcccgatggcgcgcagcgctgtcgcacgccagttagtgaagctgggcggtcgtcctgagtaccgtcagggcgtagtcactgataacggcaatgttatcctcgacgtatacggcatggaaattcttgatccgatcgcgatggaaaacgcgattaacgccattccgggcgtcgtgaccgtcggcctgttcgccaaccgtggcgcggatgtggcgctgattggtacggcagacggcgtaaaaactatcgtaaaatga

SEQ ID NO: 3013 - DNA, 696 bp, Escherichia coli
atgcgtgtgaaatttcataccacaggcgaaacgatcatgacgcaggatgaattgaaaaaagcagtaggatgggcggcacttcagtatgttcagcccggcaccattgttggtgtaggtacaggttccaccgccgcacactttattaacgcactcggtacaatgaaaggccagattgaaggggccgtttccagttcagatgcttccactgaaaaactgaaaagcctcggcattcacgtttttgatctcaacgaagtcgacagccttggcatctacgttgatggcgcagatgaaatcaacggccacatgcaaatgatcaaaggcggcggcgcggcgctgacccgtgaaaaaatcattgcttcggttgcggaaaaatttatctgtattgcagacgcttccaagcaggttgatattctgggcaaattcccgctgccagtagaagttatcccgatggcacgtagtgcagtggcgcgccagctggtgaaactgggcggtcgtccggaataccgtcagggcgtagtgaccgataacggcaacgtgatcctcgacgtccacggcatggaaatccttggacccgatagcgatggaaaacgccataaatgcgattcctggcgtggtgactgttggtttgttgctaaccgtggcgcggacgttgcgctgattggcacacctgacggtgtcaaaactattgtgaaatga

SEQ ID NO: 3014 - DNA, 732 bp, Escherichia coli
ttgccaacggggtctgaatcactttttttgtatataatgcgtgtgaaatttcataccacaggcgaaacgatcatgacgcaggatgaattgaaaaaagcagtaggatgggcggcacttcagtatgttcagcccggcaccattgttggtgtaggtacaggttccaccgccgcacactttattgacgcactcggtacaatgaaaggccagattgaaggggccgtttccagttcagatgcttccactgaaaaactgaaaagcctcggcattcacgtttttgatctcaacgaagtcgacagccttggcatctacgttgatggcgcagatgaaatcaacggccacatgcaaatgatcaaaggcggcggcgcggcgctgacccgtgaaaaaatcattgcttcggttgcggaaaaatttatctgtattgcagacgcttccaagcaggttgatattctgggcaaattcccgctgccagtagaagttatcccgatggcacgtagtgcagtggcgcgccagctggtgaaactgggcggtcgtccggaataccgtcagggcgtagtgaccgataacggcaacgtgatcctcgacgtccacggcatggaaatccttgacccgatagcgatggaaaacgccataaatgcgattcctggtgtggtgactgttggtttgtttgctaaccgtggcgcggacgttgcgctgattggcacacctgacggtgtcaaaactattgtgaaatga

SEQ ID NO: 3015 - DNA, 738 bp, Klebsiella pneumoniae
gtgatctgcatcgcagggacatttccactatcgatgttctataatgcgccacaggcattcacatctcggaccagaattatgacgcaggatgaactgaaaaaagcggtaggttgggcagcactgcaatatgtacagccagggactattgtcggcgtaggcaccggctcgacggcggcccattttattgacgcgctgggcaccatgaaggggcagatcgaaggggcggtttccagctccgacgcctccaccgagaagctgaaaagcctcgggatcaccgtcttcgatcttaacagcgtcgatcgcctggggatctatgttgacggcgcggatgagatcaacggccatatgcagatgatcaaaggcggcggcgcggcgctgacccgtgaaaagatcatcgcctcggtcgcggataaatttatctgcatcgccgacgcctccaagcaggtcgatattctgggcaagttcccgctgccggtggaagtcattccgatggcgcgcagcgccgtggcgcgtcagctggtcaagctgggcggccgtccagagtaccgtcagggcgtggtgaccgataacggcaacgtgatccttgacgtgcacggcctggaaattctcgatgcgatcgcgctggaaaacgcgatcaacggtattcctggcgtcgtcaccgtggggctgttcgccaaccgtggcgccgacgtggcgctgattggcactgccgacggcgtgaagaccatcgtaaaatag

SEQ ID NO: 3016 - DNA, 717 bp, Citrobacter youngae ATCC 29220
atgttctataatgcgcgtgaattttcccaccatattcacaccacaggcgaaacgatcatgacgcaggatgaactgaaaaaagcagtaggatgggcggcacttcagtatgtacagcccggtaccattgtgggcgtaggtacaggttcaacagccgcacactttattgatgcgctgggcacaatgaaaggtcagattgaaggcgcggtgtccagttctgacgcctcgaccgaaaaactcaaaagccttggcatccacgtgttcgatcttaacgaagtggacagccttggcgtctacgttgacggcgcggatgaaatcaacggccatatgcagatgatcaaaggcggcggcgcggcgttgacccgtgaaaaaatcattgcttccgtggcgaagaaatttatctgcatcgcggacgcgtccaaagaagttgatattctcggcaacttcccgctgccggtagaagtgatcccaatggcgcgtagcgctgtggctcgccagctggtgaagctgggcggtcgccctgaatatcgtcagggcgtggtgactgacaatggcaacgtgatccttgatgtgcacggtctggaaatccttgacgccatcgcgatggaaaacgccatcaatgcaattccgggcgtggtaaccgtaggtttgttcgctaaccgtggcgctgacgtcgcgctgatcggtacgcctgacggcgtgaaaactatcgtaaaatga

SEQ ID NO: 3017 - DNA, 717 bp, Citrobacter sp. 30_2
atgttctataatgcgcgtgaattttcccaccatattcacaccacaggcgaaacgatcatgacgcaggatgaactgaaaaaagcagtaggatgggcggcacttcagtatgtacagcccggtaccattgtgggcgtaggtacaggttcaacagccgcacactttattgatgcgctgggcacaatgaaaggtcagattgaaggtgcggtatccagttcggacgcttcaaccgaaaaactcaaaagcctcggtatccacgtgttcgatcttaacgaagtggactgcctcggcgtatacgttgacggcgcggatgaaatcaacggccacatgcagatgatcaagggcggcggcgctgcgttgacccgtgaaaaaattattgcttccgtggcgaagaaatttatctgcattgccgacgcgtccaaagaagtcgatattctcggtaacttcccgctgccggttgaagtgatcccaatggcgcgcagcgctgtggctcgccagttggtgaagctgggcggtcgtcctgaataccgtcagggcgtagtgacggacaatggtaacgtgatccttgatgtacacggtctggagatcctcgatgccatcgcgatggaaaacgccatcaatgcgattccgggcgtggtaaccgtcggtctgtttgccaaccgtggtgcggatgttgcgctgatcggtacgccagacggcgtgaaaactatcgtaaaatga

SEQ ID NO: 3018 - DNA, 696 bp, Enterobacter sp. 638
atgcgccctgagttttcacaccacaggcaaacgatcatgacgcaggatgaactgaaaaaagcagtaggatgggccgcactccagtatgtacaaccgggcactattgtcggtgtgggtactggctcgaccgcagcacactttattgatgcgcttggcacgatgaaagggcagatcgagggtgcagtttccagctctgatgcctccacggaaaaactgaaaagtctgggcattaccgtgttcgatctgaacgaagtggatcgtctgggcatttacgtggatggggccgacgaaatcaacggccacatgcagatgatcaaaggcggtggcgcggcgctgacgcgtgagaaaatcattgcttccgttgctgataaattcatttgtatcgccgatgcctctaagcaggtcgatatcctggggacttttcctctgccggtcgaagtcattccgatggcgcgcagcgcggttgctcgtcaactggtgaagctgggtggccgcccggaatatcgtcagggtgtggtcactgataacggtaatgtgattctggacgtttacaatctggaaatccttgacgccgtggcgatggaaaacgccatcaatgcgattccgggcgtagtgactgtagggctattcgccaatcgtggcgcggatgtggcgctgattggcaccgctgacggcgtgaaaaccatcgtaaaatga

SEQ ID NO: 3019 - DNA, 696 bp, Cronobacter sakazakii ATCC BAA-894
atgcgccacagtttttacaccacaggcaaaactctcatgacgcaggatgaacttaaaaaagccgtcggctgggccgcactgaagtatgtcgagccgggcacgattgtcggcgtaggcaccggttccaccgccgcgcattttatcgacgcgctgggcaccatgaaaaacgagattgaaggcgcggtttccagctctgacgcctccaccgcaaagctcaaaagcttaggcattactgttttcgatcttaacgaggtggattctctgggcatctatgtcgatggcgcagatgaaatcaacggccagatgcagatgatcaaaggtggcggcgcggcgctgacgcgcgagaaaatcatcgcgtcggtggcgcaaaagttcatctgtatcgcggatgcgtccaaacaggtggatgtgcttggcactttcccgctgccggtggaagtgatcccgatggctcgcagcgcggtcgcgcgtcagctggtgaagctcggcggacgcccggagtatcgccagggcgtggtgacggataacggcaacgtgattctggacgtgtacggtttaaccattctcgacccgatcgcgctggaaaatgccattaacggcattccgggcgtcgttaccgttggtctgtttgcgaatcgcggcgcggacgtggcgctcatcggcaccgccgatggcgtgaaaaccatcgtaaaatga

SEQ ID NO: 3020 - DNA, 696 bp, Cronobacter turicensis
atgcgtcacagtttttacaccacaggcaaaattctcatgacgcaggatgaacttaaaaaagccgtcggctgggccgcacttcagtatgtcgagccgggcacgattgtcggcgtaggcacaggctccaccgctgcgcattttatcgacgcgctgggcaccatgaaaaacgagattgaaggagcggtttcgagctctgacgcctctaccgaaaagctcaaaagcttaggcattaccgttttcgatcttaacgaggtggattctctcggcatctatgtggatggcgctgatgagatcaacggccagatgcagatgatcaaaggcggcggcgcggcgctgacccgcgagaaaatcatcgcgtcggtggcgaaaaagttcatctgtattgcggatgcgtccaagcaggtggatgtgctcggcaacttcccgctaccggtggaagtgatcccgatggcccgtagcgcggtcgcgcgtcagctcgtgaagctcggcgggcgtccggagtatcgtcagggcgtggtgaccgataacggcaacgtgattctcgatgtctacggtatggccattctcgatccgattgcgctggagaatgccattaacggcattccgggcgttgtcaccgttgggctttttgcgaaccgcggcgcggacgtggcgctgatcggcaccgccgacggcgtgaaaaccatcgtgaaatga

SEQ ID NO: 3021 - DNA, 660 bp, Escherichia coli
atgacgcaggatgaattgaaaaaagcagtaggatgggcggcacttcagtatgttcagcccggcaccattgttggtgtaggtacaggttccaccgccgcacactttattgacgcgctcggtacaatgaaaggccagattgaaggggccgtttccagttcagatgcttccactgaaaaactgaaaagcctcggcattcacgtttttgatctcaacgaagtcgacagccttggcatctacgttgatggcgcagatgaaatcaacggccacatgcaaatgatcaaaggcggcggcgcggcgctgacccgtgaaaaaatcattgcttcggttgcagaaaaatttatctgtattgcagacgcttccaagcaggttgatattctgggtaaattcccgctgccagtagaagttatcccgatggcacgtagtgcagtggcgcgccagctggtgaaactgggcggtcgtccggaataccgtcagggcgtagtgaccgataacggcaacgtgatcctcgacgtccacggcatggaaatccttgacccgatagcgatggaaaacgccataaatgcgattcctggcgtggtgactgttggcttgtttgctaaccgtggcgcggacgttgcgctgattggcacacctgacggtgtcaaaaccattgtgaaatga

SEQ ID NO: 3022 - DNA, 660 bp, Escherichia coli
atgacgcaggatgaattgaaaaaagcagtaggatgggcggcacttcagtatgttcagcccggcaccattgttggtgtaggtacaggttccaccgccgcacactttattgacgcgctcggtacaatgaaaggccagattgaaggggccgtttccagttcagatgcttccactgaaaaactgaaaagcctcagcattcacgtttttgatctcaacgaagtcgacagccttggcatctacgttgatggcgcagatgaaatcaacggccacatgcaaatgatcaaaggcggcggcgcggcgctgacccgtgaaaaaatcattgcttcggttgcagaaaaatttatctgtattgcagacgcttccaagcaggttgatattctgggtaaattcccgctgccagtagaagttatcccgatggcacgtagtgcagtggcgcgccagctggtgaaactgggcggtcgtccggaataccgtcagggcgtggtgaccgataatggcaacgtgatcctcgacgtccacggcatggaaatccttgacccgatagcgatggaaaacgccataaatgcgattcctggcgtggtgactgttggcttgtttgctaaccgtggcgcggacgttgcgctgattggcacacctgacggtgtcaaaaccattgtgaaatga

SEQ ID NO: 3023 - DNA, 660 bp, Escherichia coli
atgacgcaggatgaattgaaaaaagcagtaggatgggcggcacttcagtatgttcagcccggcaccattgttggtgtaggtacaggttccaccgccgcacactttattaacgcactcggtacaatgaaaggccagattgaaggggccgtttccagttcagatgcttccactgaaaaactgaaaagcctcggcattcacgtttttgatctcaacgaagtcgacagccttggcatctacgttgatggcgcagatgaaatcaacggccacatgcaaatgatcaaaggcggcggcgcggcgctgacccgtgaaaaaatcattgcttcggttgcggaaaaatttatctgtattgcagacgcttccaagcaggttgatattctgggcaaattcccgctgccagtagaagttatcccgatggcacgtagtgcagtggcgcgccagctggtgaaactgggcggtcgtccggaataccgtcagggcgtagtgaccgataacggcaacgtgatcctcgacgtccacggcatggaaatccttgacccgatagcgatggaaaacgccataaatgcgattcctggcgtggtgactgttggtttgtttgctaaccgtggcgcggacgttgcgctgattggcacacctgacggtgtcaaaactattgtgaaatga

SEQ ID NO: 3024 - DNA, 660 bp, Salmonella enterica
atgacgcaggatgaactgaaaaaagcggtaggatgggcggcacttcagtatgtacagcccggcaccattgtgggcgttggtacaggctcaacggccgcacactttattgatgcgctgggcacaatgaaaggccagattgaaggcgcggtctccagctcggacgcctcgactgaaaaactcaaaggcctcggtattcatgtgtttgatctcaacgaagtggatagcctgggtatctatgtcgatggcgcggacgaaatcaacggtcatatgcagatgatcaaaggcggcggcgcggcattaacccgtgagaaaattattgcttccgtggcggagaaatttatctgtattgcggatgcctctaaacaggtggatattcttggcaaattcccgttgccggtcgaagtgattccgatggcgcgcagcgcggttgctcgtcaactggtgaagctgggcgggcgtccggagtaccgtcagaacgtggtcacggataacggcaacgtgattctggatgtttatggtatggaaatccttgatcccatcgcgctggaaaacgccattaacgcgattccgggcgtcgtgaccgtagggttgttcgccaaccgtggcgccgatgtcgcactgatcggcacgccggacggggtgaaaaccatcgtaaaatga

SEQ ID NO: 3025 - DNA, 660 bp, Salmonella enterica
atgacgcaggatgaactgaaaaaagcggtaggatgggcggcacttcagtatgtacagcccggcaccattgtgggcgttggtaccggctcaacggccgcacactttattgatgcgctgggcacaatgaaaggccagattgaaggcgcggtctccagctcggacgcctcgactgaaaaactcaaaggcctcggtattcatgtgtttgatctcaatgaagtggatagcctgggcatctatgtcgacggcgcggatgaaatcaacggtcatatgcagatgatcaaaggtggcggcgcggcattaacccgtgagaaaattattgcttccgtggcggagaaatttatctgcattgcggatgcctctaaacaggtggatattcttggcaaattcccgctgccggtcgaagtgattccgatggcgcgcagcgcggtcgctcgtcaactggtgaagctgggcgggcgtccggagtaccgtcagggcgtggtcacggataacggcaacgtgattctggatgtttatggtatggaaatccttgatcccatcgcgctggaaaacgccattaacgcgattccgggtgtcgtgaccgtggggctgttcgccaaccgtggcgcggacgttgcactgattggcacgccggacggggttaaaaccattgtaaaatga

SEQ ID NO: 3026 - DNA, 660 bp, Escherichia fergusonii
atgacgcaggatgaactgaaaaaagcagtaggttgggcggcgcttcagtatgtacagccgggcactatcgttggggtcggtactggctcaaccgctgcacattttattgatgcattaggcacgatgaaagatcaaattgaaggggcggtttccagctcggatgcgtcaaccgaaaagctgaaaagccttggtattaccgtttttgatctcaacgatgtggacagcctcggtatctacgttgacggtgctgatgaaattaacggtcatatgcagatgatcaaaggcggtggcgcagcgttaacccgtgaaaaaatcatcgcttccgtggcgaaaaaatttatctgcatcgcagatgcctccaagcaagtggatattctcggtaaatttccactgccagtagaagtgattcctatggctcgtagtgcagtggctcgccagctggtgaaactgggcgggcgtccggaataccgtcagggtgtgatcactgataacggtaacgttattcttgatgtgcacggtatggagatccttgacccggtggcaatggaaaatgcgattaatgccatcccaggtgtggttactgtcggtttatttgctaaccgtggcgcggatgtggcactgattggcaccgctgaaggcgtaaaaaccatcgttaaataa

SEQ ID NO: 3027 - DNA, 660 bp, Escherichia albertii TW07627
atgacgcaggatgaattgaaaaaagcagtaggatgggcagcacttcaatatgttcagcccgggaccattgttggcgtaggcacggggtcaaccgccgcacattttattgatgcgctcggcacgatgaaagatcagattgaaggtgcggtttccagttctgaagcatccactgaaaaactgaaaagcctcggcattcacgtttttgatctcaatgaagtggacagcctcggcatctatgttgatggcgctgatgaaatcaacggccatatgcagatgatcaaaggcggtggtgcggcgctaacgcgtgaaaaaatagttgcttcagtggcgaagaaatttatctgtattgcggacgcctctaagcaggttgatattctgggtaaattcccgctgccggtagaagttattccgatggcgcgtagcgcagtagcgcgccagctggtgaaattgggtggccgaccggaataccgtcaaggcgtggtaaccgataatggtaacgtgattctcgacgttcacggtatggaaattcttgaccctatagcgatggaaaacgcgattaacgctattcctggtgtcgttactgttggtctgtttgctaaccgtggtgcggatgttgcgctgattggcacggctgacggtgtcaaaaccattgtgaaatga

SEQ ID NO: 3028 - DNA, 660 bp, Klebsiella pneumoniae
atgacgcaggatgaactgaaaaaagcggtaggttgggcagcactgcaatatgtacagccagggactattgtcggcgtaggcaccggctcgacggcggcccattttattgacgcgctgggcaccatgaaggggcagatcgaaggggcggtttccagctccgacgcctccaccgagaagctgaaaagcctcgggatcaccgtcttcgatcttaacagcgtcgatcgcctggggatctatgttgacggcgcggatgagatcaacggccatatgcagatgatcaaaggcggcggcgcggcgctgacccgtgaaaagatcatcgcctcggtcgcggataaatttatctgcatcgccgacgcctccaagcaggtcgatattctgggcaagttcccgctgccggtggaagtcattccgatggcgcgcagcgccgtggcgcgtcagctggtcaagctgggcggccgtccagagtaccgtcagggcgtggtgaccgataacggcaacgtgatccttgacgtgcacggcctggaaattctcgatgcgatcgcgctggaaaacgcgatcaacggtattcctggcgtcgtcaccgtggggctgttcgccaaccgtggcgccgacgtggcgctgattggcactgccgacggcgtgaagaccatcgtaaaatag

SEQ ID NO: 3029 - DNA, 660 bp, Enterobacter cancerogenus ATCC 35316
atgacgcaggatgaactgaaaaaagcagtaggatgggccgctctccagtacgtacagccaggtaccattgtgggtgttggtacggggtcaacggcggcacactttatcgatgccctgggcacgatgaaagggcagatcgagggcgcggtatcaagctccgatgcttccacggaaaagctgaaaagccttggtattaccgtttttgatttgaacgaagtggaccgtctcggcatctacgttgacggcgcggatgaaatcaacggccatatgcagatgatcaaaggcggcggcgcggcgctgacgcgtgaaaagatcattgcctccgttgcggacaaatttatctgcattgccgatgcgtccaagcaggtcgatattctgggtaatttcccgctgccggtcgaagtgatcccaatggcacgcagcgcagtggcgcgcgagctggtgaggctgggtggccgtccggaatatcgtcagggcgtggtgacggataatggcaacgtgatcctcgacgtgcacggcctggagatcctcgatgcggtggcgctggaaaacgccatcaacggcattcccggcgtggtgacggtagggctgttcgccaaccgtggcgcggatgtggcgctgatcggaaccgctgacggcgtgaaaaccatcgtaaaatga

SEQ ID NO: 3030 - DNA, 660 bp, Klebsiella pneumoniae
atgacgcaggatgaactgaaaaaagcagtaggttgggcggcgctgcaatacgtacagccagggaccattgtcggcgtaggtaccggctcgacggcggcgcattttattgatgcgctggggaccatgaaagggcagatcgaaggcgcggtatccagctccgacgcctctaccgagaaactgaaaagcctcggaatcccggtattcgaccttaactccgtcgaccgcctggggatctatgttgatggcgcggatgagatcaacggccatatgcaaatgatcaaaggcggcggcgcggcgctgacccgtgagaagatcatcgcttcggtcgccgataaatttatctgcatcgccgatgcctccaagcaggttgatattctcggcgcattcccgctgccggttgaagtcattccgatggcgcgcagcgccgtcgcgcgtcaactggtcaagctgggcggtcgtccggagtaccgtcagggcgtggtgaccgataacggcaacgtcatcctggacgtgcatggcctggaaattcttgatgctgtcgcgctggagaatgccatcaacggcatccctggcgtcgtgaccgtagggctgttcgccaaccgcggggccgacgtggcactgatcggtacggccgatggcgtgaaaaccatcgtaaaatag

SEQ ID NO: 3031 - DNA, 660 bp, Pantoea sp. At-9b
atgacccaggatgaactgaaaaaagcggtaggttgggcagcactgcaatatgtgcagccgggcaccattgttggcgttggcaccggttcaaccgctgctcattttattgatgcgttaggttcgattaagcatcaaattgagggcgcggtctccagctcagaagcctcgacgcagaaactgaagtccctcggcattcacgtgtttgatctcaatgaagtggattcgctgtcggtgtatgtcgacggtgcagatgagatcaacccgcacatgcagatgatcaaaggtggcggcgcggcgctgacgcgtgagaaaattgtctccgccgtggcagagaaatttatctgtattgccgatgcctcaaaagaagtggatgtgttgggccattttccgctgccggtagaagtgatcccgatggcgcgttcctatgtggcacgtgaactggtgaagctgggcggtctgccggaataccgtcagaacgtggtgaccgataacggcaacattattctcgacgtgcataatctgcgcatcctggacccgatcgcgctggaaaaagccatcaatgcgctgccgggtgtggtaacggtggggctttttgccgcacgcggtgctgatgtagcgttgatcggcacggccgatggcgtaaaaaccattaccaaatga

SEQ ID NO: 3032 - DNA, 660 bp, Erwinia pyrifoliae Ep1/96
atgacgcaggatgaactgaaaaaggccgtaggctgggccgcgcttgattacgtcacgccgggcactgtcgttggggttggcactggctcgacggccgcgcactttattgatgcactggcgtcgatgaaacatcaaatcgaaggaacggtctccagctcggagctgtctaccgccaggctaaaagcctatggtattcccgtctttgaccttaatgaaattgacgtcctttcgctctatgttgacggtgccgatgagattaacggccagatgcaaatgatcaaaggcggcggcgcggcgctaacgcgcgagaagatcattgctgcggtagccgatcgctttatttgtattgctgatgagtccaagcaggttgatgtgctggggcattttccgctgccggtggaagtgatcccgatggcgcgttcctacgttgcgcgcgaactggtgaagcttggcgggctgccggagtaccgccaggatgtggtgactgataacggcaatatcattctcgatgtgcataacctcaacattattgacccgatccggttggaaacggcgatcaatgcgctgaccggcgtggtcaccgttgggctgtttgctgcccgtggtgccgatgtggcgttgattggcaccgcaaacggtgtgcagaccatcaaaaagtga

SEQ ID NO: 3033 - DNA, 660 bp, Erwinia tasmaniensis Et1/99
atgacgcaggatgaactgaaaaaggccgttggctgggccgcgcttgattacgtcacgccgggtactattgttggggtaggcacaggctcgaccgccgcgcattttattgatgcgctggcgtcgattaaacatcaaatcgagggaacggtttccagctcggagatgtctaccgccaggctaaaagcgtatggcatccccgttttcgacctcaacgagatcgatgctctctcgctctatgttgatggtgccgatgagataaacggacaaatgcagatgatcaaaggtggtggtgccgcgctgacgcgcgagaaaatcattgctgcggttgccgatcgttttatctgtattgctgatgagtcgaagcaggttgatgtgctggggcactttccgctgccggtggaagtgatcccgatggcacgctcctacgtcgcgcgcgagctggtaaagctcggcggtctgccggagtaccgtcaagatgtgatcaccgacaacggcaatattattctcgacgtgtataacctcagtattattgaccccatcaggctggaaacggcgatcaacgcgctgaccggcgtggtgacggtgggcctgtttgccgctcggggtgccgatgtggcgttaattggcactgccgatggtgtgaagaccatcaaaaaatga

SEQ ID NO: 3034 - DNA, 660 bp, Providencia rustigianii DSM 4541
atgactcaggatgaattaaagaaagcagttggttgggcagcactcgaatatgttaaacctggcaccattgtcggtgttggcacgggctcaacagcctcccactttattgatgcactagccacaatgaaagggcaaatagaaggagctgtttctagctcagaagcttcaactcaaaaactcaaatctttgggtattcctgtttttgattgcaataacgttgattctttagacgtttatgttgatggtgcagatgaagttgataacaacatgaatatgatcaaaggcggtggtgcagcattaacacgcgaaaaaattgtttctgcaattgcaaaaacgtttgtctgtattgttgaccaatctaagctagtggatgttttaggtaaatttcctttacccgttgaagtcattcctatggcgcgtagttatgttgctcgtgaattggttaaactgggcggtcaacctgtttaccgtgagaatgtaattactgataatggtaatgtgattttagatgttcataatttaaaaattctagaccctgttgcgttagaaaacaaaattaatggcattgctggagtggtgacggttggtctgtttgcaaatcgtggagcggatgttgtcttaatgggcacggccgaaggcgtaaaaaccattaagttataa

SEQ ID NO: 3035 - DNA, 660 bp, Providencia alcalifaciens DSM 30120
atgactcaggatgaattgaaaaaagcagtaggttgggcggcattagaatatgttaagccaggcacgattgttggggtaggtacaggttctaccgcatcccactttattgatgcattggcaacaatgaagggacaaattgaaggagccgtttctagctctgaagcatcaacacaaaaattgaaatccttgggtattcctgtttttgactgtaacagtgtagattcattagatgtttatgttgatggggctgatgaagtagatggcaacatgaacatgatcaaaggcggtggtgccgcattaactcgcgaaaaaattgtttctgctattgctaaaacgtttgtctgtatcgttgaccaatctaagttagtgggtgttttaggtaatttccctctaccagtcgaagtcattccgatggcgcgcagctatgttgcgcgtgaattggttaaattaggcgggcaaccagtttaccgtgaaaatgtggtgacggataacggtaacgttattctggatgtccataacttaaagatcctcgatcctgttgcattagaaaacaaaatcaacggtattgctggcgtcgtgactgtgggactattcgctaaccgtggtgctgatgtcgtattgatgggaacagctgaaggtgtaaaaactattaagctgtaa

SEQ ID NO: 3036 - DNA, 663 bp, Providencia rettgeri
atgactcaggacgaattaaaaaaagcggtaggttgggcagcacttgattacgtaaaaccgggcactattgttggtgttggaacgggctcgacggcttcacacttcattgatgcattagcaacaatgaaaggtcaaatagaaggtgcggtatcaagttcagaagcatcaactcaaaaattaaaatcattgggtattacggtatttgattgcaatgaagtggattccttagatgtttatgttgatggtgctgatgaagttgaccatcacctgaatatgatcaaaggcggtggtgcggctttaacacgtgaaaaaattgtttctgcaattgcaaaaacctttgtttgtatcgttgacgaatctaagttagttgatgtgttaggtaaattccctctgcctgttgaagtgatcccaatggcgcgtagctatgtggcacgtgaattggttaaactgggtggcacgccagagtaccgtcaaaatgtgattacagataacggtaatgtgattttagatgtccataatttaaatattattgacccagtggcattagaaaataccattaatgggattgcaggtgttgtgaccgttgggttattcgcgaatcgtggtgcagacgtcgtcttgatgggaactgcaaacgaaggcgttaaaaccatcaagttataa

SEQ ID NO: 3037 - DNA, 657 bp, Providencia stuartii
atgactcaggatgaattaaaaaaagcagtaggttgggcagcattagattacgtgaaaccgggcacgattgttggtgtcggcactggctctaccgcctctcattttattgatgctttggcaacaatgaaggggcagatagagggggcagtttcaagttcagaagcatcgacagcgaaacttaaatcactgggcattcctgtgttagattgtaatgatgttgattcgctggatgtttatgttgatggtgcagatgaaattgatcaccataaaaacatgatcaaaggtggcggggcagccttaacacgtgaaaaaattgtggcagcgattgccaaaacatttgtttgcatcgtagatgagtctaaacaagtggatgtattgggtaaattccctctccctgttgaagtgatcccaatggcacgcagctatgtcgcgcgtgaacttgttaaattaggtggtgtaccagagtaccgccaaaatgtcgttactgataacggtaatgtgattcttgatgtgcataatttaagcattgtggatcctgttgctctcgaaaacaaaattaacgccattgcaggcgttgttacggttggtttgtttgcaaatcgtggcgctgacattgttttaatggggacttctgaaggcgtaaaaacgattaaatag

SEQ ID NO: 3038 - DNA, 657 bp, Proteus mirabilis
atgactcaagatgaattaaaaaaagcagtaggttgggccgcccttgaatatgtaaaaccgggtactatcgtgggcgttggaacaggctctacggcttctcattttattgatgctcttgcaacaatgaaaggtcaaattgaaggggcagtttctagctcagaggcttcaacggcaaaactaaaaagctatggcattcccgtttttgactgtaatgaagttgattcgctcgatatctacgtagacggtgctgatgaaattaaccatcaaatgcagatgatcaaaggtggtggtgcggcattaacccgtgaaaaaatcattgcagcggtggcaaaaacctttgtgtgtattgtcgatgaatcgaaacaagtggatgttttgggtaaattccctctgcctgttgaagttatcccaatggctcgctcttatgttgctcgcgagctggttaaattaggtgggttacctgaatatcgtgaaaacgtcgtgacggataatggtaacgtgatcttagacgtttataatctcactattctgaatcctattgagctagaaaataaaattaatagtattgcaggggtggtcactgtcgggcttttcgctaatcgcggagcagacattgtattaatggggacttctgaaggtgtgaaaaccattaaatga

SEQ ID NO: 3039 - DNA, 660 bp, Photorhabdus luminescens
atgactcaggacgaactaaaaaaagcagtaggttgggcagcactcgaatttgttacaccaggaacagttgtgggtgtggggacaggctcaacggcttcacactttattgatgccctcggttccattaaagatcagattgaaggggcagtatccagctctgaggcttctactgagaagttaaaaagtttggggattcctgtattcgattgtaatgaagtcgattcccttgatatctacgttgatggcgcggatgaaatcaatggcaatatgcagatgattaaaggcggtggtgctgcattgacgcgtgaaaaaatcattgctgcaatagcaaaaaaattcgtttgtattgttgatgcttctaaaaaagttgaggtattgggtaaattccctctgccggttgaggtgattccaatggctcgggcttatgttgctcgtgagttggttaaattggggggagtaccaaaatatcgtcagaatgttgtgactgataacggcaatgtgattcttgatgtgcataatctagccatactcgatcctgctgagttagagaataaaattaatcgtatctcaggtgtggtgactgtgggcctatttgctaaccgtggtgcggatattgtattgatgggaacacttgatggagtggaaaccatcactcaataa

SEQ ID NO: 3040 - DNA, 660 bp, Photorhabdus asymbiotica
atgactcaggatgaactgaaaaaagcagtaggttgggcggcgctcgaatttgtcacgccaggaacgattgtgggggtggggacgggttcgacggcttcgcattttattgatgctcttggctcaattaaagaccaggttaaaggggcagtctctagctctgaggcttctactgagaagttaaaaagtttgggaattcctatacttgattgtaatgaagtggattctcttgatatctatgttgatggcgcagatgaaatcaatagcaatatgcagatgattaaaggcggtggtgctgcattgacccgtgaaaaaatcattgctgcaatagcgaagaaatttgtttgtatcgttgatgcttctaaacaagttgatgtattggggagattccctctgccagttgaagtgattccgatggctcgctcgtatgttgctcgtgaattagttaaattgggaggtgtacccaaatatcgccagaatgttgtgactgataacggtaatgtaatccttgatgttcataatttatcaattctcgatcctattgagttagagaataaaattaatggtattgcaggtgtagtgactgtcggtctgtttgctaatcgtggtgcagatgttgtattgatgggagcattagatggagtgaaaaccatcactcaatga

SEQ ID NO: 3041 - DNA, 663 bp, Dickeya zeae Ech1591
atgacacaggatgaactgaaaaaagccgttggctgggctgcactcgattatgttcgccccggtactattgttggcgtggggacgggttctaccgccgcgcattttatcgacgcattggggtcgatcaaacatcagattgaaggcgccgtctcgagctcggacgcctcgaccgccaaactcaaaagtctggggatcccggtttttgattgtaatgacgtagatgcgcttgacgtttatgtcgatggcgcggatgaaatcaacccacacatgcagatgatcaaaggcggcggtgcggcgttgacgcgggagaaaatcatcgcggcgatcgctcgtcagtttgtgtgtatcgttgatgcatccaaacaggtggatgtgctggggcgtttcccgttgcccgttgaggtgatcccgatggcgcgggcgtatgttgcccgggaactggtcaaactgggtgggcaaccggtgtatcgcgacggtgtcgtcaccgataacggcaacattattttggatgtacacaacatggatctgtccgatgccgtggcgatggagagccgtatcaatggtctggctggcgtggtaaccgtggggttgttcgctaaccgcggggcggatgtcgcgctggtgggaaccgccgatggagtgaaaatagtccgtctaaaataa

SEQ ID NO: 3042 - DNA, 663 bp, Dickeya dadantii Ech586
atgacgcaggatgaactgaaaaaagccgttggttgggccgcactcgattatgttcgccccggtactatcgttggcgtgggaaccggctctaccgccgcgcactttattgacgcactggggtctatcaagcatcaaattgaaggcgcggtttcaagctctgacgcttctaccgccaagctcaaaagtctggggattccggtttttgactgtaatgacgtggatgtgcttgatgtctacgtcgacggcgctgatgaaatcaacccacacatgcagatgatcaaaggtggcggtgccgcattgacccgcgaaaaaatcgtggcggcgatcgcgcgtcagtttgtgtgtatcgtcgatgcgtccaaacaggttgatgtgctggggcgtttcccgttgccggtggaagttatcccgatggcgcgcgcttatgtggcccgtgagctggtcaaactgggtggtcagccggtgtatcgtgatggggttatcacagacaacggcaacattattctggatgtgcacaatatggatctgtcggatgcggtggcgatggaaaactgcatcaataatctggctggcgtggtaacggtggggttgtttgcgaaccgcggtgcggatgtcgcgctggtggggaccgccgacggggtgaaaaccgttcgcctgaaataa

SEQ ID NO: 3043 - DNA, 663 bp, Dickeya dadantii Ech703
atgacgcaggatgaactgaaaaaggccgttggttgggccgcactggattatgtccggcccgggacggttgttggcgtaggtacggggtctaccgccgcacactttattgacgcattgggtacgatcaaggatcagattaaaggcgctgtatccagctctgatgcgtcgactgccaaactgaaaagtctgggtatcccggtctttgattgtaatgatgtcgatgcgctggatgtttacgtcgatggcgccgatgaaattaattcccacatgcagatgatcaaaggcggcggtgcggcgttgacgcgcgagaaaattgtcgcagccatttcccgtcaatttgtgtgcatagtggatgcctcaaagcaggttgaggtgctgggtaagttcccgttgccggtggaagtcattccaatggctcgcacttatgtcacccgcgagctgactaaactgggcggtcgcccggtgtaccgtgacggcgtgttgacggataacggcaacattatcctggacgtgcatgactttgatttatccgatgcggtggctatggagaatcgcatcaatggtattgctggcgtggtgactgtcgggctgtttgccaaccgaggcgctgatgtggcgctggtcggaacggccgatggcgtcaaaaccgttcggttgaagtaa

SEQ ID NO: 3044 - DNA, 717 bp, Pectobacterium wasabiae WPP163
atgttctataatacgcacacgttttcgtatattgattctacaggccagaagcagattatgacgcaagatgaactgaaaaaagcagtgggatgggcggcgctcgattatgtccgccctgacaccattgtgggagtaggaaccggatcgacggcagcacactttattgatgcgctgggctcgataaaacatcaaatcaaaggtgcggtttccagctcagatgcctcaacggaaaagttgaaaagtctgggcattcccgtttttgacgccaatgatgtggattcgctcgatgtttatgtggatggtgcggatgagatcaacgggcacatgcagatgatcaaaggcggtggggcggcactgacccgtgagaaaatcatctcggccctgtcgcgtcagttcatctgcatcgttgatgcatccaagcaggttgatgtgttgggtaagttcccgttgccggttgaagttatcccgatggcgcgatcttacgtggcgcgtgaactggccaaactgggcggacagccagtatatcgtcagggtgtggtgacggataacggcaacgtcattctggatgtacacaacctcaatatcatggatgccgttgcggtagaaaaccacatcaatggtattgcaggcgtcgtgaccgttgggttgtttgctaatcgcggcgcagatgttgcgttagtcggcaccgccgagggtgtaaaaaccgtcgttaaatga

SEQ ID NO: 3045 - DNA, 720 bp, Serratia proteamaculans
gtgaaaaatagcgatttaccctataatacgcacacgttttcgtacagaggcaatggacatattatgacgcaggatgaactgaaaaaagcggttggctgggcagcactggattacgttaccccgggcaccatcgttggggtcggcactggctcgactgccgcccattttattgacgcgctcggctcgatcaagcaccagatcgaaggggcggtgtccagctctgacgcctctaccgccaagctgaaaagcctcggtatccacgttttcgacagcaatgaagtggattcactggatatttatgtcgacggcgcggatgaaatcaaccgccatatgcagatgatcaaaggcggcggcgctgcgctgacgcgtgaaaaaatcattgccgctatcgcgcgcaaatttatctgtattgtcgattccagcaaacaggtcgatgtgttgggtaaattccctctgccggtagaagtcatcccgatggcacgttcttacgtagcgcgtgagctggtcaagctgggcgggctgccggagtatcgtcagaatgtcctgaccgataacggcaacgtgatcctcgatgtgcataacctgagtatcatggacgccattgcgctggaaaacaaaatcaacggcatcgccggtgtggtgaccgtgggtctgttcgccaaccggggtgccgatgtggcgctggtaggtacgcctgacggcgtgaaggttgtcgaataa

SEQ ID NO: 3046 - DNA, 756 bp, Serratia odorifera
atgcggcttagggtgaagaagtgtgatcctgccggagtgaaaaatagcgatttaccctataatacgcacacgttttcgtacagaggcaatggacatatcatgacgcaggatgaactgaaaaaagcggttggctgggcagcgctggattacgttaccccgggcaccatcgttggggtgggcaccggctctaccgccgcccactttattgacgcactcggctccatcaagcaccagatcgaaggggcggtgtccagctccgacgcctctaccgccaagctgaaaagcctgggcatccacgtgttcgacagcaacgaagtggattcgctggatatttacgtcgacggcgcggatgaaatcaaccgccagatgcagatgatcaaaggcggcggcgcggcgctgacgcgtgaaaaaatcattgccgccatcgcgcgcaagtttatctgtatcgtcgactccagcaaacaggtggacgtactgggcaaattcccgttgccggtggaagtgatcccgatggcgcgatcttatgtggcgcgtgagctggtgaaactgggcggcctgccggaataccgtcagaacgtgctgaccgacaacggcaacgtgatcctcgatgtgcataacctgagcatcatggatgccattgcgctggaaaacaaaatcaacggcatcgccggggtggtgactgtcggcctgttcgccaatcgtggtgcggatgtggcgctggtcggtacgcctgacggcgtgaaggtggttgaataa

SEQ ID NO: 3047 - DNA, 660 bp, Pectobacterium carotovorum subsp. carotovorum WPP14
atgacgcaagatgaactgaaaaaagcagtggggtgggcagcgctcgactacgtccgcccagacactattgtgggagtaggaaccggatcgacggctgcacactttattgatgcgctgggttcgataaaacatcaaatcaaaggcgcggtttccagttcggatgcctcaacggaaaagttgaaaagtctgggcatccccgtttttgacgctaatgatgtggattcgctggatgtctacgtggatggcgcggatgagatcaacggacacatgcagatgatcaagggcggtggagcagcgctgacccgcgagaaaatcatttcagcactgtcgcggcagttcatctgcattgttgatgcatccaaacaggttgacgtgctgggcaaattcccgctgccggtcgaagtcatcccgatggcgcggtcttacgtggcgcgtgaactggcgaagttgggcgggcagccggtctatcgtcagggcgtagtgacggataacggcaacgtcattctggatgtgcacaacctgaatatcatggatgcggtcgcggtagaaaaccacattaatggtatcccgggcgttgtgaccgttgggctgtttgccaaccgtggtgcggatgttgcgttagtcggcacggctgagggtgtaaaaaccgtcgttagatga

SEQ ID NO: 3048 - DNA, 660 bp, Pectobacterium carotovorum subsp. brasiliensis PBR1692
atgacgcaagatgaactgaaaaaagcagtgggatgggcagcgctcgactacgtccgccccgacaccattgtgggagtaggaaccggatcgacggcagcacactttattgatgcgctgggttcgataaaacatcaaataaaaggcgcggtttccagctcggatgcctcaacggaaaagttgaaaagtctgggtatccccgtttttgacgctaatgatgtggattcgctggatgtctacgtagatggcgcggatgagatcaacggacacatgcagatgatcaaaggcggtggtgcagcgctgacccgcgagaaaatcatttcggcaatgtcgcgccagttcatctgcattgtcgatgcatccaaacaggttgatgtgctgggtaaattcccgctgccggttgaagttatcccgatggcgcggtcttacgtggcgcgtgaactggcgaagttgggtgggcagccagtctatcgtcagggcgtactgacggataacggcaacgtcattctggatgtacacaacctgaatatcatggatgcggtcgcggtagaaaaccacattaatggtatccctggcgtcgtaaccgttgggttatttgccaaccgcggtgcagatgtcgcgttagtcggtacggctgagggtgtaaaaaccgtcgttaaatga

SEQ ID NO: 3049 - DNA, 660 bp, Pectobacterium carotovorum subsp. carotovorum PC1
atgacgcaagatgaactgaaaaaagcagtgggatgggcagcgctagactatgtccgcccggacaccattgtgggagtaggaaccggatcgacggcggcacattttattgatgcgctgggttcgataaaacaccaaatcaaaggcgcggtctccagctcggatgcctcaacggaaaaactgaaaagtctgggtatccccgtctttgacgccaatgaagtcgattcgctggatgtttacgtcgatggtgccgatgagatcaacggacatatgcagatgattaaaggcggcggtgcggcactgacccgcgagaaaatcatttcggcgctgtcgcgtcagttcatctgcattgttgatgcctctaagcaggttgatgtgctaggtaaattcccgctgccggttgaagttattccgatggcgcggtcttacgtcgcgcgtgaactggtgaagctaggcgggcagccggtctatcgtcagggcgtcgtgacggataacggcaacgtcattctggatgtacacaacctgaatatcatggatgcgatcgcggtagaaaatcacatcaatggtatcccaggcgtggtgaccgttgggctgtttgccaaccgcggtgcggatgtcgcgttagtcggcacgtctgagggtgtaaaaaccgtcgttaaatga

SEQ ID NO: 3050 - DNA, 660 bp, Pectobacterium atrosepticum SCRI1043
atgacgcaagatgaactgaaaaaagcagtgggatgggcagcgcttgactatgttcgccctgacaccatcgtgggagtaggaaccggatcgacggcagcacactttattgatgcgctgggttcgataaaacatcaaatcaaaggcgcggtttccagttcggatgcttcaacggaaaaattgaaaagtctgggcattcccgtttttgatgccaatgatgttgattcgctggatgtttatgtggatggcgcggatgaaatcaacggtcatatgcagatgatcaaaggcggtggtgctgctctgacccgtgagaaaatcatttcggcactgtcgcgccagttcatctgcattgttgatgcgtcaaagcaggttgatgtactgggtaaattcccgttgccagttgaagtcattccaatggcgcggtcttacgtggcgcgtgaactggtgaagctgggtggtcagccggaatatcgtcaaggtgtagtgacggataatggcaacgtcattctggatgtacacaacctgaatatcatggatgcggtcgcggtagaaaaccacattaatggtatcgctggcgtcgtgaccgttgggctgtttgccaaccgcggtgcggatgtggcgttagtcggtacggctgatggtgtaaaaaccgtcactaaatga

SEQ ID NO: 3051 - DNA, 660 bp, Yersinia ruckeri
atgactcaggatgaacttaaaaaagcggttggttgggcagcgttagaatacgtcaagccaggcacgattgttggtgttggcaccggctctaccgccgcacattttattgatgcacttggctcgatcaaaaatcagatcgaaggtgcggtttccagctctgatgcttcaacagcaaaactgaaaagcctgggtatccacgtttttgatagtaatgaagtggatggattggatatctacgttgacggcgcggatgaaatcaacggtcatatgcaaatgattaaaggcggtggtgctgccctgactcgtgaaaagatcattgctgcaatggcgcgtcagtttatctgcattgttgatgcttccaagcaggttgatattctgggcaagttcccgttgccagtagaagtgatcccaatggcgcgttcttatgtcgcccgtgaattggtgaaactgggtggactgccagaatatcgccagaatgtggtaacggataacggtaatgtgattctggacgtatataatctgaatattatggacgctattgcactggaaaataaaatcaacggtattgccggtgtggttaccgttggtctgtttgccaatcgtggtgcggatattgccttggtaggcacagccgaaggcgttaaaaaagttattcgctaa

SEQ ID NO: 3052 - DNA, 660 bp, Yersinia bercovieri
atgactcaggatgaacttaaaaaagcagtgggctgggcagcattagattacgtcaaacccggcaccatcgtcggcgttggtactggctccaccgcagcacactttattgatgctctcggctcgatcaaagatcaaattgaaggggcggtttccagctctgacgcctctaccgctaaactgaaaagttacggcattcatgtctttgattgcaacgaagtggatgtgctggatatctatgttgatggcgctgatgagattaacggccatatgcagatgatcaaaggcggtggtgcggccctgacccgcgagaaaatcattgcggcaatcgcccgtaagtttatctgcattgccgatgcgagcaaacaggttgatctgctgggcaagttcccgctgcccgtcgaagtgatcccgatggcccgctcttatgtggctcgtgagttggttaagctgggcggattgccagaatatcgccaaaatgtgctgaccgataacggcaacgttattttggatgtgcacaacctgacgattttggatgctgtggcgttagagaataaaatcaacggaattgccggtgtggtgacggtcgggttatttgccaaccgtggtgctgatgtggcactgattggcaccgctgatggtgttaagacgatagtaaaataa

SEQ ID NO: 3053 - DNA, 660 bp, Yersinia mollaretii
atgactcaggatgaacttaaaaaagcagtgggctgggcagcattagattatgtcaaacccggcactatcgtcggcgtcggcactggctcaaccgcagcacactttattgatgccctcggctccatcaaagatcaaatcgaaggggcggtttccagctctgacgcctctaccgctaaactgaaaagttacggtattcatgtctttgattgcaacgaagtggatgtactggatatctatgttgatggcgcggatgaaattaacggccatatgcagatgatcaaaggcggcggtgcggccttgacccgcgaaaaaatcattgcggccatcgcccgccagtttatctgcatcgccgatgcgaccaagcaggttgatgtactgggtaagttcccgctgcccgtcgaagtgatcccgatggcccgctcttacgtggcccgcgagttggttaagctgggtggattacctgagtaccgccaaaatgtgctgactgataacggcaacgtgattttggatgtgcataatctgacgattttggatgccattgcattagagaataaaatcaatgggattgcgggtgtggttacggttggattatttgctaaccgtggtgctgatgtggcactgattggtaccgctgagggtgtgaagacgatcgtcaaataa

SEQ ID NO: 3054 - DNA, 663 bp, Yersinia intermedia
atgactcaggatgaacttaaaaaagcagtaggctgggcagcattagattatgtcaaacctggtaccatcgttggggtcggcaccggctcgactgcggcacattttattgatgcacttggctccatcaagggccagatagaaggggcggtttccagctctgatgcgtctactgccaaactgaaaagttacggcatccacgtatttgattgtaatgaagtggacgtattggatatctatgttgacggtgctgatgaaattaacggccagatgcagatgatcaaaggcggtggtgctgcgctgacccgcgagaaaatcattgctgctattgctcgtcagtttatctgcatcgcggatgcatccaagcaggttgatatactgggcaaattcccgctgccagttgaagttatcccaatggcccgttcttatgtggctcgtgaactggttaagctgggtggcttaccggagtaccgtcagaacgtcctgactgataacggcaacgttattttggatgtccacaatttgagtattttggatgccattgcgttagaaaataaaattaatggtattgccggtgtcgttacggttggcttatttgctaatcggggggctgatgtggcactgattggcaccgccgacggcgttaagaccataaaattaaagtga

SEQ ID NO: 3055 - DNA, 663 bp, Yersinia rohdei
atgactcaggatgaacttaaaaaagcagtgggctgggcagcattagattatgtcaaacccggcactattgtcggggttggtaccggctctactgcggcacattttattgatgccctcggctccatcaaacatcaaattgaaggggcggtttccagctcagatgcctctaccgccaagctgaaaagttatggtattcaggtgtttgattgcaacgatgttgatgtgctggatatttatgtcgatggcgctgatgaaattaatggtcagatgcagatgatcaaaggcgggggggctgcgctaacccgcgagaaaattattgccgccatcgcccgtaaatttatttgtatcgctgatgcatccaagcaggttgatgttttgggtaaattcccactgcccgtcgaagttatcccgatggcccgttcctatgttgcccgtgaactggttaaactgggtgggttacctgaatatcgccaaaatgtcctgacggataacggcaacgttattttggatgtgcataatttgactattctggatgcaattgcattagagaataaaatcaatgggatagctggtgttgtcactgttgggctgtttgccaatcgtggagccgatgtcgcactgattggtactgccgagggcgtgaaaactgtcgtgctaaagtga

SEQ ID NO: 3056 - DNA, 663 bp, Yersinia frederiksenii
atgactcaggatgaacttaaaaaagcagtgggctgggcagcattagattatgttaaacccggcactattgttggggttggcaccggctcaaccgcagcgcattttattgatgcgcttggctctatcaaaggtcaaattgaaggggcagtttctagctctgacgcctcaaccgccaagctgaaaagttacggtattcaggtctttgattgcaatgaagtcgatgtgctggatatctatgttgatggtgctgatgaaattaacggtcagatgcagatgattaaaggcggtggtgcagcattgacccgcgaaaaaattattgcggccattgcccgtaagtttatttgtatcgctgatgcatccaagcaagttgatgtattggggagatttccgctgccggtagaagttatccctatggcccgttcttatgttgcccgcgagttggttaagttgggtggcctaccagaatatcgccaaaatgttctgacggataacggcaatgttattttggatgtccataatctgacgattttggatgccattgcactagaaaacaaaattaatggtatcgccggtgttgttacggtagggctttttgccaaccgcggtgctgatgtggcactgattggtaccgccgacggcgttaagaccgtcgttcttaagtga

SEQ ID NO: 3057 - DNA, 663 bp, Yersinia kristensenii
atgactcaggatgaacttaaaaaagcagtgggctgggcagcattagattatgtcaaacccggcactatcgttggggtcggcaccggctctactgcagcacattttattgatgctcttgcctccatcaaaggccagattgaaggggccgtttccagctctgatgcctctaccgccaagctgaaaagctatggtattcaggtgtttgattgcaacgaagtcgatgtgctggatatttatgttgatggcgcggatgaaattaacagccaaatgcagatgattaaaggcggtggtgcagccctgacccgcgagaaaatcattgcggccatttcccgcaagtttatctgtattgctgatgcttccaagcaagttgatgttctgggtaagtttccactgccagttgaagttatcccgatggcgcgttcttatgttgcccgcgagctggtgaaattaggtgggttacctgaatatcgccaaaatgtcctgacggataatggcaatgttattctggatgtgcacaacctgactattttagatgccatcgcgctcgaaaataaaattaatggcatcgccggtgttgtcaccgtagggttatttgccaaccgaggtgctgatgtggcgctgattggtactgccgagggtgttaagacaatcgtgctcaagtag

SEQ ID NO: 3058 - DNA, 663 bp, Yersinia aldovae
atgactcaggatgaacttaaaaaagcagtgggctgggctgcgttggagtatgtcacacccggcactatcgttggggtgggtacaggctccactgcggcacattttattgatgctctcggctcgattaaacatcagatcgaaggggctgtttccagctcggatgcctctaccgctaagttgaaaagcttaggtattcaagtgtttgattgcaatgaagttgatgtgctggatatctatgtcgatggcgctgatgaaattaacggtcagatgcagatgatcaaaggcggcggtgcggcactgacccgcgagaaaatcattgctgccattgcccgtaagtttatttgcatcgcagatgcatcgaaacaggttgatgtgctgggcaggttcccgctgccggttgaagttattccgatggcgcgttcttatgttgctcgcgaactggtgaaattgggtggattaccggaatatcgccagaatgtgctgaccgataacggtaacgttattttggatgtacacaatctgactattctggatgccattgcgcttgaaaataaaatcaatggtattgccggggtggtcaccgttgggctgtttgctaatcgtggcgctgatgtggcactgattggtactgccgacggcgttagaaccatcatagcaaagtga

SEQ ID NO: 3059 - DNA, 663 bp, Yersinia enterocolitica
atgactcaggatgaacttaaaaaagcagtgggctgggcagcattagaatatgtcaaacctggcactatcgttggggtcggtactggctcaactgcggcacattttatcgatgctcttgcttccattaaaggccagatcgaaggggctgtttctagctctgatgcctctaccgctaaactgaaaagttatggcattcaggtatttgattgcaacgaagtggacgagctggacatttatgtcgacggtgctgatgaaattaacagccaaatgcagatgatcaaaggcggcggtgcggctctgacccgcgagaaaatcattgcggccattgcgcgtaaattcatctgtattgccgatgcttccaaacaggttgatgtgctgggtaaattcccgttgccggtcgaagttatcccaatggcgcgttcttatgtggcgcgtgaactggtgaaattaggcgggttacctgaatatcgccagaatgttttgactgataacggcaatgttattttggatgtccataatctgactattttggatgccattgcgcttgaaaataaaattaataatattgccggtgttgtcactgtggggctatttgccaaccgaggtgctgatgttgcactaattggcactgccgatggtgttaaaaccgtagaacttaagtga

SEQ ID NO: 3060 - DNA, 657 bp, Yersinia pestis
atgactcaggatgaacttaaaaaagcggtgggctgggcagcattagattacgttaaacccggtacgattgtgggtgtcggcacgggttcaactgcggcgcattttattgacgcgctaggctcgattaaacatcagatcgaaggggctgtttccagttctgatgcttcaaccgccaagctgaaaagctatggtatcccagtatttgattgtaatgacgttgatgtattggatatctatgttgatggtgctgacgaaattaacggccaaatgcagatgattaaaggcggtggcgcagcactgacccgagagaagattattgcggctatcgcccggaagtttatctgtattgctgatgaatccaaacaagttggtgtgctgggtaaattccccctgccagtcgaagtgatcccgatggcccgctcttatgtggcgcgtgagctgattaaattgggtggtttgcctgaataccgtcagaatgtcctgaccgataacggtaacgttattctggatgtccacaacttgagtattttggatgctatcgctttagagaaccaaattaatggcattgccggtgtcgtaacggtggggctatttgcgaatcgcggtgctgatgtggccctgattggtacggccaatggcgttaaagtgattggctaa

SEQ ID NO: 3061 - DNA, 660 bp, Edwardsiella ictaluri 93-146
atgacgcaggatgaattgaaaaaagcagtgggctgggcagcgctgaagtatgtgcgccctgggaccattgtcggggtaggcaccggctccaccgcctcacactttattgatgcgctggcgaccatgaagggccagatcgagggtgcggtctccagctctgatgcctccaccgccaggctgaaaagcctggggatcccggtctttgacctcaatgaggtggattcgctggatatctatgtggatggggccgatgagatcaacggcgccatgcagatgatcaagggcggcggcgccgcgctgacacgtgagaagatcgtggcggcggtggccaagaagttcgtctgtatcgtcgatgcctctaaacaggtcgatattctgggtagcttcccgctaccggtcgaggtgatcccgatggcgcgcgcctatgttgcccgtgagctggtgaagctgggcgggcagccggtgtatcgtcagggcgtactgaccgacaatggcaacgtgatcctggatgtacacaacctgcagatcatggagccgtgcaaactggagaacgccattaacgccatcgccggcgtcgtgacggtggggctgtttgccaaccgcggtgccgacgttgcgctggtcggctgcgcggatggcgtcaaaacgctgaccctataa

SEQ ID NO: 3062 - DNA, 660 bp, Edwardsiella tarda
atgacgcaggatgaattgaaaaaagcagtgggttgggcagcgctgaagtatgtgcagcctgggaccattgtcggggtaggcaccggctccaccgcctctcactttattgatgcgctggcgaccatgaagggccagatcgagggcgcggtctccagctctgatgcctccaccgccaagctgaaaagtctggggatcccggtctttgacctcaacgaggtggatgcgctggatatctacgtggatggggccgatgagatcaacggcgccatgcagatgatcaagggcggcggcgccgcgctgacgcgtgagaagatcgtggcggcggtggccaagaagttcgtctgcatcgtcgatgcctctaagcaggtcgatattctgggtaacttcccgctgccggtcgaggtgatcccgatggcgcgcgcctacgtcgcccgtgagttggtgaagctgggcggacagccggtgtatcgccagggcgtgctgaccgataacggcaacgtgatcttggatgtacacaacctgcagatcatggagccgtgcaagctggagaacgccattaacgctatcgccggcgtcgtgacggtggggctgtttgccaaccgtggcgccgacgttgcgctggtcggctgcgccgatggggtcaaaacgctgaccctgtaa

SEQ ID NO: 3063 - DNA, 657 bp, Sodalis glossinidius str. 'morsitans'
atgacgcaggatgaactgaaaaaagcggttggctgggccgcgctgaaatatgtccggcttggcacgattgtgggcgtggggaccggctctaccgcggcgcattttatcgacgcgctggcctccgtcaggcaccaaatcgacggggcggtatccagctccgaggcatcgtctgccaaattgcaaagcctgggcatcccgttattcgacctgaatgaggtggattctctggatatttacgtcgatggcgccgatgagattaacggcagcatgcagatgattaaaggcgggggggctgcgctgacccgcgaaaaaatcatcgccgccgtggcgcgtaagtttatctgtatcgccgattccagcaagctggtggacgtgctcggcacctttccgcttccggtggaggtgatccccatggctcgcgcctgggtggctcgcgaattggttcgcctgggcggtgcaccggtctatcgtcagggcgtggtgaccgacaacggcaatatcattctggatgtccacaatctggccattatggatgcggtggcgcttgaggagcaaattaacaatatcccaggcgtcgttaccgttggcctgttcgcgcgccgcggcgccgatgtggcgcttatcggcagcgagcagggcgtcaaaatcattggctaa

SEQ ID NO: 3064 - DNA, 672 bp, Baumannia cicadellinicola str. Hc (Homalodisca coagulata)
atgatgcatgaaaagctcaaaaaagctgttggctgggcagcattagaatatgtaagttctgggatgattattggggtaggaacaggttctactactgatcactttatcgatgcactaggtacagtaaagcataaaattgaaggtgtagtatccagttctgaacagtcaactactaagctaaaaagtatgggaatactactttttaacctaaatgatgtagatggtttagatatatacgttgatggtactgacgaaataaatagtaatatgcagatgataaaaggtggtggtgcagctctaacacgtgaaaaagttcttgcagctgcagcaaataaatttatctgtattgcagatactagcaaacaagttgatattttaggcaactttcctttgcctattgaagtaattccaatggcccatgcttgggtagcacgagaattagtgcatttgaccggtggtttacctaaatatcgtcaaggtgtcataactgataatggtaatattattttagatatatataacttaaaaattttagatgctattgcattagaaaaaattattaataatataccaggtgttgttactgttgggctttttgctaatcgttgtgctgatatagcacttattagcagtgatctgggtattgaagaaataagtagatctatcaaatag

SEQ ID NO: 3065 - DNA, 660 bp, Buchnera aphidicola
atgaatttaaatgaattaaagaaaaaagcggcatgggctgcgctagattatatctatcctggaactgttataggagtaggaacaggtagtactgttttttattttattcaagctttaagtacagtaaaacatttaatatctggagctgtttctagttctaattcttctacggttttattgaaaaaaaacgggataagggtattagatttaaatacctttgacttcttagaaatttatgtagacagtgcagatgaaattaataatgacatgcaaatgattaaaggtggtggagcagccttgacaaaagaaaaaatcattgctgcgatgtcaaaaaaatttgtttgtattattgatgaatcaaaaaaagtaaatattttaggcacttttccattgcctattgaaattattcctatagcattttcttatatttcaaaagaaatattaaaaataggaggacagccaaaattaagagaaaatattataacagataatggtaatgtaattatagatgtttacaatttatttataaatgatcctatatcagtagaaaaaaaaataaattcactacctggagtagttagcgttggtttatttgcttcgagagttgcagatgttgttttaataggtactcaaaaaggagttgagattatcaaaaattaa

SEQ ID NO: 3066 - DNA, 672 bp, Buchnera aphidicola
atgaatttaaacaaactaaaaaaaaaagcagcttgggcggcactagattatattgatcctggtacgatcattggagttggaaccggtacaactattttttatttcattgaagcactcggtacgataaaaaatttgatatatggagccgtatctagttctaattcgtctactgttttattaaaaaaacacggtatagaagtttttgatttaaaaaattttagttctcttgctatttatgtcgatagtgccgatgaaatcaataatcatatgcaaatgattaaaggtggaggaggtgctttaacaagagaaaaaattattgcttcaatgtcaaaaaaatttgtttgtattattgacaaatcaaaaaaagtagatgttcttggaacatttcctctaccaattgaaattattccaatggctctttcttatatttttcgagaaatgataaaaattggtggaacgccaaaatatcgtaaaaatgttattacggacaatggaaatataattatagatgtatataatttatgtataaaagatcctatatcgatggaaaaaaaaattaattcattacccggagtagttacagttggtttatttgcttctagaagcgccgatattgttttgattggaacacaaaaaggaatacgaactattaataaaaaagaaaatagataa

SEQ ID NO: 3067 - DNA, 657 bp, Buchnera aphidicola
atgaagacaaatgaattaaaaagattagtagcacgaaaagtggtagattacattaatcctggttcagttatcggaattggaactggttctaccgtttcatattttatagaagtattaagtactataaaaaatttaatttctggagcagtttctagttcgaacttttctactgcatgtttgaagagaataggtattcctatttatgatttaagtaaaattaattctttggtattatatattgatagtgcagatgaaattaatcctcaattacaaatgattaaaggaggaggagcagcactaactagagaaaagattattgctgcaactgctgaaaaatttatttgtattgcggatgagtctaaacaagtagaaatattaggaaaagttccattacctatagaaattattcctatggcacgttcttatatttcaaacgaaataattaagataggtggtatgccaaaatatcgaaaaaatgtaattacagacaatggaaatgttattattgacgtttttaatttagttataacagatcctgtatgtcttgaaaacaaaattaattcttttcctggagtagtaagtgtaggattattcgctactaggaaagctgatattgcgttaattggaacgtcatctggtgtacaagtaatttattaa

SEQ ID NO: 3068 - DNA, 657 bp, Candidatus Blochmannia pennsylvanicus str. BPEN
atggtacaaaataaattaaaaaaatcagtaggttgggcggctttaaaatatgttcaatctagcagaattataggagtaggaacaggttctactgttacatattttattgaagcactaaacagtataaaagaaaaaatagaaggcgtggtttccagttcaaattactcatctaatcaattaaaaaaaataggtattcctctatgtaatcttaatagcttgcacgaattagatgtatatgttgacagtgcagatgaaattgattcacatatgcaaatgattaaaggtaagggtggggctttgacaaaagaaaaaattattgctgctgcagctaaaaaatttatttgtatcgttgacagcagtaaacaagtaaatatattaggacgaggtcccttgccaatagaagtcattcctatggctcgctcattagtagcaagagaattagtgcgtttaggtggtttaccagaatatcggcataatgtaattactgataatggcaataatatcttagacgtatataacatgaagattgtaaatgcgtcgttattagaaaccaaaattaataatattccaggagtagtgagtgttggtatattcgcgaaaagacgagcagatatagtattaattggaacaagagaaggtataaaaataattgaataa

SEQ ID NO: 3069 - DNA, 669 bp, Candidatus Blochmannia floridanus
atgatatcaaaagataaattaaagaaattagtaggttgggaagctttgaaatatattaaatctaacacaattataggagtaggaactggttctactgttaattattttattgaagctttgagtagtattaaacaacaaatagagggcgtagtatcaagttcgcagcattcatcaaatcagttaaaaaaattaggtattccattatataatttaaataatttaaatgatcttgagatatatattgatagtgcagatgaaattgacttgcatatgcaaatgattaaaggtggaggaggagcgttaacaaaagagaaaattattgcttttgctgctaaaaaatttatttgtattgttgatgatagtaagcaagtaaatatattgggccgtaagggaccgattcctgtagaagttattcctatggctcgttctgtggtatctaaatcattgatttgtttaggagggttacctgaatatcgtaatggagttattacagataatggtaacagtattttagatgtgtacaatatgaatataacggatgcatctttattagaacaaagaattaataatattccaggagtggtaagtgttgggctttttgctcaacgaaaagcagatattgcattaataggtactcaaaaaggaataaaaatattaaatagtaattaa

SEQ ID NO: 3070 - DNA, 657 bp, Wigglesworthia glossinidia
gtgatagaagaaaaattaaaaaaacaagctgcatgggctgcaatcaaatacattaaaccaggagatatagttggagtaggtagcggttccacagcggaatattttattgatgcgttaggatcaattaaaaacctaataaaaggtactgtatcaagttcaagaatatcttcttctaaattaaaagatttaaatattcctttatttgacttaaatgaagtaagtttattaaatatatatgtagatggagcagacgaaataaatcaaaaaaaacatatgataaaaggcaaaggggcagctttgacaagagaaaaaattattgcatctgcagcaaaaaaatttatttgtatagtagatagtagcaaattcgtacatgttttaggaagagctcctttgccaatagaagttatacctatggctagaactttagtatctaaaaaaattattgatattggaggatctccgaaatataggaaaggaataattacagaaaatggaaatgttttattagacgtacataatttaattatacttgattctttatttttagaagaaaaaattaacaatataccgggggttgtatcagtaggtctttttgctcatagagcggcagacattgctattatttcaggaaaaaatggaataaaaataatagattaa

SEQ ID NO: 3071 - DNA, 657 bp, Buchnera aphidicola
atgtttgatacgttaaaaaaatctgtagcaaaatatgcactgtcatatataaaaaaaaattctattattggaattgggtcaggatctactatagaattttttattaaagagttatatacaattttttcaaatatacaaggtgttgtagtcagttcaaaaaaatcagaaaaattattaaaaaaaattaatattccaatttatgatttaaattctatacaaaatttagatatttatatagatagtgctgatcaagtaaattcttcattagaaatgattaagggtggaggaggggctttaactcgagaaaaaattatagcttctgcagcaaaaagatttttatgtattattgataaatcaaagtatgttaatacatttaataattttccaatacccatagaagttattcctatgtcacttatgtttgtttctagagaaattctaaaaatgggtggattcgtaaaatacagaaaaaattttattactgataatggtaattatattattgatgcatataatttaaatgttatataccctactaatttagaaaaaattattaataatattcccggagtagtttctgtaggtttattttgtattcgaaaggctgatactttattaataagttattccaattatgttcgaacaataattttataa

SEQ ID NO: 3072 - DNA, 669 bp, Rickettsiella grylli
atggaaatacaaaatcttgaacgtttaaaaaaaaaactagcagaaactacattagcgtacattagccccggatccattttaggtctaggcagtggtagcaccatcaatcatctgattaccgcattagccgctattcgacataaaatcgaaggcgtcgttccagcttccttagaaactgaaaaacgattaaaagaacttcatattcctgttttagatctaaatagtgccggagaattaatgctgtatattgatagtgctgatgaagtcaatcctcatttgcaacttattaaaggaggaggaggggcattaacgcgagaaaaaattattgcttccgcaagccagaattttatgtgtattattgatgaaagtaagtatgtcggaatgcttggtcaaaaaggtttaccgcttgaagtgattccaatggcgcgtagttacgttgcgagagagatagtaaaattgggaggatttccttttcttagagataaatttattactgacaatggaaatattatattggatactcagcattgggattttactgaccctattaaacttgaacgtttactcaataatattccaggcgtagtcagtaatggattattcgcccagcgtcctgcaaataaactacttatagccaataaaaacggcatcaaaatcattgaaagttaa

SEQ ID NO: 3073 - DNA, 657 bp, Candidatus Hamiltonella defensa 5AT (Acyrthosiphon pisum)
atgactcaagatgaaatgaaaaaagccgtcagtttggtggctttaaattatgtaaaatcggacatgatagtcggaataggaacaggttcaacggtcacccactttattcatgctctaggctccatcaaagaactcgtcaaaggagccgtttccagctctgaggattccaccagaaaactcaacaatatcggtattcctgttctagataccaatgaggtagatattattgatatctacgtagacagtgctgatgaagtcaatcaccataagcagatgatcaaaggaggaggcgcggcattgactcgtgaaaaagtcatttcgagcatggcgaaaaaatttatttgtattgtggaccatacaaaaaaagtcaacatattaggtcaattccccttaccaatcgaagtgatcccaatggcgcgctcttatgtcgctcgtgagctagtaaaactaaggggattacccgaatatcgccaaggggtaatcaccgataatgcgaatattatattggatgtccgccatttaaatatggcccatcccatccatttggaaaataaaattaatgcaattgcaggggtcgtcaccgtagggctatttgcacttcggccagcagaccttgttttaattgcaacatccaatactgtcgaaatcatggagtga

SEQ ID NO: 3074 - DNA, 654 bp, Alteromonadales bacterium TW-7
atgacacaagacgaattaaaaaaagcagcagcatgggctgcactcgagtttgtaaaagaaaacacgatagtaggtgtaggcacaggctcaaccgttaatcactttattgatgcccttggcacagttaaagacactttagtaggtgcagtatcaagctctgaagcttctacagcacgtttaaaagagctcggtattgaagtgtttgagctaaacgatatcgatgtactcgatgtttacatcgacggcgcggatgaaattaacgctcaaaacgaaatgattaaaggcggtggtgctgcacttacccgtgaaaaaatagtggctgcagttgctaagcagtttgtgtgtattgttgatgacaccaaactagtagacacattgggggaatttccgcttccagttgaagttattccaatggcgcgcagctacgtagcacgtgagttattaaagttaggcggcgacccagtctaccgccaaggtgtggttaccgataacggcaacgttattttagacgtatataatttaaatattaccaatgctaagcaacttgagacagatataaatcaaattgttggcgtagttaccaatggcctatttgcgatgcgtggtgctgataaagtaattatcggcactaaaaatgggcctcaaattaaatag

SEQ ID NO: 3075 - DNA, 756 bp, Pseudoalteromonas haloplanktis
atgtgccacttaaaacaattatcaccccaaataaaacctactgttggtaaagcgttactttgtataccagcagaaatttttgacataaatgagcataaaacaatgacacaagacgaattaaaaaaagcagctgcttgggcagcgttagagtttgtaaaagagaacactattgtaggcgtaggtacaggctcaacggttaatcactttattgatgcactaggctcaataaaagacaccattaaaggtgcggtttctagttcagaagcctcaactgctcgtttaaaagcgctaggcattgaagtatttgaacttaatgacgttgatgttttagatgtatacgttgacggcgctgatgaaattaacgcccataacgaaatgattaaaggcggcggtgcagcccttactcgtgaaaaaatagtagcagcggtagctaaacaatttgtgtgcattgtagatgacaccaaattagtagcaaccttgggtggttttccactgccggttgaagttatacccatggcacgcagttacgtagcacgcgaattattaaaacttggtggtgatcctgtgtatcgccaaggtgtagttaccgataacggtaacgttattttagatgtacataatttaaatattacccaagctaaacaacttgaaacacaaattaatcaaattgttggcgtagttaccaacggcctattcgcagagcgtggcgctgataaagtgattatcggcactaaaaatgggccacaaattaaatag

SEQ ID NO: 3076 - DNA, 657 bp, Pseudoalteromonas tunicata D2
atgacacaagatgaaatgaaaaaagccgccgcgtgggctgcactcgaatacgtagaaaaagacagcattataggtgtaggcacaggctcaacagtgaaccactttattgatgcccttggcacaataaaaggtgatattcgtggtgcagtatctagctcagaagcctcaaccgaaaaattaaaagcgcttggcattgagatatttgagctcaatgatgttgatggcttaagtgtttatgttgacggtgccgatgaaattaatcccgccaatgaaatgattaaaggcggtggcgctgcactgactcgcgaaaaaattgtcgcagcagtcgctaaaaagtttgtttgtattgttgatagcagcaaacaagtagacgtattaggtaatttcccattaccggttgaagtcattcctatggcacgcagctatgttgccagagaattagttaagttaggtggtgacccaatgtatcgccaaggtgtagtcactgataacggtaatgtcatcttagatgtgtttaatctacagatcagtcaagccaaacaattagagcaacaaattaatcaaatcgtcggtgttgttaccaatggcctgttcgccgctcgtggtgcagacgttgttattgtcggcacccccgatggaccaaaaatactgaaataa

SEQ ID NO: 3077 - DNA, 657 bp, Shewanella sediminis HAW-EB3
atgacacaagatgagatgaaaaaagccgcgggttgggctgcactggaatatgtcgagaaagacagtatcgtaggtgtaggaacaggctctaccgtgaaccactttatcgatgccctggcaacgatgaaagccgatatcgatggtgcagtatcaagctctgaagcttctaccgagaagatgaaagcattagggatcccggtttacgatctcaactcagtcgacgaactatctgtctatgtcgatggcgccgatgagatcaacgctcatatggatatgatcaagggtggcggagctgcattgacacgtgaaaagatcgtcgcagcagttgcagacaagtttatctgtatcgtcgataacactaaagaggtggatgttctgggtgagttcccactgccggtagaagttatccctatggcgcgctcttatgttgctcgtcaattggtaaaacttggcggcgatcctgtctaccgtgaaggtgttgtcacagataacggcaacgttatcttagatgtgtacaacatgaagataatgaaccctaaagaacttgaagagcagatcaacgccatcgtcggtgttgtcactaacggactatttgccatgcgtggcgcagatgtactgctagtgggttctcctgaaggagttaaaacagttaaatag

SEQ ID NO: 3078 - DNA, 657 bp, Shewanella piezotolerans WP3
atgactcaagatgaaatgaaaaaagccgcaggatgggctgcattacaatatgttgaaaaagatagcattgttggtgtaggtaccggctcaaccgttaatcactttattgatgcccttgcgaccatgaaagcggacattgacggcgccgtatcaagctctgaagcttctaccgagaaaatgaaatctcttggtattccagtatatgatcttaacagtgttgatgacctgtcagtttatgttgatggcgctgacgaaattaacggccatatggatatgataaaaggtggcggtgctgcactgactcgtgaaaagatcgttgctgcagtggctgataagtttatctgtattgttgataacaccaagcaggtcgacattctaggtgagttcccactaccagttgaagttattccaatggcacgctcatatgtggcacgtcagctagttaaacttggcggcgatccggtataccgtgaaggcgtggtgacagataacggcaatattattttagatgtctacaacatgaaaatcatgaccccaaaagagcttgaagaacagatcaacgctattgttggtgtggtcaccaatggtttatttgccatgcgcggcgctgatgtgttgctagtgggtacgccagaaggtgttaagacagttaagtaa

SEQ ID NO: 3079 - DNA, 657 bp, Shewanella woodyi ATCC 51908
atgacacaagatgagatgaaaaaagccgccggttgggcagcactagaatacgttgaaaaagacagtatcgtaggtgtgggcaccggctctactgttaatcactttatcgatgccttagccacaatgaaggctgaaattgagggagcagtatccagctctgaagcctcaacccagaagatgaaagaccttgggatacctgtatttgatcttaactctgtggatgagctttctgtctatgttgatggcgccgatgagatcaacgctcatatggatatgataaaaggtggcggagccgctttaactcgtgaaaagatcgtcgctgcagtcgccgataagtttatctgtattgtcgataacactaagcaggttgatgttttaggtgaattcccactacccgttgaagttatccctatggctcgctcatatgtcgctcgccaactagttaaactcggtggtgatcccgtttatcgtgaaggcgttatcacagataatggcaacattattctggatgtctacaacatgaagatagtcaatccaaaagagcttgagcagcagatcaataagatagttggtgttgtaactaacggtctatttgcaaatcgcggcgctgatgtgctgttagtgggctcgccagatggtgttaaaacattaaagtag

SEQ ID NO: 3080 - DNA, 660 bp, Shewanella loihica PV-4
atgactcaagatgaaatgaaaaaagccgccggatgggccgcgctcgagtatgtagagaaagacagtattgtcggcgtgggtaccggctcgaccgttaaccactttatcgatgcactggccactatgaaggccgatatcgaaggcgcagtgtctagctctgaggcctcgaccgagaagatgaaggcgctggggatcccggtattcgacctgaactctgtcgatcagctctctgtctatgtcgatggcgccgacgagatcaacggccacatggacatgatcaagggtggcggagccgcgctgacccgcgagaagattgtcgccgccgtggccgacaagttcgtctgcatcgtggataacactaaggaagtcgaggtattgggcgagttcccgctgccggtagaagtgattcctatggcacgttcttacgtggcccgcgagctggtcaaattaggcggtgaccctgtctaccgtgagggcgtagtcacagataacggcaacgtgatcctggatgtctacaacatgaagatcttcaatccaaaagcgcttgaagagcagatcaatcagatcgttggtgtggtcaccaacggcctgttcgccaaccgcggcgccgacgtcctgctggtcggcacccctgaaggcgtaaagacggttaagccatag

SEQ ID NO: 3081 - DNA, 663 bp, Shewanella halifaxensis HAW-EB4
atgatgactcaagatgaaatgaaaaaagctgccggatgggctgctcttcagtacgtagaagaaaacagcattgttggcgtaggtacaggctcaacggtaaatcactttattgatgcacttgctacaatgaagttcgatatcgaaggtgcggtatcgagctctgaagcatcaacagaaaaaatgaaggccctaggtattcctgtttttgacctaaacagcgtcgacgagctatctgtctatgttgatggcgccgatgagatcaacggccatatggacatgatcaaaggcggcggtgcagcactgactcgcgaaaagatcgttgcagccgttgccgaaaagtttatctgtatcgttgataacactaagcaggttgatattttaggcgatttcccactgcctatcgaagtgatcccaatggcacgttcgtacgtggctcgccagattgttaagcttggcggcgaccctgtttaccgtgaaggttgtgtaaccgataacggcaacatcatcttagatgtgtacaacatgaagatcatgaatccgaaagcgttagaagagcagatcaacggtatcgtgggtgtggtaactaacggcctgttcgccatgcgcggcgcagacgtgttgttagttggtactcctgacggcgttaaaacaattacttattaa

SEQ ID NO: 3082 - DNA, 660 bp, Shewanella pealeana ATCC 700345
atgactcaagatgaaatgaaaaaagctgccggttgggctgcgcttcagtacgtagaagaaaacagcattgttggtgtaggtaccggctcaacggtcaatcactttattgatgcactagcgacaatgaagttcgatatcgaaggtgcagtatcaagctctgaagcgtcaacagagaaaatgaaggcgttaggtattcccgtttttgacctaaacagcgtcaatgagttatctgtttatgttgatggcgccgacgaaatcaacagccaaatggacatgattaaaggtggcggagcagcgctgactcgcgagaaaatcgttgccgcagttgcagataagtttatctgtatcgttgataacaccaagcaagtcgacattttaggtgagttcccactgccaatcgaagtgatcccaatggcacgttcatacgtggcgcgccagattgttaagctgggcggagatcctgtttaccgcgaaggctgtgttaccgataacggcaacatcattatcgacgtgtacaacatgaagatcatgaagccaaaagagctagaacagcagattgacggcattgttggtgtagtgactaacggcctattcgctaagcgcggcgctgatattttattagttggcacacctgaaggcgtgaagacagttaccttttaa

SEQ ID NO: 3083 - DNA, 657 bp, Shewanella benthica
atgacacaagatgagatgaagaaagccgctggttgggctgcgctacagtacgttgaaaaagatactatagttggcgtcggcacaggctctaccgttaatcactttatcgatgctctcgcgaccatgaaggccgatatcgaaggggctgtttctagctctgcagcgtctaccgaaaagatgaaagcactgggtattccggtctacgatctcaattctgtcaatgagctttctgtgtatgtcgatggtgccgatgagatcaacgaacgcatggacatgatcaagggcggcggcgccgcgctgactcgtgagaagatcatcgcagccgtagccgaaaagtttatctgtatcgtagataacactaagcaggtcgctatcttaggcgagtttccactgccagtagaagtgatccctatggctcgctcatacgtggcacgccaactggtcaagctaggcggcgatccggtttaccgtgaaggttgtctcaccgacaacggcaacatcatcttagatgtgtacaacatgaagatcatgaagccaaaagagctcgaagagcagatcaatcaaatcgtcggcgtagtgactaacggtttgttcgctaaccgcggtgcagatgtcttgttagtgggtacaccagaaggggttaaaacggttaagtag

SEQ ID NO: 3084 - DNA, 663 bp, Shewanella sp. W3-18-1
atgactcaagatgaaatgaaaaaagctgctggttgggccgcgcttaagtacgttgaagaaggcagtattgtcggtgtaggtacaggttcgactgtaaaccactttattgatgcactcgctaccatgaaagatgatatcgaaggtgcggtttcaagctcggaagcatccactcagaaaatgaaagcgctaggaattcccgtttatgacttaaacagcgtcgatcgtttatctgtctatgtagacggtgccgatgaaatcaacgatcgtatggatatgatcaaaggtggtggcgcagcattaactcgcgagaaaattgtcgcggctgtagctgagaagtttatctgcatcgttgataacactaaacaagtcaacatattaggtgaatttccgctacccgtagaagtcattccaatggctcgctcttatgtcgctcgccaattggtaaaattgggtggagatcctgtttatcgccaaggtgttgtgaccgataacggcaacgtaatcctcgatgtgtataatcttaaaatccttaatccaaaagaattagaaagtcagatcaatgagatagtcggtgtagtgactaacggtctgtttgccaaacgcggtgcggatgtgttactcgttggcacccctgatggcgtaaaaacgtttactaccaaataa

SEQ ID NO: 3085 - DNA, 663 bp, Shewanella putrefaciens
atgactcaagatgaaatgaaaaaagctgctggttgggccgcgctgaagtacgttgaagaaggcagtattgtcggtgtaggtacaggttcgactgtaaaccactttattgatgcactcgctaccatgaaagatgatatcgaaggtgcggtttcaagctcggaagcatccactcagaaaatgaaagcgctaggaattcccgtttatgacttaaacagcgtcgatcgtttatctgtctatgtagacggtgccgatgaaatcaacgaccgcatggatatgattaaaggtggcggcgcggcattaactcgcgagaaaattgtcgcggctgtagctgagaagtttatctgcatcgttgataacactaaacaagtcaacatattaggtgaatttccgctacccgtagaagtcattccaatggctcgctcttatgtcgcgcgccaattggtaaaattgggtggagatcctgtttatcgtcaaggtgttgtcactgataacggcaacgtgatcctcgacgtgtataatcttaaaatccttaatccaaaagaattagaaagtcagatcaatgagatagtcggtgtagtgactaacggtctgtttgccaaacgcggtgcggatgtgttactcgttggcacccctgatggcgtaaaaacctttaccgccaaataa

SEQ ID NO: 3086 - DNA, 663 bp, Shewanella putrefaciens
atgactcaagatgaaatgaaaaaagctgctggttgggccgcgcttaagtacgttgaagaaggcagtattgtcggtgttggtacaggttcgactgtaaaccactttattgatgcactcgctaccatgaaagatgatatcgaaggtgcggtttcaagctcggaagcatccactcagaaaatgaaagcgctaggaattcccgtttatgacttaaacagcgtcgatcgtttatctgtctatgtagacggtgccgatgaaatcaacgatcgtatggatatgatcaaaggtggtggcgcagcattaactcgcgagaaaattgtcgcggctgtagctgagaagtttatctgcatcgttgataacactaaacaagtcaacatattaggtgaatttccgctacccgtagaagtcattccaatggcacgctcttatgtagcgcgtcaacttgttaaacttggcggcgatcctgtgtaccgtgaaggcgttgttaccgataacggcaacgtgatcctcgatgtgtacaatcttaagatccttaatccaaaagaattagaaagtcagatcaatgagatagtcggtgtagtgactaacggtctgtttgccaaacgcggtgcggatgtgttactcgttggcacccctgatggcgtaaaaacgtttactgccaaataa

SEQ ID NO: 3087 - DNA, 663 bp, Shewanella baltica OS155
atgactcaagatgaaatgaaaaaagctgccggttgggccgcactcaagtacgttgaaagagacagtattgttggtgttggtactggttcgactgtgaatcactttattgatgcactggcgaccatgaaagctgatatcgaaggcgcagtctctagttctgaggcatcaactcagaaaatgaaagcgctgggtattcccgtttatgacttaaacagcgtcgatcgtttatctgtctatgtggacggtgccgatgaaatcaacgaccgtatggatatgatcaaagggggcggcgcggcgttaactcgcgagaaaattgttgcggctgtggctgaaaaatttatctgtatcgtggataacactaagcaagtcgacatcctaggggaattcccactgccagttgaagtcattcctatggcgcgctcttatgtggcacgtcagttagttaagctaggcggcgatcctgtgtaccgtgaaggcgttgtgaccgataacggcaacgtgatcctcgatgtgtacaatcttaagatccttaatccaaaagaattggaaagtcagatcaatgagatagtcggtgtcgtcactaacggtctgttcgctaaacgcggcgcagatgtgttgttagtcggtacacctgatggcgtaaaaacctttaccgccgaataa

SEQ ID NO: 3088 - DNA, 663 bp, Shewanella baltica OS185
atgactcaagatgaaatgaaaaaagctgccggttgggccgcgctcaagtacgttgaaaaagacagcattgttggtgttggtacgggttcgactgtgaatcactttattgatgcactggcgaccatgaaagctgatatcgaaggcgcagtctctagctctgaggcatcaactcagaaaatgaaagcgctgggtattcccgtttatgacttaaacagcgttgatcgtttatctgtctatgtggacggtgccgatgaaatcaacgaccatatggatatgatcaaaggcggcggcgcggcgttaactcgtgagaaaattgtcgcggctgtggctgaaaagtttatctgtatcgttgataacactaagcaagtcgacatcctaggtgaattcccactgccagttgaagtcattcctatggcgcgctcttatgtggcacgtcagttagttaagctaggcggcgatcctgtgtaccgtgaaggcgttgtgaccgataacggcaacgtgatcctcgatgtgtacaatcttaagatccttaatccaaaagaattggaaagtcagatcaatgagatagtcggcgttgtcactaacggtctgttcgctaaacgcggcgcagatgtgttactcgttggcacccctgatggcgtaaaaacctttaccgccaaataa

SEQ ID NO: 3089 - DNA, 660 bp, Shewanella sp. ANA-3
atgactcaagatgaaatgaaaaaagccgctggctgggctgctctcaaatacgttgagaaagacagcattgtgggtgtaggcacaggctcaaccgtcaatcactttatcgatgccctcgccaccatgaaggccgatattgaaggtgcggtatcaagctcagaagcctcaacccaaaagatgaaagcccttggcatcccagtttatgacttaaacagcgtcgataaattatctgtgtatgtcgatggtgccgatgaaatcaacggccatatggacatgatcaaaggcggcggcgcggcattaacccgcgagaaaatcgttgcggctgtggctgaaaagtttgtctgtatcgtggataacactaaacaagtggatattttgggtaaattcccactgcccgttgaagtgatcccaatggcgcgctcttacgtggcccgtgaactggtcaaactcggcggcgaccctgtgtaccgtgaaggcgttgtcacggataacggcaacgtgatcctcgacgtttacaaccttaagatcatcaatcctaaggaattagaagagaagatcaacgccatcgtcggcgtagtcaccaacggcctgttcgcaaaacgcggcgccgatgtgttattggttggcacccctgaaggtgtaaaaacctttaccgcttaa

SEQ ID NO: 3090 - DNA, 660 bp, Shewanella sp. MR-4
atgactcaagatgaaatgaaaaaagccgctggctgggctgctctcaaatacgttgagaaagacagcattgtgggtgtaggcactggctcaaccgtcaatcactttatcgatgccctcgccaccatgaaggccgatattgaaggtgcggtatcaagctcagaagcctcaacccaaaaaatgaaagcccttggcatcccagtttatgacttaaacagcgtcgataaattatctgtgtatgtcgatggtgccgatgaaatcaacggccatatggacatgatcaaaggcggcggcgcggcattaacccgcgagaaaatcgttgcggctgtggctgaaaagtttgtctgtatcgtggataacactaaacaagtggatattttgggtgaattcccactgcccgttgaagtgatcccaatggcgcgttcttacgtggcccgtgaactcgtcaaactcggcggcgacccagtgtaccgtgaaggcgttgtgactgataacggcaacgtaatcctcgacgtttacaaccttaagatcatcaatcctaaggaattagaagagaagatcaacgccatcgtcggcgtagtgactaacggtttgttcgcgaaacgcggcgccgatgtgttactggttggcacccctgaaggcgtgaaaacctttaccgcttaa

SEQ ID NO: 3091 - DNA, 660 bp, Shewanella oneidensis MR-1
atgactcaagatgaaatgaaaaaagctgcgggctgggctgcactcaaatacgttgagaaggacagcattgtgggtgtgggcacaggctcaaccgttaaccactttatcgatgctttggcgaccatgaaggctgatattgaaggcgcagtatcaagctctgaagcttcaacgcaaaaaatgaaggcccttggcatcccggtttatgacttaaacagcgtcgataaattatctgtctatgtcgatggtgccgatgaaatcaacggccacatggacatgatcaaaggtggtggcgcggcattaacccgcgaaaaaatcgttgcagctgtggctgaaaagtttgtctgtatcgtggataacactaagcaagtagatatcttgggtgaatttccactgcccgttgaagtgatcccgatggcgcgctcttacgtggctcgccaactggtaaaactgggtggtgatcctgtttaccgcgaaggcgttatcactgataacggtaatgtgatcctcgatgtttacaatcttaagatcctcaatccgaaagaattagaagataagatcaatgccattgtgggtgtggtcactaatggtctgttcgcaaaacgcggcgccgatgtgttactggttggtacccctgaaggcgttaaaacctttaccgcttga

SEQ ID NO: 3092 - DNA, 660 bp, Shewanella amazonensis SB2B
atgactcaagacgaaatgaaaaaggccgccgcctgggctgcactcaaatacgtagaaaaagacagtattgttggcgtgggcacaggctctactgtgaaccactttatcgacgcactgggcaccatcaaggcggatatcgaaggcgctgtgtcgtcttctgaggcctccaccgccaagctcaaggcgttgggcattccggtttacgacttaaacagtgtcgacagactgtctgtttatgtggacggagcggatgaaatcaacggccagatggacatgatcaagggcggcggcgcggccctcacccgtgaaaaaattgtcgctgccgtggccgataaatttatctgtatcgtggacaacaccaaagaagtggccatcctaggtgagtttccgctgccggttgaagtcatccccatggcccgctcctacgtggcccgtgagctggtcaaactgggcggtgaccctgtgtaccgcgaaggcgttgttaccgacaacggcaacgttattctggatgtgcacaacatgaagatcatggaacccaagaagctcgaagcacaaatcaacggcatcgtgggtgtggttaccaatggcctgttcgcccaccgcggcgctgatgtgctcttggtcggcacccccgatggcgtaaaaacggttaccgcctga

SEQ ID NO: 3093 - DNA, 660 bp, Shewanella denitrificans OS217
atgacacaagatgaaatgaaaaaagccgccggttgggctgcacttaaatacgttgaagtagacagcatagttggcgttggcactggctcaacggttaatcatttcatcgatgcattagccacaatgaagcacaatatcaagggtgcggtatcgagctccgtcgcttccactgagaaaatgaaagccttaggcattgatgtgtttgacttaaatgaagtgtctgaactatcgatttatgtggatggtgccgatgaaatcaatgcccatatggacatgatcaaaggcggcggcgcagcccttacccgtgaaaaaatcgtcgccgcagtggccgataaatttatttgcatcgtggacaataccaagcaagtcgacgtgttaggtcagttccccttaccggttgaagtcattcctatggcgcgctcttatgttgctcgtgagctggtaaaattgggcggcgatcccgtctatcgtcaaggggtcatcacagacaatggcaatgtgattttagacgtatacaaccttaaaatattgaaccctaaggcgttagaaactcaaatcaatgccatcgtaggcgtagtcaccaatggtctgttcgccaatcgcggcgctgatatactgttaatgggtacccctgatggcgtaaagacatcaacaaactag

SEQ ID NO: 3094 - DNA, 660 bp, Shewanella frigidimarina
atgacacaagatgaaatgaaaaaagcagcaggttgggcagcactgcagtatgtcaaaaaagacaccatcgtcggtgtaggtacaggctctacagttaatcactttattgatgcacttgccaccatgaaagatgatattgaaggtgcggtatcaagctctgaagcatcaactaaaaaactcattgaacttggcattgaagtatttgatttaaacagtgttgatttgatagatgtctatgttgatggcgcggacgagattaacgaccgcatggacatgattaaaggcggcggagctgcattaactcgcgaaaaaattgtcgcggcggtagcaaaacggtttatttgtattgtagataataccaaacaagtgccaattttaggtgagtttccattgcctgttgaagtcatcccgatggcacgatcttatgtggcacgtgagttggtaaaattaggtggagatccagtttaccgtcaaggcgtaataaccgataacggcaacgttattttagatgtctacaatatgaaaattctagaccctaaagtgatggaaactaaaatcaacgccatcgtcggtgttgtgacaaatggtttatttgcgaaccgcggtgccgatgtactactcgtaggcacccctgatggcgttaacaccatcacactctaa

SEQ ID NO: 3095 - DNA, 660 bp, Photobacterium sp. SKA34
atgacacaagatgaaatgaaaaaagcagcaggttgggcagcacttgaatacgtacagaaaggaacaattgtaggtgtaggtactggctctacggttaatcacttcatcgatgccttagcaactcgcaaagaagaaattaaaggtgctgtttcaagttcagtcgcttcaactgaacgtcttgaacaactaggcattactgtatttgatgcgaatgaagttgcttcacttgatatttatgtcgatggtgctgatgaaattaacgcagactacgacatgattaaaggcggtggtgcggcgcttactcgtgaaaaaatcgtggcagccatcgcgaaaaaatttatctgtatcgttgatgacaccaagcaagttgacgtattgggccaattcccgcttccagttgaagtaatccctatggggcgctctttcattggtcgtgagttggtaaaacttggtggcgatccggcttaccgtgaaggcgttgtgaccgataacggtaatatgatccttgatgtctacaacatgaagatcacagatcctaaaacaatggaagataagatcaacgccctacctggtgtggtaactgttggtctatttgctcaccgtggcgctgatgtattattggttggctcacctgacggtgtaaaaaaattcgagaaataa

SEQ ID NO: 3096 - DNA, 660 bp, Photobacterium angustum
atgacacaagatgaaatgaaaaaagcagcaggttgggcagcacttgaatacgtacagaaaggaacaattgtaggtgtaggtactggctctacggttaatcacttcatcgatgccttagcaactcgcaaagaagaaattaaaggtgctgtttcaagttcagtcgcttcaactgaacgtctagaacaacttggcattactgtatttgatgcaaatgaagttgcttcacttgatatttatgtcgatggtgcagatgaaattaacgctgattacgacatgattaaaggcggtggtgctgcgcttactcgtgaaaaaattgtcgccgcaattgcgaaaaaatttatctgtatcgttgatgacaccaagcaagttgacgtattgggtcaattcccgcttccagttgaagtgatccctatggggcgctctttcattggccgtgagttagtaaaacttggtggcgatccagcctaccgtgaaggcgttgtgaccgataacggtaatatgatccttgatgtctacaacatgaagatcaccgatcctaaagcaatggaagataagatcaacgccctaccaggtgttgtaactgttggtctatttgctcaccgtggcgctgatgtattattggttggctcacctgacggtgtaaaaaaattcgagaaataa

SEQ ID NO: 3097 - DNA, 660 bp, Photobacterium profundum SS9
atgacacaagatgaaatgaagaaagctgctggctgggctgcactggaatacgtgactaaaggtagcattgtgggtgtgggtacaggctcaactgtcaatcacttcatcgatgcactagaaacacgtaaagaagaaattaaaggtgctgtttcaagttctgttgcttctactgaacgtctagaaaaactgggcattcctgtatttgaagcaaacgaagtcgctgggttagatatctatgtcgatggcgctgatgaaatcaacgctgaatacgacatgatcaaaggtggcggtgccgctttaacgcgtgaaaaaatcgtagccgctatttctgataagttcatttgtattgttgatgacaccaaacaagttgatgttttaggtcagttcccattaccggttgaagtcatcccaatggcacgttctttcatcggtcgcgaacttgttaagcttggcggtgatcctgaataccgtgaaggtgtggttactgataacggtaatatcatcattgatgtgcacaacatggctatcactgatgcaaaagacatggaaaagaaaatcaatgccctacctggcgttgtgactgtgggtctatttgctgcccgtggcgctgatgttctattggtcggtgcacctgaaggcgtaagaaaattcgagaaataa

SEQ ID NO: 3098 - DNA, 660 bp, Photobacterium profundum 3TCK
atgacacaagatgaaatgaagaaagctgctggctgggctgcactggaatacgtgactaaaggtagcattgtgggtgtgggtacaggctcaactgttaatcacttcatcgatgcactagaaacacgtaaagaagaaatcaaaggtgctgtttcaagttctgttgcttctactgaacgtctagaaaaactgggcattactgtatttgatgcaaacgaagttgctgggttagatatctatgtcgatggcgctgatgaaatcaacgctgaatacgacatgatcaaaggtggcggtgccgctttaacgcgtgaaaaaatcgtggcagccatttctgataagttcatttgtattgttgatgacactaaacaagttgatgttttaggtcagttcccattaccagttgaagtcattccaatggcacgttctttcatcggtcgcgagcttgtaaagcttggcggtgaccctgaataccgtcaaggtgtggtcactgataatggcaatatcatcattgatgtacacaacatggctatcactgatgcaaaagacattgaaaagaaaatcaatgccctaccaggcgttgtgactgttggtctatttgctgcccgtggcgctgacgttctattggttggtgcacctgaaggtgtaagaaaatttgagaaataa

SEQ ID NO: 3099 - DNA, 660 bp, Photobacterium damselae subsp. damselae CIP 102761
atgacacaagatgaaatgaaaaaagctgctggctgggctgcactggaatacgttaagaaaggcagcattgtcggtgtaggtacaggctcaaccgtcaatcacttcatcgatgctcttgccactcgtaaagaagaaattaaaggtgctgtatcaagttcagttgcatcaaccgagcgccttaaacaaattggaattccagtatttgatgcaaatgaagttgcaagcctagatatctatgttgatggtgccgatgaaatcaatggcgaatttgacatgattaagggcggtggcgcagcgttaactcgtgagaagatcgtagcagccattgcgaaaacatatgtatgtatcgtagataacaccaaggaagtagacgtacttggtcagtttcccctaccagtagaagtaatcccaatggctcgctcttatgttgcgcgcgaattggtaaaactaggtggtgatccagtttaccgtcaaggtgttacaaccgataacggtaacattattcttgatgttcataatatgcaaattaccaatccaaaagcgatggaagatgcaattaatggtattgcaggtgtagtaactgtcggtttatttgctcatcgtggtgctgatatcttattagtaggcgcacctgacggtgtaaaaaaagtagaaaaataa

SEQ ID NO: 3100 - DNA, 657 bp, Aliivibrio salmonicida LFI1238
atgactcaagacgagatgaaaaaagcagccggttgggcagcgttagaatacgtagaagttggcagcattgttggtgtaggtacaggatcaacagtaaatcatttcatcgacgcacttgcgacaatgaaagatgacattaaaggtgcggtatcaagttcagttgcttcaacagaaaaactaaaagaactcggtattgaagtttttgattgtaacgatgttgctggtcttgatgtttatgtcgatggcgcggatgaaatcaatggtctgaacgagatgattaaaggtggtggtgcagcccttactcgtgaaaaaatcgttgctgcaatttctgataagtttatttgtattgttgataacacaaaacaagtcgacatattaggtgagtttcctcttcctgttgaagtcattccaatggcacgctcttatgttgctcgtgaactggttaagttaggtggtgatcctgcctaccgtgaaggcgttgttactgataatggtaatatgatcttagacgttcacaacatgaaaatcaccaatgcgaaagagcttgaagataaaattaatgcccttcctggtgttgtgacggttggtttatttgctcaccgtggcgccgatgttttattggttggcgctcctgatggcgtaaaaaaattcgtttaa

SEQ ID NO: 3101 - DNA, 657 bp, Vibrio fischeri
atgactcaagacgagatgaaaaaagcagctggttgggcagcgttagaatacgtagaagctggcagcattgttggtgtgggtacaggttcaaccgtaaaccatttcatcgacgcacttgcgaccatgaagaatgaaattaaaggcgcagtatcaagctcagtagcttcaacagagaagttaaaagaactgggtattgaagtttttgattgtaatgatgttgcaggccttgatgtttatgttgatggtgccgacgaaattaacggcaagaatgaaatgattaaaggcggcggcgctgctcttactcgtgaaaaaatcgttgctgcaatttctgataaatttatctgtattgttgatgacacaaagcaagttgatgttttaggtcaattcccacttcctgttgaagttattccaatggctcgctcttatgttgctcgtgagttagttaaattaggtggcgatcctgcataccgtgaaggcgtaattaccgataatggtaatgtgatccttgatgttcacggtatgaaaattacagatgcaaaagatctagaagataaaatcaatgctcttccaggcgtagtaactgtaggtttatttgcacaccgcggtgcagatgtcctattagtaggggctccagaaggcgttaagaagttcgactaa

SEQ ID NO: 3102 - DNA, 654 bp, Grimontia hollisae CIP 101886
atgactcaggatgaaatgaaaaaggcggctggctgggctgcgctggaatacgtgaccaaaggcagtattgttggtgtcggcacggggtcaaccgttaatcacttcatcgatgcgcttgaaaccattaaagagcaaatcaaaggtgcggtgtcgagctcagtggcatcaaccgagcgccttgagaaaattggcatcccggtgtttgatgccaatgaggtagacagcttagatatctatgttgatggcgcagatgagatcaacccaaacaatgaaatgatcaaaggcggcggcgcagccctgacccgcgagaagatcgttgccgcgatcgccaagcagttcatttgcattattgatgacagcaaaaaagtggatgtactgggccagttccccctgccggtagaggtgatcccaatggcacgctcttatgtagcccgcgaactggtgaaactgggcggcgatccttgttatcgtgaaggctgtattaccgacaatggcaacgtcattctggacgttcacaacctgaaaatcaccaatgcgaaagagttggaagacaagatcaatgcgatcccgggtgttgtcactgtgggcctgtttgctaaccgtggtgcagatgtggtgctggaaggcacggcaaacggtgtcgtaaaaagctaa

SEQ ID NO: 3103 - DNA, 663 bp, Vibrio vulnificus; identical to SEQ ID NO: 2110

SEQ ID NO: 3104 - DNA, 663 bp, Vibrio vulnificus
atgagcatgactcaagatgaaatgaaaaaagccgctggttgggcagcgctcaaatatgtggaaaaaggcagcattgttggcgtaggaacaggctcaacggttaatcacttcatcgatgctcttggaaccatgagtgaagagatcaaaggtgcggtatccagctctgttgcatcaacagagaaacttgaagcgctaggtattaaaattttcgactgcaatgaagtcgcatctttagacatttatgttgatggcgcggacgaaatcaacgccgatcgtgaaatgatcaaaggcggtggcgcggcgctcactcgcgagaagatcgttgcggcgattgcggacaagtttatctgtatcgttgatggcacaaaggctgtcgatgttcttgggactttccctcttcctgttgaagtcatcccaatggctcgctcatacgttgcgcgtcaattggttaaactgggtggtgatccttgttaccgcgaaggggtgattactgacaacggtaacgtcatccttgatgtttacggtatgaagatcaccaatccaaaacagctggaagatcagatcaacggcatcccaggtgtcgtcactgtcggcctatttgctcatcgcggtgctgacgtggtcattaccggcactccagaaggcgccaaaattgaggaataa

SEQ ID NO: 3105 - DNA, 663 bp, Vibrio vulnificus; identical to SEQ ID NO: 3104

SEQ ID NO: 3106 - DNA, 663 bp, Vibrio parahaemolyticus
atgagcatgactcaagatgaaatgaaaaaagaagcaggttgggccgcactaaaatatgtcgaaaaaggcagcattgtaggtgtgggtactggctcaacggtcaatcacttcatcgacgctctaggtacgatcaaagaagagatcaaaggtgcagtgtctagctcagaagcctctacccagcgtcttaaagagctggaaatcgaagttttcgattgtaacgaagtggcaggtctggatatttacgtagacggtgctgacgaaatcaacgcaaaccgcgaaatgattaaaggcggcggtgcagccctaacacgcgaaaaaatcgtggcggcaatctcagacaagttcatctgtattgttgatgacactaaagccgtggatgtgctgggtgaatttccactgccagttgaagtcatcccgatggctcgctcgtacgttgctcgtgagctcgtaaaattgggtggcgatcctgcttatcgtgaaggctgtatcactgacaacggcaacgtgattttggatgtgtacggtatgcaaatcactaaccctaaagaacttgaagacaagatcaatgcacttccaggtgtggtaacggttggtctttttgctcaccgtggtgctgatgttgtcattacaggcacccaacaaggtgcaaaaatcgaagagtaa

SEQ ID NO: 3107 - DNA, 657 bp, Vibrio orientalis
atgactcaagatgaaatgaagaaagaagctggctgggctgcacttaagtatgtcgaaaaaggcagtattgttggtgtaggtaccggttcaacagtgaatcacttcatcgatgcattaggcactatgaaagaggaaatcaaaggtgcggtatcaagttccgttgcttcaaccgagcgcttaaaagagctagaaatcgaagtctttgattgtaacgaagttgcgggtctagatatctatgttgatggcgctgatgaaatcaacgctgaccgcgagatgattaaaggtggcggcgcagcgctaacgcgtgaaaagattgttgccgcaatctctgacaagtttatctgtatcgttgacaacaccaaagctgttgacgtacttggtgagttcccactccctgttgaagtaatcccaatggcacgctcttacgttgcacgcgagttggtgaaacttggcggtgacccagcttaccgtgaaggcgtgacaacggataacggcaatgtaatcttagatgtttacggtctaaaaattacgaaccctaaagatctagaaaacaagattaacgcactaccaggcgtagtaacagttggcctatttgcacaccgtggtgcagacgtcgttatcactggtacaccagaaggtgcaaaaatcgaagagtga

SEQ ID NO: 3108 - DNA, 657 bp, Vibrio sp. MED222
atgactcaagatgaaatgaaaaaagcagcgggctgggcagcacttcaatatgttgaagaaggcagcattgtaggtgtaggtactggctcaacagtaaatcacttcatcgacgcacttggcacaatgaaagacaaaatcaagggtgcggtttcaagctctgtagcctctactgaaaaactagaagcgctagaaatcaaagtattcgaatgcaacgacgtattcaagctagacatctatgttgatggcgctgacgagattaacggttctcgcgatatgatcaaaggcggcggcgctgctttgactcgtgaaaaaatcgtagcagctatctctgataagtttatttgtatcgttgatggtaccaaagcagttgatgtgttgggtaaattcccactgcctgttgaagttatcccaatggcacgctcatacgttgctcgtgaattagtaaaacttggtggtgacccagtttaccgcgaaggctgcacaaccgataacggcaacgtgatcctagatgtgtacggcatggcgatcgaaaacccaaaacagctagaagatatcatcaatggtatcgctggtgtggtaacggttggtctgttcgctcaccgtggtgctgatgtagttatcactggcacgcctgaaggtgcaaaaatcgaagaataa

SEQ ID NO: 3109 - DNA, 657 bp, Vibrio splendidus
atgactcaagatgaaatgaaaaaagcagcgggctgggcagcacttcaatatgttgaagaaggcagcattgtaggtgtaggtactggctcaacagtaaatcacttcatcgacgcacttggcacaatgaaagacaaaatcaagggtgcggtttcaagctctatagcctctactgaaaaactagaagcgctagaaatcaaagtattcgaatgcaacgacgtattcaagctagacatctatgttgatggcgctgacgagattaacggttctcgcgatatgatcaaaggcggcggcgctgctttgactcgtgaaaaaatcgtagcagctatctctgataagtttatttgtatcgttgatggtaccaaagcagttgatgtgttgggtaaattcccactgcctgttgaagttatcccaatggcacgttcatacgtagctcgtgaactcgtaaaacttggtggtgacccagtttaccgcgaaggctgtacaaccgataacggcaacgtgatcctcgatgtgtacggcatggcgatcgaaaatccaaaacagctagaagatatcatcaatggcatcgctggtgtggtaacggttggtctgttcgctcaccgtggtgctgatgtagttatcactggcacgcctgaaggtgcaaaaatcgaagaataa

SEQ ID NO: 3110 - DNA, 657 bp, Vibrio splendidus
atgactcaagatgaaatgaaaaaagcagctggctgggcagcacttcaatatgttgaagaaggcagcattgtaggtgtaggtactggctctacagtaaatcacttcatcgacgcactaggcacaatgaaagaaaaaatcaaaggtgcggtttcaagctctgtagcctctactgaaaaactagaagcgctagaaatcaaagtatttgagtgtaatgacgtattcaagttagacatctatgttgatggcgcagatgagatcaacgcttcacgcgacatgatcaaaggcggcggtgctgctttgactcgtgaaaaaatcgtagcggctatctctgataagtttatttgtattgttgacggtactaaagccgttgatgtgttgggtaaatttccactgcctgttgaagttatcccaatggcacgttcatatgttgcacgtgaactagtaaagcttggtggtgacccagtttaccgcgaaggttgcacaaccgataatggcaacatgatcctagatgtatacggcatggcgatcgaaaacccgaaacaattagaagatatcatcaacggtatcgctggtgtggttacggttggtctatttgctcaccgtggtgctgatgtggttatcacaggcacacctgaaggtgcaaaaattgaagaataa

SEQ ID NO: 3111 - DNA, 657 bp, Vibrionales bacterium SWAT-3
atgactcaagatgaaatgaaaaaagcagcgggctgggcagcacttaaatatgttgaagaaggcagcattgtaggtgttggtactggctctacagtaaatcacttcatcgacgcactgggcacaatgaaagacaaaatcaaaggtgcagtttcaagctctgttgcttcaacgcaacgcctagaagagctagagatcaaagtgtatgagtgtaatgatgttgctaagctagacatctatgttgatggcgcagacgagatcaacccaactcgcgatatgatcaagggcggcggtgcagctctaactcgtgaaaaaatcgtagcggctatctctgataaatttgtatgtattgttgatggcacgaaagctgttgatgtactgggtaaattccctctaccggtagaagttatcccaatggcgcgttcatacgttgcgcgtgagctagttaagcttggtggtgacccggtttaccgtgaaggttgtacaacggataacggcaacgtgatcctagatgtttacggcatggctattgaaaacccgaaacagctagaagacatcatcaatggtattgctggtgtggtaacggttggcctattcgcacaccgtggtgcagatgtggttatcacagtacccctgaagtgcaaaatcgaagataaataa

SEQ ID NO: 3112 - DNA, 657 bp, Vibrio cholerae
atgactcaagatgaaatgaaaaaagccgccggttgggctgctctgaaatacgtagaaaaaggcagcattgtcggtgttggtacgggctcaaccgttaatcacttcatcgatgctttaggcactatcaaagacgaaatcaaaggcgcggtttcgagctcaattgcttcgactgcgaaactggaagcactcggcatccgtgtttatgactgtaacgatgtatcggagctggacatctatgtcgatggtgctgatgagatcaacccagaacgcgacatgatcaaaggtggcggtgcagcactgacgcgtgaaaaaatcgtcgcagcgattgccaaaaaatttgtgtgtattgtcgatggcactaaagcggtcgatgttctaggcaacttccctctgcctgttgaagtgatcccaatggcgcgctcttatgtcgcgcgcgaactggtaaaactcggcggcgatcctgtgtatcgtgaaggtgtgatcaccgataacggtaacgttattctggatgtctacaacatgaagatcacccatcccaaagatctcgaaagcaagatcaacggcatcgcaggggttgtgaccgtgggtctctttgctcatcgcggggctgatgtggtcatcactggcacaccacaaggtgcaaaaatcgaagagtaa

SEQ ID NO: 3113 - DNA, 657 bp, Vibrio cholerae
atgactcaagatgaaatgaaaaaagccgccggttgggctgctctgaaatacgtagaaaaaggcagcattgtcggtgttggtacgggctcaaccgttaatcacttcatcgatgctttaggcactatcaaagacgaaatcaaaggcgcggtttcgagctcaattgcttcgactgcgaaactggaagcactcggcatccgtgtttatgactgtaacgatgtatcggagctggacatctatgtcgatggtgctgatgagatcaacccagaacgcgacatgatcaaaggtggcggtgcagcactgacgcgtgaaaaaatcgtcgcagcgattgccaaaaaatttgtgtgtattgtcgatggcactaaagcggtcgatgttctaggcaacttccctctgcctgttgaagtgatcccaatggcgcgctcttatatcgcgcgcgaactggtaaaactcggcggcgatcctgtgtatcgtgaaggtgtgatcaccgataacggtaacgttattctggatgtctacaacatgaagatcactcatcccaaagatctcgaaagcaagatcaacggcatcgcaggggttgtgaccgtgggtctctttgctcatcgcggggctgatgtggtcatcactggcactccacaaggtgcaaaaatcgaagagtaa

SEQ ID NO: 3114 - DNA, 657 bp, Vibrio cholerae
atgactcaagatgaaatgaaaaaagccgccggttgggctgctctgaaatacgtagaaaaaggcagcattgtcggtgttggtacgggctcaaccgttaatcacttcatcgatgctttaggcactatcaaagacgaaatcaaaggcgcggtttcgagctcaattgcttctactgcgaaactggaagcgctcggcatccgtgtttatgactgtaacgatgtatcggagctggacatctatgtcgatggtgctgatgagatcaacccagaacgcgacatgatcaaaggtggcggtgcagcgctgacgcgtgaaaagatcgtcgctgcgattgctaagaaatttgtgtgtattgtcgatggcactaaagcggtcgatgttctaggcaacttccctctgcctgttgaagtgatcccaatggcgcgttcttatgtcgcgcgcgaactggtaaaactcggtggcgatcctgtgtatcgtgaaggtgtgatcaccgataacggtaacgttattctggatgtctacaacatgaagatcacccatcccaaagatctcgaaagcaagatcaactgcatcgcaggggttgtgaccgtgggtctctttgctcatcgcggggctgatgtggtcatcactggcacaccacaaggtgcaaaaatcgaagagtaa

SEQ ID NO: 3115 - DNA, 657 bp, Vibrio cholerae
atgactcaagatgaaatgaaaaaagccgccggttgggctgctctgaaatacgtagaaaaaggcagcattgtcggtgttggtacgggctcaaccgttaatcacttcatcgatgctttaggcactatcaaagacgaaatcaaaggcgcggtttcgagctcaattgcttcgactgcgaaactggaagcactcggcatccgtgtttatgactgtaacgatgtatcggagctggacatctatgtcgatggtgctgatgagatcaacccagaacgcgacatgatcaaaggtggcggtgcagcactgacgcgtgaaaaaatcgtcgcagcgattgccaaaaaatttgtgtgtattgtcgatggcactaaagcggtcgatgttctaggcaacttccctctgcctgttgaagtgatcccaatggcgcgctcttatgtcgcgcgcgaactggtaaaactcggtggcgatcctgtgtatcgcgaaggcgtgatcactgataacggcaacgtgatcctcgatgtgcacaacatgaaaatcacccatccgaaagatctggaaactaagatcaacggcatcgcaggggttgtgaccgtgggtctctttgctcatcgcggggctgatgtggtcatcactggcacaccacaaggtgcaaaaatcgaagagtaa

SEQ ID NO: 3116 - DNA, 657 bp, Vibrio mimicus
atgactcaagatgaaatgaaaaaagccgccggttgggctgctcttaaatacgtagaaaaaggcagcattgtcggtgttggtacaggctcaaccgttaatcacttcatcgatgctttaggctctatcaaagaagaaattaaaggcgcggtatccagctcaatcgcttctaccgagaaactcgaagccctcggcattcgtgtctacgactgcaacgatgtatcagaactggacatctatgttgatggtgcagatgaaatcaacccaaaacgtgacatgatcaaaggcggcggtgctgcactgactcgcgaaaagattgtggctgcgattgccaagaaatttgtgtgcatcgtcgatggcaccaaagcagttgatgttctaggtaacttcccactgcctgttgaagtcattccaatggcgcgctcttacgtggcacgtgaactggtgaaactgggtggcgatcctgtgtatcgcgaaggcgttatcactgataacggcaacgttatcctcgacgtgtacaacatgaaaatcactcatccgaaagatctagaaactaagatcaacggcattcctggcgttgtcactgttggcctttttgcccaccgtggagccgatgtagtgatcacaggtacaccacaaggtgcgaaaatcgaagagtaa

SEQ ID NO: 3117 - DNA, 657 bp, Vibrio mimicus
atgactcaagatgaaatgaaaaaagccgccggttgggctgctcttaaatacgtagaaaaaggcagcattgtcggtgttggtacaggctcaaccgttaatcacttcatcgatgctttaggctctatcaaagaagaaattaaaggcgcggtatccagctcaatcgcttctaccgagaaactcgaagccctcggcattcgtgtctatgactgcaacgatgtatcagaactggacatctatgttgatggtgcagatgaaatcaacccagaacgtgacatgatcaaaggcggcggtgctgcactgactcgcgaaaagattgtggctgcgattgccaagaaatttgtgtgcatcgtcgatggcaccaaagcagttgatgttctaggtaacttcccactgcctgttgaagtcattccaatggcgcgctcttacgtggcacgtgaactggtgaaacttggcggcgatcctgtgtatcgcgaaggcgttatcactgataacggcaacgttatcctcgacgtgtacaacatgaaaatcactcatccgaaagatctagaaactaagatcaacggcattcctggcgttgtcactgttggcctttttgcccaccgtggagccgatgtggtgatcacaggtacaccacaaggtgcgaaaatcgaagagtaa

SEQ ID NO: 3118 - DNA, 657 bp, Vibrio sp. RC586
atgactcaagatgaaatgaaaaaagccgccggttgggctgctctaaaatacgtagaaaaaggcagcattgtcggtgttggtacaggctcaaccgttaatcacttcatcgatgctttaggctctatcaaagaagaaattaaaggcgcggtatccagctcaatcgcttctaccgagaaactcgaagctctcggcatccgcgtttatgattgcaatgatgtggcggcactggatatctatgttgatggtgcagatgaaatcaacccagaacgtgacatgatcaaaggcggcggcgccgcgctgacgcgtgagaaaatcgtagccgcgattgccaaaaaattcgtatgcatcgttgatggtaccaaagcggttgatgttctaggtaacttcccactgcctgttgaagtcatcccaatggcgcgttcttacgtggcacgtgaactagtgaaacttggcggcgatcctgtgtatcgtgaaggcgtcatcaccgataacggcaacatgatcctcgatgtacataatatgaagatcatccatccgaaagatctggaaactaagatcaacggcatcgcgggcgttgtgacggtaggcttatttgcccaccgcggagcggatgtcgtgatcacaggtacaccacaaggtgcaaaaatcgaagagtaa

SEQ ID NO: 3119 - DNA, 657 bp, Vibrio sp. RC341
atgactcaagatgaaatgaaaaaagccgccggttgggctgctctaaaatacgtagaaaaaggcagcattgtcggtgtcggtactggttcaaccgtgaatcacttcatcgatgctttaggcactatcaaagaagaaatcaaaggcgcagtatctagctctatcgcttctaccgagaaactcgaagctctcggcatccgcgtttatgactgcaatgaggttgctgcactcgatatttatgttgatggtgcggatgaaatcaacccagaacgtgacatgatcaaaggtggcggcgccgcgctgacgcgtgagaaaatcgtagccgcgattgccaaaaaattcgtatgcatcgttgatggtaccaaagcggttgatgttctaggtaacttcccactgcctgttgaagtcatcccaatggcgcgttcttacgtggcacgtgaactagtgaaacttggcggcgatcctgtgtatcgtgaaggcgtcatcaccgataacggcaacgtgatcctcgacgtacacaatatgaagatcacccatccgaaagatctggaaactaagatcaacggcatcgcgggcgttgtgacggtaggcttatttgcccaccgcggagcggatgtcgtgatcacaggtacaccacaaggtgcaaaaatcgaagagtaa

SEQ ID NO: 3120 - DNA, 657 bp, Vibrio furnissii
atgactcaagatgaaatgaaaaaagccgccggttgggctgcactgaaatatgtagaaaaaggcagcattgttggtgtcggtaccggttcaacggtgaatcacttcatcgatgctttggggtcgatcaaagatggcatcaaaggcgcagtttcaagctcaattgcgtccaccgagaaactcaagggcctcggcattgaggtgttcgattgtaacgatgtggctggcttggacgtgtacgtcgatggcgcggacgaaattaacccacagcgcgaaatgatcaaaggcggtggtgcggcgctgacgcgtgaaaaaattgtggcggccattgccgacaaattcatctgtatcgtcgatggcaccaaagcggttgacgtcctgggaggattcccgctccccgtagaagtgattccaatggcgcgctcttatgtggcacgtgaactggtcaaactgggcggtgatccggtgtatcgtgaaggtgttctgaccgacaacggcaacatcattctagacgtgcacaacatgcgcatcacagacgccaaagatctggaaagcaaaatcaacgcgattgcaggcgtggtgaccaacggtctgttcgctcaccgcggagcggatgtggtcattaccggtacccctgaaggggcgaaaatcgaagaataa

SEQ ID NO: 3121 - DNA, 657 bp, Vibrio parahaemolyticus
atgactcaagatgaaatgaaaaaagcggctggttgggcagcacttaaatatgttgagaaaggcagcattgtcggtgttggcacaggctctaccgtgaatcacttcatcgatgcactaggcactatcaaagatgatatcaaaggtgcagtgtctagctcagttgcttctacagagcgtctaaaagagcttggtattgaagtttttgagtgcaacgacgtaattaagctagacgtatatgttgatggcgcagacgaaatcaaccatgcgcgtgaaatgatcaaaggtggcggtgcagcgctaactcgtgaaaaaatcgttgcagcaatctctgaaaagtttgtatgtatcgttgacgacacgaaagcggttgacgtgcttggccagttccctcttccagtggaagtgattccaatggcacgttcttacgttgctcgtgagttggtgaaacttggtggcgaccctgcataccgtgaaggtgttgtaacggataacggcaacatcatcctagatgtacacaacatgcaaatcaccaacccgaaagagatggaagacaaaatcaacggtatcgcgggtgtggtaacggttggtctttttgctcaccgtggtgctgatgttgtgatcactggtacgccagaaggcgcaaaaattgaagagtaa

SEQ ID NO: 3122 - DNA, 657 bp, Vibrio parahaemolyticus
atgactcaagatgaaatgaaaaaagcggctggttgggcagcacttaaatatgttgagaaaggcagcattgtcggtgttggcacaggctctaccgtgaatcacttcatcgatgcactaggcactatcaaagatgatatcaaaggtgcagtgtctagctcagttgcttctacagagcgtctaaaagagcttggtattgaagtttttgagtgcaacgacgtaattaagctagacgtatatgttgatggcgcagacgaaatcaacccagcgcgtgaaatgatcaaaggtggcggtgcagcgctaactcgtgaaaaaatcgttgcagcaatctctgaaaagtttgtatgtatcgttgacgacacgaaagcggttgacgtacttggccagttccctcttccagtggaagtgattccaatggcgcgttcttacgttgctcgtgagttggtgaaacttggtggcgaccctgcataccgtgaaggtgttgtaacggataacggcaacatcatcctagatgtacacaacatgcaaatcaccaccccgaaagagatggaagacaaaatcaacggcatcgcgggtgtggtaacagttggtctttttgctcaccgaggtgctgatgttgtgatcactggcacgccagaaggcgcaaaaattgaagagtaa

SEQ ID NO: 3123 - DNA, 657 bp, Vibrio alginolyticus
atgactcaagatgaaatgaaaaaagcggctggttgggcagcactaaaatatgttgagaaaggcagcattgtcggtgttggtactggctctaccgtgaatcacttcatcgatgcactaggcactatcaaagatgatattaaaggtgcagtgtctagctctgtcgcttcaactgagcgccttaaagagcttggtattgaagtatacgagtgcaacgatgtaatgaagctggatgtgtatgttgatggcgcagatgagatcaacccagcacgtgaaatgatcaaaggcggcggcgcggctctgactcgtgagaaaattgtcgcagcaatctctgataagttcgtatgtatcgttgacggcactaaagcagttgacgtacttggccagttcccattgcctgttgaagtaatcccaatggcacgctcttacgtggctcgtgaattggtaaaactaggtggtgatccagcttaccgtgaaggcgttgtgactgacaacggcaacgtgattctggatgtgcacaatatgcaaattaccaacccgaaagaaatggaagacaaaataaacggcatcgctggtgtggtgactgtgggtcttttcgctcatcgtggtgcagacgtagtgatcactggcacaccagaaggtgcaaaaattgaagagtaa

SEQ ID NO: 3124 - DNA, 657 bp, Vibrio harveyi
atgactcaagatgaaatgaagaaagcggctggttgggcagcacttaagtatgttgagaaaggcagcattgtcggtgttggtactggctctaccgtgaatcacttcatcgatgccctaggcagtatcaaagatgatatcaagggtgcagtgtctagctctgttgcttcaactgagcgtctaaaagagcttggtattgaggtttatgagtgtaacgacgtagcaatgctagatatctacgttgatggtgcagatgaaatcaacgcagcacgtgaaatgatcaaaggcggcggtgctgcactgactcgtgaaaagatcgttgcggctatttcagaaaaattcgtatgtatcgttgacggcacaaaagcagttgacgtacttggccagttcccacttcctgtagaagttatcccaatggcgcgttcttacgtggctcgtgaattggtaaaactgggcggtgaccctgcataccgtgaaggcgtaacaacggacaacggtaacgtaatcctagacgtacacaacatgcaaatcactaacccgaaagagcttgaagacaagatcaacggcattgcaggtgtggtaactgtgggtctattcgctcaccgtggtgctgacgtggttatcactggcacaccagaaggtgcgaaaatagaagaataa

SEQ ID NO: 3125 - DNA, 657 bp, Vibrio sp. AND4
atgacccaagatgaaatgaaaaaagcggctggttgggcagcacttaagtatgttgagaaaggcagcattgtcggtgttggtactggctctaccgtgaatcacttcatcgatgccctaggcagtatcaaagacgatatcaagggtgcagtgtctagctctatcgcttcaactgaacgcttgaaagcgctcggtattgaagtttacgagtgcaacgacgtggcgatgctggatatctacgtggatggtgcagacgaaatcaacgcagcacgtgaaatgattaaaggtggcggtgcagcactgacacgtgaaaaaatcgtagcagcactttcagaaaaattcatctgtatcgttgatggcacaaaagcagttgacgtgctgggccaattcccgcttcctgtcgaagtgatcccaatggcacgctcttatgtggctcgtgagttggtcaaactgggaggagacccagcgtaccgtgaaggtgtgactacggacaacggcaacgtgatcctagacgtgcataacatgcaaatcaccaacccgagagagcttgaagacaagatcaacgcaattgcaggagtagtcacggtaggcctgtttgctcaccgtggagcagatgtagttatcactggcacaccagaaggtgcgaaaatagcagaatag

SEQ ID NO: 3126 - DNA, 657 bp, Vibrio shilonii AK1
atgactcaagacgagatgaagaaagctgctggttgggcggcactaaagtatgtcgaaaaagatagcattgttggtgttggtacaggctcaactgtaaaccacttcattgatgcactaggcacaatcaaagaagatatcaaaggtgcagtatccagttcgattgcttcaacagagaagctagaagcgctaggcattgaagtcttcgactgcaacgacgtggcttatcttgatgtttacgttgatggcgcagatgaaatcaacccaactcgtgacatgatcaagggcggtggtgcagcactaacacgtgagaagatcgtagccgctatctcagacaagtttgtatgtatcgttgatggtactaaggccgttgatgttcttggccagttcccactacctgtagaagttattccaatggcacgttcttacgtggctcgcgaactagtgaaacttggtggtgacccggtttaccgtgaaggcgtgattacagacaacggtaacgtcattttagacgtacacggtatgcaaatcactgatgctaaagatatggaagacaaaatcaacgctctagcaggcgtggtaacggtaggtttatttgcacaccgtggcgctgatgtgatcattactggcactccagaaggtgcaaaaatcgaagaataa

SEQ ID NO: 3127 - DNA, 657 bp, Vibrio coralliilyticus ATCC BAA-450
atgactcaagatgaaatgaagaaagaagctggttgggcagcacttaagtatgttgaaaaagacagcattgtcggtgttggtacaggctctacggtaaatcacttcatcgatgcactcggtacaatcaaagacgatatcaaaggtgcagtttctagctcagaagcatcgactgaaaagctgaaaggtttaggcattgaagtctttgactgtaatgaagtatcgaacttagatgtctacgttgacggtgctgacgaaatcaacgcagcacgcgacatgatcaaaggtggtggcgcggcgctaacacgcgagaaaattgttgcggctatttcggataaatttgtctgtatcgtagatggcaccaaagctgttgacgttctgggtgagttccctttacctgtagaggtcatcccaatggcgcgttcttacgtcgctcgtgaaatggtgaaacttggtggcgaccctgtgtaccgtgaaggcgtggtgactgataacggcaacgttatcctggatgtgcatggcatgcagatcacccacccgaaagaaatggaagataaaatcaatgctatcgcaggtgttgtgacggttggcttatttgctcaccgtggtgcggatgtggtgatcactggcacgcctcaaggggcaaaaatcgaagattaa

SEQ ID NO: 3128 - DNA, 657 bp, Vibrio metschnikovii
atgactcaagatgaaatgaaaaaagccgccggctgggctgcacttaactatgtcaaaaaaggcagtattgttggtgtcggtacaggctcaactgttaatcacttcatcgatgccttaggctctattaaggatgatattcaaggcgcagtctcgagctcattggcttcaacagaaaaactccaagcacttggtatcaaagtttatgactgtaatgacattgaagcattagatgtttacgtggatggggctgatgaaatcaacgctcaacgcgaaatgattaagggcggtggtgcggccttaacgcgagaaaaaattgttgcagcgattgctaaacaatttatctgtatcgtcgatggcagcaaagctgttcccgtgctagggaaatttccactgccagttgaagttatcccaatggcacgtagctacgttagccgtgaattaagcaaattgggtggaaaacctgtctatcgtgaaggggtgattactgataacggcaatattattttggatgtgcacgatctgcacattactcaagccaaagcgctggaagataaaattaactcgattaccggcgtcgtgaccaatggtttatttgcccatcgcggtgccgatgtggtgatcacgggaaccgagcaaggtgccaaaatcgaagaataa

SEQ ID NO: 3129 - DNA, 654 bp, Aeromonas salmonicida
atgactcaagatgaaatgaagaaggcggctggttgggctgcgctcaaatacgtggtgcccggtaccatagtcggggtaggcacaggctctaccgtcaaccactttatcgatgcgctggcaaccatgaaggaccagatcaacggggctgtatccagctcaatcgcctccaccgagcgcctcaaagagtttggcatcaatgtctatgacctcaatgacatcgatgccctctccgtctacgtggatggcgccgacgagatcaacgccagtcgcgacatgatcaagggcggtggcgcggccctgacccgcgagaagatagtggcggccgtggctgacaagttcatctgcatcatcgacaacacaaaaactgtggacgtgctgggtcagttcccgctgccggtggaagtgatccccatggcccgcgaatacgtggcccgcgagatccgcaagctgggtggcaaccccgagtggcgcgaaggtgtggtcaccgacaacggcaacatcatactggacgtcaagggcatggccatcaaggatgccaaggcgctggaagtacagctcaatggcatagtgggcgtggtcaccaacggtctgtttgcccaccgtggcgcggacgtggtactgatcggcacacctgacggggtcatcacccaataa

SEQ ID NO: 3130 - DNA, 654 bp, Aeromonas hydrophila
atgactcaagatgaaatgaagaaggcggccggttgggctgcgctcaagtatgtggttcccggcaccatcgtcggggtaggcaccggctctaccgtcaaccacttcatcgatgcactggcgaccatgaaggacgagatcaagggggcggtatccagctccgtggcctccaccgaacgcctcaagggcttcggcatcacagtgtatgacctcaacgagatcgacgccctctccgtctacgtggacggtgccgacgagatcaacggcacccgcgacatgatcaagggcggcggcgcagccctcacccgcgagaagatcgtcgccgccgtggccgacaagttcatctgcatcatcgacaacaccaagacggtcgacgtgctcggcaccttcccgctgccggtggaagtgattcccatggcccgcgaatacgtggcccgcgagatcagaaagctcggcggcaacccggtctggcgtgaaggggtggtcaccgacaacggcaaccacatcctggatgtgaaaggcatggccatcaccgatgccaaggggctggaagtgcagctcaatgccatcgtcggcaccgtcaccaacggcctgttcgcccaccgtggggcagatgtagtgctgattggtactcccgacggggtcatcacccaataa

SEQ ID NO: 3131 - DNA, 657 bp, Moritella sp. PE36
atgactcaagatgaattaaaaaaagcagcaggctgggcagcattagaatatgttaaaaaagatagcatcgtcggtgtcggtaccggctcaaccgttaatcattttattgatgcattaggtactattcgcgaagacattaaaggtgccgtttcaagttctatcgaatcaactaagcgcttagaagcaatgggaattgaagtatttgatttaaacagtgtcccgcaccttgatatctatgttgatggggctgacgaaattgatagcaacaacaacatgatcaaaggtggtggcgcagcgctaacacgtgaaaagatcgttgctgcagtagcagaccaattcgtgtgtattattgatgatactaagaatgttgccgtattaggtgatttcccattacccgttgaagtgatcccaatggcccgctcttacgtgggtcgtgagttagttcaactcggtggtgatccggtttaccgtgaaggtgtcgtgactgataacggtaatattattctggatgtatacaacatgcagatcaccgatccgaaagcactagaaattgcaattaatggcttggtgggcgtagtaacaaatggtctattcgctgctcgcggcgcggacattgtgctaactggcacacaaaatggcgtgaaaacaactaagtaa

SEQ ID NO: 3132 - DNA, 657 bp, Psychromonas ingrahamii 37
atgacacaagatgaaatgaaaaaagcagccgcctatgcagccttggaatatgtacagccagattcaattgttggcgtcggcactggctcaacagtgactcattttattgatgcgctggcaaccataaaggatcttatcaaaggtgcggtttcaagctccgatgagtcaactgcaaggttacaatcctatggtatcgatgtttttgatcttaatgaggtttctgaattgagcatttatgtcgatggtgcggatgaaataaatccctataaccacatgatcaaaggtggcggtgcagccttaacgcgtgaaaagataatttcagcggttgctgaaaaatttatctgtattgtggataacactaaaaatgttgatattctgggtgactttccattacctattgaagtgattccgatggcgcgcagttatgtcgcacgtgaattggttaaattaggtggagatcctgtttatcgtcagggtgtggtaacagacaatggcaatgtgattttagatgttcataacttaaaaattgctgaaccccttaaattagaggcgcaaatcaatgcgattgttggcgtagtcaccaatggtttatttgcaaaccgtgcggctgatgttgttttagttggtacaccagaaggtgttaaaacgctaaaataa

SEQ ID NO: 3133 - DNA, 657 bp, Psychromonas sp. CNPT3
atgacccaagatgaaatgaaaaaagcagccgcctacgcagcccttgaatatgtagaatctggcagtattatcggtgtgggtacaggctctaccgtcaatcattttattgatgcgctaaaaaccatcaaaggaagcataaaaggggctgtctcgagctctgaagagtcaactaaaagactacgtgcttacggcatcgaagtttttgatcttaatgaagtgactgagctgagtgtttatgtggatggcgcagatgaaattaacccttataacgcgatgatcaaaggcggaggagctgctttaacacgcgaaaagattgtcgcagcggttgctaaaaagtttatttgtattgtcgataacactaaaaacgtcgatgttttaggtggattcccgctacctgttgaagttatcccaatggcgcgcagttatgttgcaagagagctggttaaactgggtggtacgcctatctatcgtcaaggcgtgataacagataatggcaatattattttagatgtacatgccatgaaaatttcagagccactaaaaacagaaacggctattaatgcattagcgggcgttgtcaccaatggcttatttgcaaacagaggcgctgatgttgtacttgtcggcacacctgaaggcgttaaaaccttaaaataa

SEQ ID NO: 3134 - DNA, 657 bp, Pseudoalteromonas atlantica
atgaatcaagacgataagaagaaagcagtcgcccaagcagcggtacgatatgtagagcaagactccataataggcgttggtactggctctactgtcaattacttcattgaggccttagcgccaatcaagaacgatatagtcggtgcggtttccagctcagaagcatcaacagaacgtttaacagcgttaggtattgaagtgtttgatttgaactcggttgatcaattatcagtgtatgttgatggcgcggatgaaatcactgaacaccgacatatgattaaaggcgggggtgcggctttaactcgtgagaaaattgttgcagcggtagcacagaagttcgtctgtatcatcgacgataccaaaaacgtgggcgtattaggtgcctttccactccccgttgaggttatccctatggcgcgctcatacgtcgctagggagattgtaaagctcggtggcgatccagtgtatcgccaaggtgtggtgaccgacaatggtaacgtcatcctagacgtacataatctgaaaatactgaatcctgtagagctagagcgacagttaaacaacattgtcggtgttgtcactaacggcttgtttgcagcccgaggggccgacgttgtgctcacaggcagcgagagcggtgttcaagtaaacgagtaa

SEQ ID NO: 3135 - DNA, 654 bp, Rhodobacterales bacterium HTCC2255
atgacccaagatgacaaaaaacgtgcagcagctcaagcggctcttgcttatgtaaaacctgacgatattgttggtgttggtacaggctctacggtgaattattttatcgaagcgttagctgccaaaaaagatctcatcgaaggtgccgtctctagttctgatgcttccactcaacaacttaaagctcttggtattgaagtatttgatttaaacagtgtggaccaatttgatatttacatcgatggggccgatgaaatcactgaacacaaacacatgatcaaaggtggtggtgccgcattaactcgagagaaaatcgtatctgccgttgctaaaacctttgtgtgtattattgatgacacaaaacaagtcggcatgttaggtgattttccattaccagttgaagtcattcctatggcacgcagttatgtggctagagaattagtcaaacttggtggtgaccctgtctaccgccagggtgtcatcaccgataatggcaatgttattttagatgtccataatttaaccattcttgatcctcgcgcactagaaacaaaaatcaatcaaattgtaggtgtggtcacgaatggattatttgcccatcgaggcgccgatatattaatcgtcggaggggaagacggagttaaaactttataa

SEQ ID NO: 3136 - DNA, 663 bp, Alteromonas macleodii
atgaccatggatcagaacgcaaagaaacaagccgtagccaaagcagctatcgactacgttgaatcagacagtattgtcggtgtgggtacgggttctaccgtgaatttctttattgaagagctcggtaaaattaaacacaaaattgaaggggcagtatcaagctcagaagcatcaacagcgcgtttaaaagctttgggcattgaagtatttgcgctaaacgaagtaagcaacctttctgtttatatcgacggtgccgatgaagttaccgaacacaagcatatgattaaggggggcggtgccgcacttactcgtgaaaagattgttgcaggcgctgccactacgtttgtttgtattgtagatgaaactaaacgggtgccagtactgggcgcattccccctccctgttgaagtgatacctatggcccgttctttcgtagcccgtgaactggttaagcttggcggcgacccagagtaccgtcagggagtgatcaccgacaatggcaacgttatcttggatgttcataaccttgagatacttaatccacgggaactagaacaaaagataaataatattccaggcgtagtgactaacggcattttcgctctgcgcggtgccgatatagtgctaagtgcaacagaaaacggtgttgagacctttaagtaa

SEQ ID NO: 3137 - DNA, 657 bp, Alteromonas macleodii
atggatcagaacgcaaaaaaacaagccgtagccaaagcagccatcgaatatgttgaagcagacagcattgtcggtgtgggtacaggttctaccgtaaatttctttattgaagaactcggtaaaattaaacacaaaattgaaggtgcagtatcaagttcagaagcctctaccgagcgtttaaaagccttaggcattgaggtattcgagttaaacgaagtcagcaatctatcggtttatatcgacggtgccgatgaagtgaccgaacacaagcatatgattaaaggcggaggcgcagcactcactcgcgagaaaattgtagccggtgcggcgaccacgtttgtgtgtattgttgatgaaagtaagcgcgttcctgtattgggctcgtttccccttcccgttgaagttattcccatggctcgctctttcgtagcacgagagctagtaaagcttggtggcgatcctgaatatagacaaggtgttgtcaccgataacggcaacgttattttagatgttcacaaccttgagattctgaatcctcgtgagctagaacaaaaaataaataatattcctggcgtggtcacgaacggcattttcgcactacgaggcgcggacatagtgctaagtgctacagatagtggtgttgaaacctttaagtga

SEQ ID NO: 3138 - DNA, 657 bp, Colwellia psychrerythraea 34H
atgactcaagatgaaatgaaaaacgcagccgccattaaggcattagaattcattgaaaatgatactatcgtcggtgttggcactggctcaacagttaactttttcattgaagctctagcctcgatgaaagataaaatagcaggtgctgtttctagctcagaagagtcaactaagcgtttaaaagcacacggtattgaggtatttgatttaaacagtgttgatgttttagatgtatacgttgacggtgccgatgaaatcactcgtcatatgtcgatgatcaaaggcggtggcgcagcattaacccgtgaaaaaatcgtggcggcagtcgccaagaaatttatttgcattgccgacgattccaaacaagtaaaagtattgggtaactttcctttgcctgttgaagtaatacctatggcgcggagttatgtcgcacgtgaattagttaaattaggtggcgacccagtttaccgtcaaggtgtgaccacagataatggcaacgttatccttgatgtgtacaatctcgaaattcttgatccaaaagcactagaaactcaaattaacgctattgttggcgttgtgactaatggtttgtttgcacttcgtggcgctgacatattagtacttggtagcaaagatggaattcaggttatccaataa

SEQ ID NO: 3139 - DNA, 657 bp, Aggregatibacter aphrophilus NJ8700
atggatcaacttgaaatgaaaaaaatcgccgcacaagcggctttgcaatttgtgaagccggagatgatcgtaggcgtgggcagcggttccaccgtgaactgctttattgaagcacttggttcaatgaaagatgaaatcaaaggtgctgtagcagcttccaaaaattcggaagaattgcttaaaaaacatggtattgaagtatttagcgcaaatgatgtgacgagcttagatatttatgttgatggcgctgacgaaattaatccgcaaaaaatgatgattaaaggcggtggggcggcgttgacacgtgaaaaaattgtggctgcacttgcaaaaaatttcatctgcatcgtggatagtagcaaacaggttgatgtgttaggctctacattccctctaccggtagaagtgattccgatggcacgttcgcaagtggcgcgtaaattggtagcactcggtggtgcaccggaatatcgtgaaggtgtagtaaccgataacggcaacatcattttagatgtgcataattttgaaattcttaacccggtagaaatggaaaaagaattaaacaacatcgcaggtgtcgtgactaacggcatttttgccttacgccctgccaatacagtgattgtcggcacaccgaacggtgcaaaaataatctaa

SEQ ID NO: 3140 - DNA, 657 bp, Aggregatibacter actinomycetemcomitans D11S-1
atggatcagcttgaaatgaaaaaaatcgccgcgcaagcggctttgcaatttgtgaagccggagatgatcgtgggcgtaggcagcggttctaccgtcaattgttttattgaagccttgggcgcgttaaaaaatcaaattaaaggcgcggttgcagcatccaaaaaatcggaagaattattgcgccaacaaggcattgaggtgttcagcaccaatgatgtttccggtttggatatttatgtggacggtgccgatgaaatcaatccgcaaaaaatgatgattaaaggcggcggcgcggcgttgacacgtgaaaaaattgtggctgcactagcaaaaaatttcatctgcattgtggatagtagcaagcaggttgatgtgttaggctctactttcccgttgccaatcgaagtgattcctatggcacgttcgcaggtggcacgtaaattagtggcgttaggcggtgcaccggaatatcgcgaaggtgtggtgaccgataacggcaacattattttggatgtgcataattttgagattatgaatccggtggcgatggaaaaagaattaaacgatattgcgggggtggtcaccaacggcatcttcgcgttacgctcggcggacacggtgattgtcggcaccccgagcggcgcaaaaataatttaa

SEQ ID NO: 3141 - DNA, 660 bp, Mannheimia succiniciproducens MBEL55E
atgaatcaactcgaaatgaaaaaagttgcggctaaagccgcattacaatttgtcaaaccggatatgattgtcggggtagggagcggttcaacggtaaattgctttattgaagaattaggtgcatttcgtgatcaaattaaaggcgcggtagcggcttctaaagcatcggaagaattattaagaaaacaaggtattgaggttttcagtgccaatgacgtatcgagtctggatatttatgtagacggcgccgatgaaatcaatccgcagaaaatgatgattaaaggcggcggtgcggcgttaacccgtgaaaaaatcgtttcgtctttggcgaaaaattttatttgcattgtcgatagcagcaaacaggtagatatactgggttccactttcccgttgccggtagaagtgattcctatggcgcgttcacaagtcgcccgtaaattggtagcgttgggcggaagccctgaatggcgtgaaggcgtgattaccgataacggtaacgtaattttggacgtgcataattttattattatgaatcctattgaaatggaaaaagaattgaataatgtcgcaggtgtggtaacaaacggtatttttgcgttaaatgcggcgcataccgtgattgtcggcacaccggacggtgctaaaattattgaataa

SEQ ID NO: 3142 - DNA, 660 bp, Actinobacillus succinogenes 130Z
atggatcaactcgaaatgaaaaaaatggctgctcaagccgcattacaatttgtgcaacccgatagtatcgtcggggtcggcagcggttctaccgtaaattgtttcattgaagcgctgggtgcaatgcgggatcaaatcaaaggtgcggtggcggcatccaaagcgtcggaggaattgctgcgcaaacagggcattgaagtgttcagtgccaatgatgtgtcgagtttggatatttacgtggacggtgcggacgaaatcaatccgcagaaaatgatgatcaaaggcggcggagcggcgttaacccgcgagaaaatcgtagcgtcgctgaccaaaaattttatctgtattgtggacagttcaaaacaggtggacgtgctgggttccacatttccgttaccggtggaagtgattcctatggcgcgttctcaagtggcacgtaaactggtcgcattaggcggttcgccggaatggcgtcagggggtggtgacggataacggcaatgtcattttagacgtacataatttcccgattatgaatccgccggaaatggaaaaggaattgaataacgtggcgggcgtggtgacaaacggcattttcgccttgaatgcggcgaataccgtgattgtcggcacgcctgaaggtgcgaaaatcatcaaataa

SEQ ID NO: 3143 - DNA, 660 bp, Haemophilus somnus
atggatcagttaagcatgaaaaaaatggctgctcaagctgcactgcaatatgttaagcctgatagcattattggcgtaggaagcggttcaactgtcaactgttttattgaagtattaggtacaataaaagaaacaatcaaaggtgctgtcgcagcttcaaaagcatcagaagaattattactccgacaaggtatcgaggtattcagtgcaaatgatgtatccggtttagatatttatgtcgatggtgcagatgaaattaatccgcaaaaaatgatgattaaaggtggcggagcagcattgacacgtgaaaaaattgtagctgcattggcaaaaaaattcatatgtatagtagacagttctaaacaagtggatgtattaggctcaacgttcgctttgccgatagaggtgattccaatggctcgctctcaagttgcacgcaaattagtggcgttgggcggttcacctgaatatcgtgaaaatgtggttacagataatggtaatgttattttagatgtatataactttaaaattatgaatccgatagaaatggaaaaagaattgaataatgtggccggcgtggtaacaaatgggatttttgctttacgttctgcagatattgttattgtaggtacgccggagggtacaaaaattattgaataa

SEQ ID NO: 3144 - DNA, 660 bp, Haemophilus somnus
atggatcagttaagcatgaaaaaaatggctgctcaagctgcactgcaatatgttaaacctgatagtattattggcgtaggaagcggttcaactgtcaattgttttattgaagtattaggtacaataaaagaaacaatcaaaggtgctgtcgcagcttcaaaagcatcagaagaattattactccgacaaggtatcgaggtattcagtgcaaatgatgtatccggtttagatatttatgtcgatggtgcagatgaaattaatccgcaaaaaatgatgattaaaggtggcggagcagcattgacacgtgaaaaaattgtagccgcattggcaaaaaaattcatatgtatagtagacagttctaaacaagtggatgtattaggctcaacgttcgctttgccgatagaggtgattccaatggctcgctctcaagttgcacgcaaattagtggcgttgggcggttcacctgaatatcgtgaaaatgtggttacagataatggtaatgttattttagatgtatataactttaaaattatgaatccgatagaaatggaaaaagaattgaataatgtggccggcgtggtaacaaatgggatttttgctttacgttctgcagatattgttattgtaggtacgccggagggtacaaaaattattggataa

SEQ ID NO: 3145 - DNA, 660 bp, Pasteurella dagmatis
atggatcaacttgaaatgaaaaaacaagctgctaaagctgcgcttaaatatgtcaaaccagacaccattgtaggtgtgggcagtggctcaacagtgaattgtttcattgaagcacttggtgcaatgaaaaatgaaattaaaggggcagttgctgcatcaaaagcctctgaagaattattaagaaaacaaggcattgaggtctttagtgcaaacgaagtctcaagtttagatatttatgttgatggcgcagatgaagtcaatccacaaaagatgatgatcaaaggtggcggtgcagcattaacacgtgaaaaaatcgtagcggcattagcgaaaaaattcatttgtatcgtagataaaagcaaacaagttgatgtgttaggttcaacatttgctttacctgttgaagtcattccaatggctcgctcacaagttgcacgcaaattagtgtcgttaggcggttcaccagaatatcgagaaggcgtggtcactgataacggtaatgtcattttagatgtttacaattttgctattatgaaccctgttgaaatggaaaaagaattaaataacgtcgcaggtgtcgtgactaatggtatttttgccctacgtgctgctgatattattattgttggcacacctgaaggtgcaaaaattatcgaataa

SEQ ID NO: 3146 - DNA, 660 bp, Pasteurella multocida
atggatcaacttgaaatgaaaaaaatggctgcggcagccgcactgcaatacgtgaaacccgattcaatcattggggtaggcagtggctcaacagtcaattgttttattgaagcgctagggagtatgcgagatcaaattaaaggggcggtggcggcctcaaaagcctcagaagccttattagcaaaacaagggattgaagtgtttagtgccaatgaggtttcaagccttgatatctatgtcgatggtgccgatgagattaacccacagaaaatgatgatcaaaggcggaggtgccgcactaacccgtgaaaaaattgtggcagcgttggcaaaaaaattcatttgtatcgttgatacaagcaaacaagttgatgtgctcggctcaactttcgccttaccagttgaggtgattccaatggcgcgctcccaagtggcgcgtaaattagtcgccttaggtggctcaccagaataccgcgaaggtgttgttacagataatggtaacgtgattttagatgtctatcattttgctattatgaatcctgttgaaatggaaaaagaattaaataatgtgccgggcgtggtcaccaatggcatttttgctctacgcgcagcagatattattattgtcggcacgcctgaaggtgccaaagtcattgaataa

SEQ ID NO: 3147 - DNA, 660 bp, Haemophilus influenzae
atgaatcaattagaaatgaaaaaactcgccgcacaagctgcattacaatatgtaaaagcagatacgattgttggggtgggaagtggctccacagtgaactgctttattgaggctttgggtacaatcaaagataaaattcaaggcgcagttgcggcttcaaaagaatcagaagaattattacgtaagcaaggtatcgaagtatttaatgcaaatgatgtctctagcttagatatttatgtggatggtgcggatgaaatcaatccacaaaaaatgatgattaaaggcggcggcgcagcgctcactcgtgaaaaaatcgtcgctgcattagcgaaaaaatttatttgtattgtggattcaagtaagcaagtggatgtgttaggttcgaccttcccattaccagttgaagttattccaatggctcgttcacaagtaggcagaaaattagtcgcacttggtggctcacctgaatatcgtgaagacgtggtgacagacaacggcaatgtgattttagatgtgcacaacttcagtattttaaatccagttgaaatggaaaaagaattaaacaacgtttcgggtgtcgtcactaacgggatattcgcgttacgtggcgcagacgttgtgatcgtcgggacgcctgaaggcgccaaaattattgactaa

SEQ ID NO: 3148 - DNA, 660 bp, Haemophilus influenzae
atgaatcaattagaaatgaaaaaactcgccgcacaagctgcattacaatatgtaaaagcagatacgattgttggggtgggaagtggctccacggtgaactgctttattgaggctttgggtacaatcaaagataaaattcaaggcgccgttgcggcttcaaaagaatcagaagaattattacgtaagcaaggtatcgaagtatttaatgcaaatgatgtctctagcttagatatttatgtggatggtgcggatgaaatcaatccacaaaaaatgatgattaaaggcggcggcgcagcactcactcgtgaaaaaatagtcgctgcattagcgaaaaaatttatttgtattgtggattcaagtaagcaagtggatgtgttgggttcaactttcccattaccagttgaagtgattcctatggcacgctcacaagtaggcagaaaattagtcgcacttggtggctcacctgaatatcgtgaagacgtggtgacagacaacggcaatgtgattttagatgtgcacaacttcagtattttaaatccagtcgaaatggaaaaagaattaaacaacgttgcgggtgtcgtcactaacggcatctttgcgttgcgtggtgcagatgttgtgatcgtcgggacgcctgagggtgcaaaagttattgactaa

SEQ ID NO: 3149 - DNA, 660 bp, Haemophilus influenzae
atgaatcaattagaaatgaaaaaactcgccgcacaagctgcattacaatatgtaaaagcagatacgattgttggggtgggaagtggctccacagtgaactgctttattgaagctttaggtacaatcaaagataaaattcaaggtgccgttgcggcttcaaaagaatcagaagaattattacgtaagcaaggtatcgaagtatttaatgcaaatgatgtctctagcttagatatttatgtggatggtgcggatgaaatcaatccacaaaaaatgatgattaaaggcggcggcgcagcactcactcgtgaaaaaatagtcgctgcattagcgaaaaaatttatttgtattgtggattcaagtaagcaagtggatgtgttgggttcaactttcccattaccagttgaagtgattcctatggcacgctcacaagtaggcagaaaattagccgcacttggtggctcacctgaatatcgtgaaggggtggtgactgacaacggcaatgtgattttagatgtacacaacttcagtattttaaatccagtcgaaattgaaaaagaattaaacaacgttgcaggtgtcgtcactaatgggatattcgcgttacgtggtgcagatgttgtgatcgtcgggacgcctgagggtgccaaagttattgactaa

SEQ ID NO: 3150 - DNA, 660 bp, Haemophilus influenzae
atgaatcaattagaaatgaaaaaactcgccgcacaagctgcattacaatatgtaaaagcagatacgattgttggggtgggaagtggctccacagtgaactgctttattgaagctttaggtacaatcaaagataaaattcaaggtgccgttgcggcttcaaaagaatcagaagaattattacgtaagcaaggtatcgaagtatttaatgcaaatgatgtctctagcttagatatttatgtggatggtgcggatgaaatcaatccacaaaaaatgatgattaaaggcggcggtgcagcactcactcgtgaaaaaatcgttgctgcattagcgaaaaaatttatttgtattgtggattcaagtaagcaagtggatgtgttgggttcaactttcccattaccagttgaagtgattcctatggcacgctcacaagtaggcagaaaattagccgcacttggtggctcacctgaatatcgtgaaggggtggtgactgacaacggcaatgtgattttagatgtacacaacttcagtattttaaatccagtcgaaatggaaaaagaattaaacaacgttgcaggtgtcgtcactaatgggatattcgcgttacgtggtgcagatgttgtgatcgtcgggacgcctgagggtgccaaagttattgactaa

SEQ ID NO: 3151 - DNA, 660 bp, Haemophilus influenzae
atgaatcaattagaaatgaaaaaactcgccgcacaagctgcattacaatatgtaaaagcagatacgattgttggggtgggaagtggctccacggtgaactgctttattgaggctttgggtacaatcaaagataaaattcaaggcgcagttgcggcttcaaaagaatcagaagaattattacgtaagcaaggtatcgaagtatttaatgcaaatgatgtctctagcttagatatttatgtggatggtgcggatgaaatcaatccacaaaaaatgatgattaaaggcggcggcgcagcactcactcgtgaaaaaatagtcgctgcattagcgaaaaaatttatttgtattgtggattcaagtaagcaagtggatgtgttgggttcaactttcccattaccagttgaagtgattcctatggcacgctcacaagtaggcagaaaattagccgcacttggtggctcacctgaatatcgtgaagggggggtgactgacaacggcaacgtgattttagatgtacacaacttcagtattttaaatccagtcgaaatggaaaaagaattaaacaacgttgctggtatcgtcactaatgggatattcgcgttacgtggtgcagacgttgtgatcgtcggcacgcctgagggtgccaaaattattgactaa

SEQ ID NO: 3152 - DNA, 660 bp, Haemophilus influenzae
atgaatcaattagaaatgaaaaaactcgccgcacaagccgcattacaatatgtaaaagcagatacgattgttggcgtgggaagtggctccacggtgaactgctttattgaggctttgggtacaatcaaagataaaattcaaggcaccgttgcggcttcaaaagaatcagaagaattattacgtaagcaaggtatcgaagtatttaatgcaaatgatgtatctagcttagatatttatgtggatggtgcggatgaaatcaatccacaaaaaatgatgattaaaggcggcggtgcagcactcactcgtgaaaaaatagtcactgcattagcgaaaaaatttatttgtattgtggattcaagtaagcaagtggatgtgttgggttcaactttcccattaccagttgaagtgattcctatggcacgctcacaagtaggcagaaaattagccgcacttggtggtgcgcctgaatatcgtgaaggggtggtgactgacaacggcaatgtgattttagatgtgcacaacttcagtattttaaatccagttgaaatggaaaaagaattaaacaacgttgctggtatcgtcactaacgggatattcgcgttacgtggcgcagacgttgtgatcgtcgggacgcctgagggtgccaaagttattgactaa

SEQ ID NO: 3153 - DNA, 660 bp, Haemophilus influenzae
atgaatcaattagaaatgaaaaaactcgccgcacaagctgcattacaatatgtaaaagcagatacgattgttggggtgggaagtggctccacggtgaactgctttattgaagctttgggtacaatcaaaaataaaattcaaggtgccgttgcggcttcaaaagaatcagaagaattattacgtaagcaaggtatcgaagtttttagtgcaaatgatgtctctagcttagatatttatgtggatggtgcggatgaaatcaatccacaaaaaatgatgattaaaggcggcggcgcagcactcactcgtgaaaaaatcgtcgctgcattagcgaaaaaatttatttgtattgtggattcaagtaagcaagtggatgtgttgggttcaactttcccattaccagttgaagtgattcctatggcacgctcacaagtaggcagaaaattagccgcacttggtggtgcgcctgaatatcgtgaaggggtggtgactgacaacggcaatgtgattttagatgtgcacaacttcagtattttaaatccagttgaaatggaaaaagaattaaacaacgttgctggtatcgtcactaacgggatattcgcgttacgtggtgcagatgttgtgatcgtcggtacacctgaaggcgctaaaattattgactaa

SEQ ID NO: 3154 - DNA, 660 bp, Haemophilus influenzae
atgaatcaattagaaatgaaaaaactcgccgcacaagctgcattgaaatatgtaaaagcagatacaattgttggcgtgggaagtggctccacggtgaactgctttattgaggctttgggtacaatcaaagataaaattcaaggtgccgttgcggcttcaaaagcatcagaagaattattacgtaaacaaggtatcgaagtatttaatgcaaatgatgtctctagcttagatatttatgtggatggcgcagatgaaatcaatccacaaaaaatgatgattaaaggcggcggcgcagcactcactcgtgaaaaaatcgtcgctgcattagcgaaaaaatttatttgtattgtggattcaagtaagcaagtggatgtgttgggttcaactttcccattaccagttgaagtgattcctatggcacgctcacaagtaggcagaaaattagccgcacttggtggctcacctgaatatcgtgaaggcgtggtgacagacaacggcaatgtgattttagatgtgcacaacttcagtattttaaatccagtcgaaatggaaaaagaattaaacaacgttgcgggtatcgtcactaacgggatattcgcgttacgtggcgcagacgttgtaatcgttggtacgcctgaaggcgctaaaattattgactaa

SEQ ID NO: 3155 - DNA, 660 bp, Haemophilus influenzae
atggatcaattagaaatgaaaaaactcgccgcacaagctgcattagaatatgtaaaagctgacacaattgttggcgtgggcagtggctccacagtgaactgctttattgaggctttgggtacaatcaaaaataaaattcaaggcgcagttgcggcttcaaaagcatcagaagaattattacgtaaacaagggatcgaagtatttaatgcaaatgatgtctctagcttagatatttatgtggatggtgcagatgaaatcaatccacaaaaaatgatgattaaaggcggcggtgcggcacttactcgtgaaaaaatcgttgcggcattagcgaaaaaatttatttgtattgtagattctagtaaacaagtagatgtgttaggttcgactttcccattgccagttgaagttattccaatggctcgttcacaagtgggcagaaaattagtcgcacttggtggcgcacctgagtatcgtgaaggcgtggttacagataatggcaatgtgattttagatgtacacaacttcagtattttaaatccagttgaaatggaaaaagaattaaacaatgttgcaggtgtcgccactaatgggatattcgcattgcgtggcgcagatgttgtaatcgtcggcacgcctgaaggtgccaaaattattgactaa

SEQ ID NO: 3156 - DNA, 660 bp, Haemophilus influenzae
atgaatcaattagaaatgaaaaaactcgccgcacaagctgcattagaatatgtaacagctgacacaattgttggcgtgggcagtggctccacagtgaactgctttattgaagctttgggtacaatcaaaaataaaattcaaggcgtagttgcggcttcaaaagcatcagaagaattattacgtaaacaagggatcgaagtatttaatgcaaatgatgtctctagcttagatatttatgtggatggtgcagatgaaatcaatccacaaaaaatgatgattaaaggcggcggtgcggcacttactcgtgaaaaaatcgttgcggcattagcgaaaaaatttatttgtattgtagattctagtaaacaagtagatgtgttaggttcgactttcccattgccagttgaagttattccaatggctcgttcacaagtgggcagaaaattagtcgcacttggtggcgcacctgagtatcgtgaaggcgtggttacagataatggcaatgtgattttagatgtacacaacttcagtattttaaatccagttgaaatggaaaaagaattaaacaatgttgcaggtgtcgtcactaatgggatattcgcattgcgtggcgcagatgttgtaatcgtcggcacgcctgaaggtgccaaaattattgactaa

SEQ ID NO: 3157 - DNA, 660 bp, Haemophilus parasuis
atggatcaacttgagatgaaaaaaattgcagctcgtgcagctttgcaatatgttaaacctgacactattgttggtgtgggaagtggctcaactgtaaactgttttattgatgcattaggtgaaatggctggtgatattaaaggtgcagtagccgcttctaaagcatctgaagaacgtttaagagcgttaggtattgaagtatttagtgccaatgaggtgactgagcttgatgtttatattgacggtgcagatgaaattactccgcaaggctatatgattaaaggcggtggggcggcattaacgcgtgaaaaaattgtgagttcacttgcaaaaaaattcatctgtattgttgatgcaagtaagcaagtagatgtgttaggctctactttcgctctgcctgttgaggtgatcccgatggctcgttcttatgttgctcgtcaattagtagccttagggggatcgcccgaataccgtgaaagcgttgtaacagataatggcaatgtgattttagatgtgtataacttcaaaatttttgagccattaaaaatggaacataccatcaataatatcgcaggtgttgttactaacgggatttttgcacaacgttatgcgaatgtgaccatcgtaggtacgcctgatggtgcaaaaattattgaataa

SEQ ID NO: 3158 - DNA, 660 bp, Haemophilus parasuis
atggatcaacttgagatgaaaaaaattgcagctcgtgcagctttgcaatatgttaaacctgacactattgttggtgtgggaagtggctcaactgtaaactgttttattgatgccttaggtgaaatggcagataaaatcaaaggggcagtcgcagcttcaaaagcttcagaagaacgtttaagagcgttaggcattgaagtatttagtgccaatgaggtgactgagcttgatgtttatattgacggtgcagatgaaattactccgcaaggctatatgattaaaggcggtggggcggcattaacgcgtgaaaaaattgtgagttcacttgcaaaaaaattcatctgtattgttgatgcaagtaagcaagtagatgtgttaggctctactttcgctctgcctgttgaggtgatcccgatggctcgttcttatgttgctcgtcaattagtagccttagggggatcgcccgaataccgtgaaagcgttgtaacagataatggcaatgtgattttagatgtgtataacttcaaaatttttgagccattaaaaatggaacataccatcaataatattgcaggtgttgttactaacgggatttttgcacaacgttatgcgaatgtgaccatcgtaggtacgcctgatggtgcaaaaattattgaataa

SEQ ID NO: 3159 - DNA, 660 bp, Mannheimia haemolytica serotype A2 str. BOVINE
atggatcaacaagaaatgaaaaaaattgcggcacaagctgcattaaaatttgtaaaatcggacactattgttggggtgggaagtggttcaaccgtaaactgttttattgatgcccttgcttcaatgaaagatgagattaaaggagcggttgctgcctctaaagcctcggaacagcgtttgcgtgatatcggcattgaagtattcagtgccaatgaagtgacggaattagatgtgtatattgacggagctgatgaaatcacgccacaaggggcgatgattaaaggtggcggggcagcacttacccgtgagaaaatcgtgagttcattagcgaaaaaatttatctgcattgtggataaatccaaacaagttgatgtgctgggttcaactttccctctgccggtggaggtgatcccaatggctcgttcttatgtggctcgtcagctcgtagccttaggtggttcgccggaataccgtgagggcgtggtcactgataacggcaatgtgattttagatgtacataactttaaaattatggagccgttgaaaatggaacataccattaataatattgcaggcgtggtgactaacggtatttttgcacaacgttttgccaatgtaaccattgtcggcacacctgaaggtgcagttattttagaataa

SEQ ID NO: 3160 - DNA, 660 bp, Mannheimia haemolytica PHL213
atggatcaacaagaaatgaaaaaaattgcggcacaagctgcattaaaatttgtaaaaccggacactattgttggggtgggaagtggttcaaccgtaaactgttttattgatgcccttgcttcaatgaaagatgagattaaaggagcggttgctgcctctaaagcctcggaacagcgtttgcgtgatatcggcattgaagtattcagtgccaatgaagtgacggaattagatgtgtatattgacggagctgatgaaatcacgccacaaggggcgatgattaaaggtggcggggcagcacttacccgtgagaaaatcgtgagttcattagcgaaaaaatttatctgcattgtggataaatccaaacaagttgatgtgctgggttcaactttccctctgccggtggaggtgatcccaatggctcgttcttatgtggctcgtcagctcgtagccttaggtggttcgccggaataccgtgagggcgtggtcactgataacggcaatgtgattttagatgtacataactttaaaattatggagccgttgaaaatggaacataccattaataatattgcaggcgtggtgactaacggtatttttgcacaacgttttgccaatgtaaccattgtcggcacacctgaaggtgcagttattttagaataa

SEQ ID NO: 3161 - DNA, 660 bp, Actinobacillus minor
atgaaccaacaagaaatgaaaaaaattgcggcaaaggcggcattaaaattcgtcacaccggatacgattgtgggcgttggtagcggctcaacggtaaattgctttattgatgaattagcctcaatgaaagatcaaattaaaggtgcagtggcagcatcaaaagcttctgaagaacgtttaaaagcgttaggtattgaagtctttagtgccaatgaagtcagtgaacttgatgtttatattgatggtgcggatgaaattactccgcaaggttatatgatcaagggcggcggtgcggctttaacccgtgaaaaaatcgtgagttcattagcgaagaaatttgtttgtatcgtagatagctcaaaacaagtagatgtattaggttcaaccttccctttaccggttgaggttattccaatggctcgctcttatgtggctcgtcaattagtcgctttaggaggttcgccggaatatcgtgaaggcgtggtaaccgataatggcaatgtgattttagatgtgcataatttcaaaatcttagagccactaaaaatggagcatactattaacaatattgccggtgtggttaccaatggtatttttgcccaacgttttgccaatgtgacgattgtcggcacgcctgaaggggcaaaaatccttgaataa

SEQ ID NO: 3162 - DNA, 660 bp, Actinobacillus minor
atgaaccaacaagaaatgaaaaaaattgcggcaaaggcagcattaaaattcgtcacaccggatacgattgtgggcgttggtagcggttcaacggtaaactgctttattgatgaattagcctcaatgaaagatcaaattaaaggcgctgtggcggcatcaaaagcctctgaagaacgtttaaaagcgttaggtattgaagtctttagtgctaatgaagtcagtgaacttgatgtttatattgatggtgcagatgaaattacaccacaaggttatatgatcaagggcggcggtgcggctttaactcgtgaaaaaatcgtgagttcattagcgaagaaatttgtttgtatcgtggatagctcaaagcaagtggatgtattaggctcaatcttcccattacccgttgaggttattccaatggctcgctcttatgtggctcgtcaattagtcgctttaggtggttcaccggaatatcgtgaaggcgtggtaaccgataatggcaatgtgattttagatgtacataatttcaaaattttagaaccactaaaaatggagcataccattaacaacattgcgggtgtggttaccaatgggatatttgcccaacgttttgccaatgtgacgattgtcggcacgcctgaaggggcaaaaatccttgaataa

SEQ ID NO: 3163 - DNA, 660 bp, Actinobacillus pleuropneumoniae
atgacccaacaagaaatgaaaaaaattgccgctcaagctgcgcttcaattcgtcaaaccggataccatcgtgggggtgggtagcggttctaccgtaaactgttttatcgatgcgttagcctctatgaaagatcaaattaaaggtgcggttgccgcctccaaagcgtccgaagaacgtttacgtgcgatcggcatcgaagtattcaatgcaaatgaagtcagcgaattggacgtttatatcgacggtgcggatgaaattacccctcaaggcgcaatgattaaaggcggcggtgcggcattaacccgagaaaaaatcgttagctcgctggcgaaaaaattcgtttgtatcgtggacggttcaaaacaagtggacgtattaggcacaaccttcccgttaccggtcgaagtgatcccgatggcacgttcgtatgtcgcccgtcaattagtggcattaggcggttcgccggaataccgtgaaggcgtggtcaccgataacggtaatgtaattttagacgtgcataatttccacattatcgaaccgcttaaaatggaacataccatcaataacatcgccggtgtggttaccaacggtatctttgcgcaacgctatgcgaacgtaaccattgtcggtacgccggaaggtgcgaaaattattgaataa

SEQ ID NO: 3164 - DNA, 660 bp, Actinobacillus pleuropneumoniae
atgacccaacaagaaatgaaaaaaattgccgctcaagctgcgcttcaattcgtcaaaccggataccatcgtgggggtgggtagcggttctaccgtaaactgttttatcgatgcgttagcctctatgaaagatcaaattaaaggtgcggttgccgcctccaaagcgtccgaaggacgtttacgtgcgatcggcatcgaagtattcaatgcaaatgaagtcagcgaattggacgtttatatcgacggtgcggatgaaattacccctcaaggcgcaatgattaaaggcggcggtgcggcattaacccgagaaaaaatcgttagctcgctggcgaaaaaattcgtttgtatcgtggacggttcaaaacaagtggacgtattaggcacaaccttcccgttaccggtcgaagtgatcccgatggcacgttcgtatgtcgcccgtcaattagtggcattaggcggttcgccggaataccgtgaaggcgtggtcaccgataacggtaatgtaattttagacgtgcataatttccacattatcgaaccgcttaaaatggaacataccatcaataacatcgccggtgtggttaccaacggtatctttgcgcaacgctatgcgaacgtaaccattgtcggtacgccggaaggtgcgaaaattattgaataa

SEQ ID NO: 3165 - DNA, 660 bp, Haemophilus ducreyi
atgactcaacaagaaatgaaaaaaattgcggctcaagctgctcttcaatttgttaaaccagatacgataatcggtgtaggaagtggttccactgtcaattgctttattgatgcccttgcctcaatcaaagatgagattaaaggtgccgtagcggcctctaaagcatcagaggatcagttgcgtgcaatgggtattgaggtgtttaacgctaatgaagttgcgggattagatgtatatattgatggtgctgatgaaatcacgccacaaggtgcaatgataaaaggtggcggcgcagcattaacgcgtgaaaaaatcgtcagttcgcttgctaaacaatttatctgtatggtcgatagttcgaaacaagttgacgtattaggttctagttttccattgccggtggaagtgatcccgatggctcgttcgtatgttgcccgccaactagttgccttaggtggatcacccgaatatcgcgaaggtgttgttactgataatggcaatgttattttagatgtgcataattttaatatttatgaaccgcttaaaatggaacacactattaataatattgctggcgtagtaaccaatggtatttttgcgcaacgttatgccaatatcatcattgtaggcacagctgaaggtgcaaaaattatcaaatag

SEQ ID NO: 3166 - DNA, 660 bp, Tolumonas auensis
atgacccaggacgaaatgaagaaagcggtaggacaggctgctttagcttatgtacaacccaacaccattattggtgtaggtaccggttcaaccgttaattgctttattgatgcactggccagcatcaaagatcagatcaaagccgcagtatccagctccgaagcctctacagcccgtctgcaggcgctgggaattacggttgttgatctgaatgatgtgactgaatttgatatttatgtcgacggtgccgacgagatcaatccgcatatggaaatgatcaaaggcggtggtgccgcactgacccgtgagaaaatcgtcgcggcggttgcaaaacgttttatctgtatcgctgatgccaccaagcaggttgaggtaatgggtaaatttccattgccggtagaagtgatcccgctggcccgcgaatatgtcgcacgtgaactgcggaaactgggtggtaatccggtataccgtgaaggtgtgatcaccgataaccagtgccagatcctggatgtacatggtctgcagatcacgaatgcgaaagcattggagctggttataaaccagatccctggcgttgtgactgtaggtttatttgctcagcgcggtgctgatgttgccctgatcggttcaccagatggtgttaccacgatcaccaagtaa

SEQ ID NO: 3167 - DNA, 675 bp, Pseudomonas putida
atgacccaggaccaactcaaacaggccgtcgcccaggccgctgtcgacttcattctgcccaagctggatgaaaagagcgtcgtaggcgtcggtaccggttcgaccgccaacttcttcatcgatgccctggctcagcacaagaccgcgttcgacggcgcagtcgccagctccgaagccactgcccagcgcctgaagggccatggcatcccggtctacgaactgaacagcgtaagcgagcttgagttttacgtggacggtgccgacgagagcgacgcacacctgcacctgatcaagggcggcggcgcagcgctgacccgcgaaaagatcgtcgcggccgtggccaagaccttcatctgcatcgccgacggcagcaagctggtgccggtactgggggccttcccgctgccggtcgaagtgatccccatggcccgcagtcacgtggcgcgtcagctggtgaagctgggtggcgacccggtgtaccgtgaaggcgtggtcaccgacaacggcaacgtgatcctggatgtgtacaacctgcagatcaccaacccggtggagctggaagcgcagatcaacgccatcgtcggcgtggtgaccaacggcctgttcgcggcgcggccggcggatctgctgctgctgggcaccgctgaaggcgtgaagagcctgaaggccgagtaa

SEQ ID NO: 3168 - DNA, 675 bp, Pseudomonas putida
atgacccaggaccaactcaaacaggccgtcgcccaggccgctgtcgacttcattctgcccaagctggatgaaaagagcgttgtcggcgtcggtaccggttcgaccgccaacttcttcatcgacgccctggctcagcacaagaccgccttcgacggcgcagtcgccagctccgaagccactgcccagcgcctgaagggccatggcatcccggtgtacgagctgaacagcgtcagcgagcttgagttctacgtggacggcgccgacgaaagcgacgcgcacctgaacctgatcaagggcggcggcgcagccctgacccgcgagaagatcgtcgcggccgtggccaagaccttcatctgcatcgccgacggtagcaagctggtgcccgtgctgggcgccttcccgctgccggttgaagtgatcccgatggcccgcagccacgtggcgcgccagctggtcaagctgggcggcgacccggtgtaccgcgaaggcgtggtcaccgacaacggcaacgtgatcctcgacgtgcacaacctgcagatcaccaacccggtggagctggaagcgcagatcaacgccatcgttggcgtggtcaccaacggcctgttcgcggcgcgaccggcggacctgctgctgctgggcacctctgaaggtgtgaagagcctgaaggccgagtaa

SEQ ID NO: 3169 - DNA, 675 bp, Pseudomonas putida
atgacccaggaccaactcaaacaggccgtcgcccaggccgctgtcgacttcattctgcccaagctggatgaaaagagcgtcgtcggcgtcggcaccggttcgactgccaatttcttcattgacgccttggcccagcacaagacggcgttcgacggcgcggtcgccagctccgaggccactgcacagcgtctgaagggccatggcatcccggtctatgagctgaacagcgtcagcgagctggagttctacgtcgacggcgccgacgagagcgacgcacacctgaacctgatcaaaggcggtggcgcggcactgacgcgggagaaaatcgtcgcggccgtggccaagaccttcatttgcatcgccgatgccagcaagctggtgccggtgctgggcgccttcccgctgccggtcgaggtcatcccgatggcccgcagccacgtggcgcgccaactggtcaagctgggcggagacccggtgtaccgtgagggtgtggtcaccgataacggcaacgtgatcctggatgtgtacaacctgcagatcaccaaccccgtggagctggaagcgcagatcaatgcgatcgtcggcgtggtgaccaatggcctgtttgccgcacggccggcagacttgctgttgctgggcaccccggaaggcgtgaagagcctgaaagccgagtga

SEQ ID NO: 3170 - DNA, 675 bp, Pseudomonas entomophila L48
atgacccaggaccaactcaaacaggccgtcgcccaggccgccgtcgacctcatcctgcccaagctggatgaaaaaagcgtcgtcggcgttggcaccggttccaccgccaacttcttcatcgacgccctggcccagcacaagaccgccttcgacggcgccgtcgccagttccgaggccaccgcccagcgtctgaagggccatggcatcccggtctacgagctgaacagcgtcagcgagctggagttctacgtggatggcgccgacgagagcgacgctcacctgaacctgatcaagggcggcggcgcggccctgacccgcgagaagatcgtcgcggcggtggccaagaccttcatctgcatcgccgacgccagcaagctggtgccggtactgggtgccttcccgctgccggtcgaggtcatccccatggcccgcagccacgtggcgcgccagctggtcaagctgggcggcgacccggtctaccgcgagggtgtggtgaccgacaacggcaacgtcatcctcgacgtgcacaacctgcagatcaccaacccggtggagctggaaagccagatcaacgccatcgtcggcgtggtcaccaacggcctgttcgcggcacggccggcggatgtgctgctgctgggcaccgccgaaggcgtgaagaccctcaaggccgagtaa

SEQ ID NO: 3171 - DNA, 672 bp, Pseudomonas fluorescens
atgacccaggatcaactcaaacaggcagtggcccaggccgccgtcgatttaatccttcctaaactcgacgacaaaagcatcgtcggtgtcggcaccggctccaccgccaactgctttatcgatgcgctggcccagcacaagggcgcgttcgacggcgccgtggccagctccgaagccaccgccgctcgcctcaagggccacggcattccggtgtatgagctcaacaccgtgagcgacctggagttctacgtcgacggcgccgatgaaagcgacgaacacctgaacctgatcaaaggcggcggcgcagccctgacccgcgagaagatcgtcgcggccgtggccaagacctttatctgcatcgccgacgccagcaagctggtgccggtcctcggcgcgttcccgctgccggtggaagtgatcccgatggcccgcagccacgtggcccgcgagctggtgaaactgggcggcgacccggtgtaccgcgaaggcgtgttgaccgacaacggcaacatcatcatcgacgtgttcaacctgcagatcaccaacccggtagagctggagacgcagatcaacgcgatcgtcggcgtggtcaccaacggcttgttcgcggcgcgcccggcggatgtgctgttgctcggcacctctgaaggcgtgaaaaccctcaaggcctga

SEQ ID NO: 3172 - DNA, 675 bp, Pseudomonas fluorescens
atgacccaggatcaactcaaacaggccgtggcccaggccgccgtcgacttcatccttccgaaactcgacgacaagagcatcgtcggtgtcggcaccggctccaccgccaactgcttcatcgacgccctggcccagcacaagggcgcgttcgatggcgcggtcgcgagctccgaagccaccgccgcgcgcctcaagggccacgggattccggtgtacgagctgaacaccgtgagcaacctggagttctacgtcgacggcgccgatgaaagcgacgaacacctgaacctgatcaagggcggcggcgcagccctgacccgcgagaagatcgtcgcggccgtggcccagaccttcatctgcatcgccgacgccagcaaactggtgccggtgctgggcgcgttcccgctgccggtggaagtgatcccgatggcccgcagccacgtggcccgccaactggtaaaactgggcggcgacccggtctaccgcgaaggcgtgctgaccgacaacggcaacatcatcctcgacgtgcacaacctgcagatcaccaatccggtggagctggaagcgcagatcaacgcgatcgtcggcgtggtcaccaacggcctgttcgcggcgcgtccggcggatttgttgttgctgggtacttccgaaggtgtgaaaacactgaaggctgagtaa

SEQ ID NO: 3173 - DNA, 672 bp, Pseudomonas fluorescens
atgacccaggatcaactcaaacaggccgttgcccaggccgccgtcgaccttatcctcccgaaactcgatgacaagagcatcgtcggggtcggcaccggctccaccgccaactgcttcatcgacgccctggccctgcacaagggcaccttcgacggcgccgtggccagctccgaagccaccgccgcgcgcctcaagggccacgggattccggtctacgagctcaacaccgtgagcgacctggagttctacatcgacggcgccgacgaaagcgacgagcacctgaacctgatcaagggcggcggcgccgccctgactcgggaaaagatcgtcgccgccgtggccaagacgttcatctgcatcgccgacgccagcaagctggtgccggtgctgggcaacttcccgctgcccgtggaagtgatccccatggcccgcagccacgtggcccgtgaactggtgaaactgggcggcgacccggtgtaccgcgaaggcgtgatcaccgacaacggcaacatcatcctcgatgtgcacaacatgcagatcaccaatccggtggaactggaaagccagatcaatgccattgtcggcgtggtcaccaatggcctgttcgctgcacgccccgctgatgtgctgctgctgggtaccgccgaaggggtgaagaccctcaaggcctga

SEQ ID NO: 3174 - DNA, 672 bp, Pseudomonas syringae
atgacccaggatcaactcaaacaggcagtcgcccaagcagctgtcgacttcatccttccgaagctcgatgacaaaagcattgtgggcgtcggcaccggctccacggccaattgctttattgatgcgctggctaaacacaaggcggcattcgatggcgcagtcgccagctcggaagctaccgccgcgcgcctcaagggccatggcattccggtgtatgagctgaacacggtcagcgacctggagttctatgtcgatggtgccgacgaaagcgacgagcacctgaacctgatcaagggcggcggcgcggcactgactcgcgagaaaatcgtcgcggccgtggccaagaccttcatctgtatcgccgacggcagcaagctggtgccggtgctgggcgcgttcccgctgccggtcgaagtcattccgatggcccgcagccacgttgcgcgacaactggtgaaactgggcggcgacccggtttatcgcgaaggtgttctaaccgacaacggcaatatcatcattgatgtgcacaacatgagcatcaccaatccggtggagctggaagcacagatcaacgccatcgtcggcgtggtcaccaatggcctgttcgccgcccgtccggccgacctgttgctgctgggcaccaccgaaggcgtgaaaaccctgacgcgctga

SEQ ID NO: 3175 - DNA, 672 bp, Pseudomonas syringae
atgacccaggatcaactcaaacaggcagtcgcccaggcagctgtcgacttcatccttccgaagctcgatgacaaaagcattgtgggcgtcggcaccggctccacggccaattgctttattgatgcgctggctaaacacaaggcggcattcgatggcacagtcgccagctcggaagctaccgccgcgcgcctcaagggccatggcattccggtgtatgagctgaacacggtcagcgatctggagttctatgtcgacggagccgacgaaagcgacgagcacctgaacctgatcaagggcggcggcgcggcactgactcgcgagaaaatcgtcgcggccgtggccaagaccttcatctgcatcgccgacggcagcaagctggtgccggtgctgggcgcgttcccgctgccggtcgaagtcattccgatggcccgcagccacgttgcgcgacaactggtgaaactgggcggcgacccggtttatcgcgagggcgttctgaccgacaacggcaatatcatcattgatgtgcacaatatgagcatcaccaatccggtggagctggaagcacagatcaacgccatcgtcggcgtggtcaccaatggcctgttcgccgcccgtccggccgacctgttgctgctgggcaccaccgaaggcgtgaaaaccctgacgcgctga

SEQ ID NO: 3176 - DNA, 672 bp, Pseudomonas syringae
atgacccaggatcaactcaaacaggcagtcgcccaagccgctgtcgatttcatccttccaaagctcgacgacaagagcattgtgggcgtcggcaccggttccacagccaactgcttcattgatgcactggccaaacacaagggtgcgttcgacggcgcagtcgccagctccgaagccaccgctgcacgcctcaagggccacggtattccggtctatgagctgaacaccgtcagcgacctggagttctacgtcgatggcgccgatgaaagcgacgagcatctgaacctgatcaagggcggcggtgcagcgctgactcgcgagaagatcgtcgcggcagtggccaagaccttcatctgcatcgccgacggcagcaagctggtgccagtgctgggcgcattcccgctgccggttgaagttgtgccgatggcgcgcagccacgttgcgcggcaactggtgaagctgggcggcgacccggtctaccgtgaaggcgtgctgaccgacaacggcaatatcatcatcgacgtgcacaatatgagcatcaccaacccggtagagctggaagcgagcatcaacgccatcgtcggcgtggtcaccaacggcctgttcgccgctcgcccggctgacctgctgctgctgggcaccgccgaaggcgtgaagaccctaacacgctga

SEQ ID NO: 3177 - DNA, 672 bp, Pseudomonas syringae
atgacccaggatcaactcaaacaggcagtcgcccaagccgctgtcgatttcatccttccaaagctcgacgacaaaagtatcgtgggcgtcggcaccggctccacggccaactgcttcatcgatgcgctggcaaagcacaaggcagcgttcgacggcgcggttgcgagctcggaagctaccgctgcgcgcctcaagggccatggtattccggtttatgaactgaacactgtgagtgatctggagttctacgtcgacggtgccgatgagagcgatgagcatctgaacctgatcaagggcggcggcgcggcgctgactcgcgagaaaattgtcgcggcggtggccaaaaccttcatctgcatcgccgatggcagcaagctggtgccagtgctgggcgcattcccgctgccggtcgaagtcattccgatggcccgcagccacgtcgctcggcaactggtgaaactgggcggtgatccggtttaccgggaaggcgtgctgactgacaatggcaatatcatcatcgacgtccacaacatgagcattaccaacccggtggagctggaagccagcatcaatgccatcgtcggcgtggtcaccaacggtctgttcgcagcccgtccagcagacttattgctgctgggcaccgatgaaggcgtgaagactctgaagcgctga

SEQ ID NO: 3178 - DNA, 672 bp, Pseudomonas syringae
atgacccaggatcaactcaaacaggcagtcgcccaggcagctgtcgacttcatccttccgaagctcgatgacaaaagcattgtgggcgtcggcaccggctccacggccaactgcttcatcgacgcgctggcaaagcacaaggccgcctttgacggtgctgtcgccagctcgcaagccactgcggcgcgcctgaaggcgcacggcattccggtctatgagctgaacacggtcagcgatctggagttctatgtcgacggcgccgacgaaagcgacgagcacctgaatctgatcaagggcggcggcgcggcactgactcgcgaaaaaatcgtcgcggcggtggccaataccttcatctgcatcgccgacggcagcaagctggtgccagtgctgggcgcgttcccgctgccggtcgaagtcattccgatggcccgtagccacgtggcgcggcaactggtgaaactgggcggcgacccggtttatcgcgaaggtgttctgaccgacaacggcaacatcatcattgatgtgcacaacatgagcattaccaacccggtggagctggaagcgcagatcaacgccatcgtcggcgtggtcaccaatggcctgttcgccgcccgtccggccgacctgttgctgctgggtaccgctgaaggcgtgaaaaccctgacgcgctga

SEQ ID NO: 3179 - DNA, 714 bp, Pseudomonas mendocina
gtggatggctataattgcgcttttcccgtccggcagaactccatgacccaggatcagctcaagcaggcggtggcccaggccgccgtcgaccacattctcccgcgcctcgacagcaagagcatcgtcggcgtcggcactggctccaccgccaacttcttcatcgacgcgttggccaggcacaagatggacttcgacggcgccgtggccagctccgaagccacggccgcccgcctcaagggccatggcatcccggtctacgacctcaacagcgtcagcgagctggagttctatgtcgatggcgccgacgagagcgacgagcgcctgcacctgatcaagggcggcggcgccgcgctgacccgcgagaagatcgtcgccgccgtggccaagaccttcatctgcatcgccgatgccagcaagctggtgccggtgctcggcgccttcccgctgccggtggaggtgatccccatggcccgcagccacgtggcccgcgagctggtgaagctgggcggcgacccggtgtaccgcgagggcgtgctgaccgacaacggcaacgtcatcctcgacgtgcacaacctgtcgatcaccgacccggtgaagctggaggcggacatcaacgccatcgtcggcgtggtcaccaacggcctgttcgccgcccgcccggccgacctgctgctgctcggcaccgccgaaggcgtgaaaacgctcaagcgctga

SEQ ID NO: 3180 - DNA, 672 bp, Peudomonas aeruginosa
atgaaccaggatcagctcaagcaggcagtggcacaggccgccgtcgaccacattcttccgcacctcgacagcaagagcatcgtcggcgtcggcacaggctccaccgccaacttcttcatcgatgccctggcccgccacaaggccgagttcgacggcgcagtagccagttcggaggccaccgccaagcgcctgaaggagcatggcatcccggtctacgagctgaacacggtcagcgagctggagttctacgtcgacggcgccgacgaaagcaacgagcgcctggagctgatcaagggcggcggtgccgcgctgacccgcgagaagatcgtcgccgcggtggccaagaccttcatctgcatcgccgatgccagcaagctggtgcccatcctcggccagttcccgctgccggtggaggtcatcccgatggctcgcagccacgtcgcccgccaactggtgaagctcggcggcgatccggtctaccgcgaaggcgtgctgaccgacaacggcaatatcatcctcgacgtgcacaacctgcgcatcgacagcccggtggaactggaagagaagatcaacgccatcgtcggcgtggtcaccaacggcttgttcgccgcccgcccggccgacctgctgctactcggcaccgccgacggcgtcaagaccctcaaggccgga

SEQ ID NO: 3181 - DNA, 672 bp, Pseudomonas aeruginosa
atgaaccaggatcagctcaagcaggcagtggcacaggccgccgtcgaccacattcttccgcacctcgacagcaagagcatcgtcggcgtcggcacaggctccaccgccaacttcttcatcgatgccctggcccgccacaaggccgagttcgacggcgcagtagccagttcggaggccaccgccaagcgcctgaaggagcatggcatcccggtctacgagctgaacacggtcagcgagctggagttctacgtcgacggcgccgacgaaagcaacgagcgcctggagctgatcaagggcggcggtgccgcgctgacccgcgagaagatcgtcgccgcggtggccaagaccttcatctgcatcgccgatgccagcaagctggtgcccatcctcggccagttcccgctgccggtggaggtcatcccgatggctcgcagccacgtcgcccgccaactggtgaagctcggcggcgatccggtctaccgcgaaggcgtgctgaccgacaacggcaatatcatcctcgacgtgcacaacctgcgcatcgacagcccggtggaactggaagagaagatcaacgccatcgtcggcgtggtcaccaacggcttgttcgccgcccgcccggccgacctgctgctactcggcaccgccgacggcgtcaagaccctcaaggcctga

SEQ ID NO: 3182 - DNA, 672 bp, Pseudomonas aeruginosa
atgaaccaggatcagctcaagcaggcagtggcacaggccgccgtcgaccacattcttccgcacctcgacagcaagagcatcgtcggcgtcggcacaggctccaccgcgaacttcttcatcgatgccctggcccgtcacaaggccgagttcgacggcgccgtggccagctcggaggccaccgccaaacgcctgaaggagcatggcatcccggtctacgaactgaacacggtcagcgagctggagttctacgtcgatggcgccgacgagagcaacgagcgcctggagctgatcaagggcggcggcgccgcgctgacccgcgagaagatcgtcgccgcggtggccaggaccttcatctgcatcgccgacgccagcaagctggtgcccatcctcggccagttcccgctgccggtggaagtcatcccgatggcccgcagccacgtcgcccgccaactggtgaagctcggcggcgacccggtctaccgcgaaggcgtgctgaccgacaacggcaatatcatcctcgacgtgcacaacctgcgcatcgacagcccggtggaactggaagagaagatcaacgccatcgtcggcgtggtcaccaacggcctgttcgccgcccgcccggccgacctgctgctgctcggcaccgccgacggcgtgcagaccctcaaggcctga

SEQ ID NO: 3183 - DNA, 672 bp, Pseudomonas stutzeri
atgacccaggaccagctcaagcaggccgtcgcccaggccgctgtcgaccatatccttcccaagctcaacgatcgcagcatcgttggcgtcggtaccggctccaccgccaacttcttcatcgacctgctggccaagcacaagggcttcttcgacggtgccgtggccagttccgaagccaccgccgaacgtctcaagcagcacggcattccggtctacgacctgaactcggtgagcgaactggagttctacgtggatggcgccgacgaggcgaacaagcacctggagctgatcaagggcggcggcgcggcactcacccgcgagaagatcgtcgcggcggtggccaagaccttcatctgcatcgccgatggcagcaagctggtcgagcagctgggcgcctttccgctgccggtggaggtcatcccgatggcgcgcagccatgtggcgcgcgagctggtcaagctcggcggcgacccggtctaccgcgacggcgtggtgaccgacaacggcaacgtcatccttgacgtgcacaacctgatgatcggcttcgccccggagctggaaggcaagatcaacgacatcgtcggcgtggtcagcaacggcctgttcgccatgcgcccggccgacctgctgctgctcggcacccaggacggcgtgcagaccctcacgcgctga

SEQ ID NO: 3184 - DNA, 681 bp, Azotobacter vinelandii
atgacccaggaccagctcaagcaggccgtggcccaggccgccctcgaccacatccttccgcagctcactcggcagagcatcatcggcgtcggcaccggctccaccgccaatttcttcatcgacctgctggctcgctaccggatggacttcgatggcgccgtggccagttccgaagccaccgccgcccgcctgaaaggccacggcatcgaagtgcacgatctgaacaacgtcgtcgaactggagttctacgtggacggcgccgacgagtgcaacaagcatctggagctgatcaagggcggcggcgccgcgctgacccgcgagaagatcgtcgccgcggtggcccggaccttcatctgcatcgccgacgagagcaagcgggtcgattttctcggcgacttcccgctgccggtggaggtgattcccatggcccgcagccatgtggcgcgccaactggtcatgctgggcggcgacccggtctaccgcgaaggcgtggtgaccgacaacggcaacgtgatcctcgacgtgtacaacatgcagatcaccaaccccagacaactggagtcggacatcaacaacatcgtcggagtggtctgcaacgggctgttcgccgcgcgtccggccgacctgctgctgctcggcacccgcaacggggtggagcgcatcgagcgcccgcgccgctga

SEQ ID NO: 3185 - DNA, 675 bp, Azotobacter vinelandii
atgattcaggatcagcttaagcaggccgtggctcaggccgccctcgatcacatcctgccgcatctcacgcggcagagcatcgtcggcgtcggcaccggctccaccgccaacttcttcatcgacctgctggcccgccaccggatggacttcgacggcgccgtggccagttccgaggctactgccgcccgtctgaggagccatggcatcgaagtgcacgacctgaacagcatcgccgagctggagttctacgtggacggtgccgacgagtgcaacgggcacctggagctgaccaagggcggcggtggcgcgctgacccgcgagaagatcgtcgccgcggtggccaaaaccttcgtctgcatcgccgacgagagcaagcgcgtcgattttctcggcggtttcccgctgccggtggaggtgatccccatggcccgtggccacgtggcgcgccaactggtcatgctgggcggtaacccggtccatcgcgaaggggtggtgaccgacaacggcaacgtgattctcgacgtgtacgacatgcggatcatcgaccccaggcaattggagtcggatatcaacggcatcgtcggggtggtctgcaacggtctgttcgccgcgcgcccggccgacctgctgttgctcggcacccataacggggtcgaaaagtttggacgtcggtaa

SEQ ID NO: 3186 - DNA, 675 bp, Marinobacter sp. ELB17
atgaaccaggacgaactgaagcaagcggtcgccaaatccgctatcgactacatcagcccacgcctgaacagcagcagcgtaattggtgtgggcaccggcagcactgccaactgcttcattgattttctggcggccattcgcaacgattttgacggcgccgtggccagctccgaagccaccgctgaacgcttgaaaagccacggcattcccgtttatgagctgaacagcaccgccgatctggagttttatgtagacggcgccgatgaagtcaacgaacagctggaactgatcaaaggcggcggcggcgcgctaacgcgggaaaagattgtggctgaagtggcgcagacgtttatctgcatcgccgacgagtccaaaaaagtagacattctgggtgaattcccactgccactggaagtgttaccgatggcccgcagccacgttggccgggaaatcgtgaaacttggcggcgatccggtgtaccgcgacaattttaccaccgacaatggcaacatcattattgacgtctataacctggacctgtcgcgcccaattcaggtggaagaacgcctgaaccagattgtaggtgtggtcaccaacggcctgtttgcccgccgccccgccgatcttctgctgctgggcacaaaaaccggtgtacggactctcaagcgcggctga

SEQ ID NO: 3187 - DNA, 681 bp, Marinobacter algicola DG893
atgaatcaggacgaactgaagaaagccgtcgccaaggccgcactggaccatatcaggccgcacctggatcaggagagcgttatcggcgtgggtaccggcagtacggctaactgtttcatcgatctgctggcggatatccgcaccgatttcgatggtgcggtcgccagttccgacgccacggcagagcgcctgaaaagccatggtattccggtatacgatctcaacagtgccgggccactggagttttatgtcgacggtgccgatgaaaccaatgaacgcctggaactgatcaagggcggcggtggcgccctgacccgggaaaagatcgtggcggcagtggccaagacgtttatctgcattgccgatgggtccaaggaggtggacatcctgggcgcgtttccgcttccggttgaagtggtgcccatggcccgcagtcatgttggccgcgaaatcgtcaagctgggcggcgacccggtttatcgtgagggttttaccaccgacaacggcaatatcattctggatatccacaatctggatatttcccgcccgattcaggtggaagagcagttgaacaatattgtaggcattgtgaccaatgggctgtttgcgcgacggcctgcggatttgttgttgcttggtactgaagatggggtaaagacgatctcccgcaaggatggctaa

SEQ ID NO: 3188 - DNA, 678 bp, Marinobacter aquaeolei VT8
atgacccaggacgaactgaaacaagccgttgccaaagctgcagtggatcacatcgcacctcacctggaaccgagcagcattgtcggggtgggcaccggcagcaccgccaactttttcatcgactacctggccgagtaccgcaacgacttcgacggtgccgtcgcaagctccgaggcgaccgctgaacggctgaaaaaacacggcatcccggtgtatgacctcaacgccgtcaacgaaatcgagttttacgtcgacggtgccgacgaaaccaatgaaagcctggaactgatcaaaggcggtggcggcgccctaacccgggaaaagattgtggccgccgtcgccaagacctttatctgcatcgccgatgagtccaagcaagtcggcatcctgggcgaattcccgctgcccgtggaagttatccccatggcccgcagccatgtcggccgcgagattgtaaaactcgggggcgacccggtttaccgggacggttttgtcactgacaacggcaacatcatcatcgacatccacaacatggatatctcccgcccgctggtggtggaagaaaagctcaataacattgtcggcgtggtcaccaacggactgttcgcccgccgcccggccgacctgctgctactcggcacccgtgacggggtgaaaagcattgcccgcggtgcataa

SEQ ID NO: 3189 - DNA, 678 bp, Bermanella marisrubri
atgaatcaggatcaactcaagcaagcagtcggccaagctgctgtggattacatcaagccgcatctacaaaaagatagcattattggcgtaggcacaggtagcacagcaaattgctttattgatgcccttgcagaactaaagaatgattttgatggcgccgttgccagttccgaggcgaccgctgaaagactaaaaagccatggcattcccgtctatgacttgaattcctctggcactctcgacttttacattgatggtgccgacgaaaccaacgatcacctacagttaattaaaggcggtggtggtgcactaactcgggaaaaaatcgtcgccgcctgtgctaaagaatttatctgtatcgctgatgaaagcaaatgggtcgacttattgggcacattccctttgccggttgaagtcattcccatggcccgttcatatgttgctagagagttggttgctttagggggcgacccggtttaccgccaaggcttcgtaaccgataacggtaatgtcattcttgatgtacacaatatgagtattcaaagcgccacggcattggaggagcgcattaataatattgtgggcgtggtcaccaatggtttatttgcttgtcgacctgctgatgttttattaatgggtacggcagatggtgtcaaaaccatcaaggctaagaactga

SEQ ID NO: 3190 - DNA, 678 bp, Hahella chejuensis KCTC 2396
atgaaccaggacgaattaaagcaggcagtcgcaaaagcggcgctggactatatcaaaccccacctgcagtcggacaccattctcggcatcggcacaggctctactgccaactacttcatcgacgcgcttgcggaagtaagaacccagttcgagggcgcagtggccagctcagaagcctccgcagaacgcttgaagaagcataatattcccgtatacgagcttaactccgtttccggtctggagttctatatcgacggtgctgacgaaaccaacccacgcctggagttgatcaaaggcggcggcgccgcgttgacgcgagagaaaattgtcgccgccaacgccaaaacctttatctgtatcgctgacgaatccaaatgggtggacgtacttggcgatttcccattaccaatagaagttatccccatggcgcgcagctatgtagcaagggaattggttaagctgggcggcgacccggtctaccgcgaaggctgtgtgacggataatggcaatattattctggacgtgttcaacctgcgtattctggagcccgtaaaactggagcaacagatcaatcaaatcaccggcgtagtgaccaacggcttgttcgccatgcgtcctgctgatgtgcttctgctgggatcacaagaaggtgtaaaaactatcaaggttgacgcctga

SEQ ID NO: 3191 - DNA, 672 bp, Marinomonas sp. MWYL1
atgactcaagatgaattaaaacaagccgttgctaaagccgctatggcttacattcaacctatgttagaagctgacactatcgtcggtgttggcacaggctcgacagcaaatctattcattgatgaattagctaaacacaaaggcttatttgacggtacagtagcaagctctgaagcgtcagcagaacgcttaaaaaaacatggcattcctgtctatgatctaaacagcgttgacagtattcgcgtgtatgttgatggtgcagatgaatcaaatgacaacctacatttgatcaaaggtggcggcgcagcgctaacacgtgaaaaaatcgtagcggcttgcagtgatgagtttgtctgtattgcagacgaatctaaactggtaaaagttctgggagacttccctcttccggttgaaatcattccaatggcacgcggccatgttgcgcgcgaactagtgaaattgggcggtgacccagtttatcgtgaaggagtggtaaccgacaacggtaaccatattcttgacgtctacaatctagaaattctagatccaatcgcactggaaaaaagcatcgacggcattgtcggcgtagtgacgaatgggttattcgcgaaacgctctgcagacgttttgttattagcaacgaaagaaggtattaaaacactgaaaaaatag

SEQ ID NO: 3192 - DNA, 672 bp, Marinomonas sp. MED121
atgacgcaagacgaattgaaactcgccgttgccaaagccgcggttgaatacatacttccccttcttgaagacgacaccattgtcggtgtaggaacaggctcaacagcgaacctattcattgacgagctcgctcagcacaaacttaagtttgaagcgactgtggccagctctgaagcgtcagcagaacgccttaagtctcacggcattcctgtatatgatttaaacagtgttgcagatatcgcagtttatgtagatggggctgacgaatctaacaaccacctgcatttgattaaaggtggcggtgccgcactgactcgcgagaaaatcgttgcagccgtcagtaagcagtttgtttgtattgctgaccaatctaaattggtaaatgtgttgggcgacttcccactacccgttgaagtgattcctatgtcacgtagctatgttgctcgtgaattagtgaagcttggcggtgacccggtttaccgcgaaggtgtcgtgacagataacggtaaccaaattttagatgtgtataacctaaaaattgaagatgctgttgctctagaaaataagatcaatagtctagtaggtgtggtaactaacggcttattcgctagccgccctgctgatgttttgctactaggcacagaagaaggtgttaagactttaaaagcctaa

SEQ ID NO: 3193 - DNA, 693 bp, Congregibacter litoralis KT71
atggatcaggacagtctcaaactcaaggtcgcccgggctgccctggatattgtgcaacccggtcttgagtccggcacggtgctgggtattggtacaggctcaacggcaaacatgtttatcgatttgctgggagaggtcgctcacctctttgatggcgccgttgccagctccgaagccagcgccgagcgtctcaaatcccacaacattcccgtctatgacctcaatgccgtggatcgaatatcggtctatgtggatggcgccgacgagtgcaacgaagcgcttcagttaatcaaagggggcggtgcggccctcacccgggagaagattgttgccgccgtggccaaggagttcatctgcattgccgatgagagtaaatgggtgccggtgctgggggcattcccccttcccgtggaggtgattcccatggcccgcagtcatgttgcccgggagatcgttaaactgggcggcgaccccatccttcgcgagggggtggtgacggacaacggcaacgtgatcctggatgtttacaatttttccatcgcccagcccctggccatggaagcccggatcaacggcatcgtcggtgttgtctgcaacggtctctttgccctgcgccccgccgaccgcctgctcctgggaaccgcagacggcgtgcgcgatctcaggcgtccagcatcttccctggattcataa

SEQ ID NO: 3194 - DNA, 693 bp, unknown
  gamma proteobacterium NOR5-3
atggatcaggacagcctcaagctgagcgttgccaaggcagcactcgacatcattgtgccgcagctcgaacccgacaccatattgggaattggaaccggctctaccgccaatatgtttattgatctgctggccgatgtcgcgcacctctttgatggcgccgtcgccagctcgcaggcaagtgccgagcgcctcaaaagtcacaacattccggtgtatgacctcaacgctgtgaatcaggtggcggtgtacatcgatggcgccgacgaatgcaatgaggccctggagctaatcaaaggcggtggtgcggcgctcacgcgggagaagattgtcgcggcggtggccagggaatttatctgcatcgccgatggcagcaagtgggtgcacaccctgggggagtttccgctcccggtagaggtcattcccatggcgcgcagtcacgttgcccgggagctcgtcaaactcggcggcgacccggtgcttcgggagggtgtggtcacggataacggcaacgtgatcctcgacatctacaatttcgctatccctcagcctctggccacagaggcaaagattaacgggattgtcggtgtggtctgtaatggcctgttcgcgttgcgccccgccgatcgcctgctactgggcaccgccgaaggcgtgcgcgatatcaagcgtccagaatctttcctggattcataa

SEQ ID NO: 3195 - DNA, 744 bp, unknown
  Marine gamma proteobacterium HTCC2148
atgctgtcggtaactggccgctggcctatactggtctcccaccatcgcaccaggagtatcgagccaatgaaccaggatgaactgaaacaggctgtggcccaggctgctttggattatgtgcgcccaaaaattgatgacgatactgtcttgggtattggcaccggctccaccgccaacctgtttatcgactgtctggcggaaattcgcggcagcatcaacgccaccgtcgccagttcagaagcctccgctgaacgattgaaggcccatggcatcccggtttacgacctcaatgcggtggatcaggtggatttttatatcgacggggcagacgagagcaacagtgctctgcaactgatcaaaggcggcggagcggcgctcacgcgagaaaaaatagtaacagcagtggcccgcgaatttatctgcatcgccgatgaatccaaactggtgcacactctgggggaattcccactgccggtagaggtggtgccaatggctcgcagtcatgtcgcccgggagctggtcaaactggggggagatcctgtttaccgggacggtgtggtcaccgataacggcaatattatcctcgacgtttacaacttcgcgattccccaaccactggcaacagaagcaaagattaatggcattaccggtgtggtaaccaacggcctgttcgcccttaaaccggcggacgtgctgctattgggcaccgcagagggcgttaaaaccctctatccagtggcctag

SEQ ID NO: 3196 - DNA, 678 bp, Teredinibacter turnerae
atgaatcaacaagagctgaaacaggcggtcgcgcaggccgcggtcgactacattcttccgaaactcgagagcgataccattctgggcataggaaccggctctaccgcggcgttgtttatcgatgccctggcacagcataaaggtcttttccagggcgcggtgtccagctcagaagcgtcagctcgccaattggaaggccacggcattcctgtctacgatctcaatgaagtcgatcgcctggtggcctatgtggacggcgccgacgaggccaatgcgcgtttacagttgattaaaggcggcggtgcggcgttgactcgtgaaaaaattgtaaccgcctgtgccgacgaatttgtctgcattgcagatgagagtaaatgggtgccggtgctcggtaaattcccgctgccagttgaagtgatccccatggctcgtagctttgtcgcacgagagctggtgaaaatgggcggtagccccgagcaccgccacggctgcactaccgataacggcaatcatattctcgatgttcacggcctcgaaattcatcagcccgccgagctggaatcggcaattaatcagattccgggggtggtgactaacggattgtttgcactgcgcccggccgatgtgttgctgttaggtaccaacgacggcgttaaaacgctttacccacattcttaa

SEQ ID NO: 3197 - DNA, 681 bp, Saccharophagus degradans 2-40
atgactcaagacgaattgaaacaagctgttgctcaagcggcgctagactatattttaccgcacctagaagacgacatgattttgggcataggtaccggctctacagcgcgcctttttatcgatttacttgccgcgcacaagggcaagtttgacggcgcggtttctagctcagaggcttccagcgagcaattaaaggggcacggcatacccgtttacgacctaaacagcgtagatagcctacctttttatatagatggtgccgacgaggccaacgcccaactgcaccttattaaaggcggtggcgcggcccttactcgcgaaaaaattattaccgccgtagccgacaaatttatctgcattgccgatgccagcaaagatgtagacgtattgggcaagttcccattacctgtagaagtgattccaatggcgcgcgcgcatgttgctagagaaatagtgaaattgggtggcaacccagtacaccgccaagattgcgttaccgataacggttgtcaaatactggatgtatacgacctcgccatccacgacgcaccagcacttgaagctaaactaaataacattgccggtgtggtcaccaatgggctatttgccctcaggccagccgatgtattgcttttgggcacaacgaacggggtagaaacccgatttgccgccaagccgtaa

SEQ ID NO: 3198 - DNA, 678 bp, Cellvibrio japonicus Ueda107
atgagcccacaagatcaactcaaacacgccgtggcgcgcgccgcgattgaatacatcaaacccaagctgacccccgatgccgtacttggtataggtacaggctctaccgccaatttttttatcgatatgctgggtgagcttaagtacgacttcgccgccgccgtagccagctccgatgcctctgcccagcgcttgcagacactcgggatcgaggtgctggactgcaacgccgtgagtgaactgctggtgtacgtggacggtgccgacgagagcaaccccaacctgcacctgatcaagggcggcggtgcagcgctgacgcgcgaaaagatcgtctgcgccgtagcgcgcgagtttgtctgtatcgccgatgagagcaaatgggtggatatcctgggcagatttcccctgcccgtcgaagtgattcccatggcgcgctcctttgtcgcgcgcgaactggtcaagctgggcggcgccccggtgtaccgcgaaggggttatcaccgacaatggcaatgtgatcctggacgtgcacaatctgcagatactgaacccggtcgagctggaaaccaaaatcaaccagatcaccggtgtggttgccaatggcctgtttgccatcaagcccgctgacgtattactgctgggcactaaagagggtgtgaaggttatcaggccgcagtaa

SEQ ID NO: 3199 - DNA, 681 bp, unknown
  gamma proteobacterium HTCC2207
gtggatcagaatcaattaaaactcgcggtagctgccgctgcagtagagtacacattaagtaagatcaaccccgatagtattgttggaattggtacggggtcaaccgccaactgctttatcgacctactcgccgaacataagaatagctttcaagctgcagtggcaagctctgatgcttcagctgagcgcttgcgcggccatggaatagaggttatcgaactgaatgcagcagcagaaattaccatttatatcgatggcgccgacgaagccaacccccaccttgagctaatcaaaggtggcggtgccgcattgaccagagagaaaattgtcactgcggtggccaatgaatttgtctgcatcgccgatgaaagcaagtgggtcgactttcttggtcagttcccgctgccagtagaagttattccgatggcccgcagtcatgttgccagagaattggtcaagttgggcggcgacccagtgtggcgtgagaacgtgatcaccgacaatggcaatcaaattctcgatgtgcaccacctctatcctgttgcatctgctcaggctctggaagaaaaaattaatcaaatcaccggtgtggttaccaatggcttctttgctcttaaagcagctgatgtattatttttggcaacccagcagggtattgtcactcactacccaaaagcatag

SEQ ID NO: 3200 - DNA, 675 bp, unknown
  Marine gamma proteobacterium HTCC2143
atgacacaagatgacctaaaaaaagccgttgcacgcgcagcactggactatattaagcctaaaattgaaaacgatagtgtcatcggtatcggcactggatctaccgctaactacttcattgactatctagctgagattaaaagtcatattaatgccacggttgccagctctgaggcttcggcagacagactgagaaagcatggtatacctgtattcgaactaacctcagtcaacgaaattaccgtctatgttgatggtgccgatgagtcagatccaaatctggcactgataaaaggcgggggcgcggcactaacccgggaaaaaatcgtggctgcatctgctagagaatttgtctgtatagccgacgagagtaaatgtgtagcgcaactgggtaactttccactaccggtagaggtcatcccaatggcgcgttcttttgtcgccagagagttagtgaaaatgggcggtgatccagtttatcgagagggagtagtgactgacaacggcaatattatcatcgacgtcttcaacttcatgatacccaaccccatcgaaactgaacaacatatcaacaatattactggagttgtcactaatggtattttcgcccagcgaccagccgatattctgttggtagcaactagtgaaggtataaaaacgcttcacaaggcgtaa

SEQ ID NO: 3201 - DNA, 672 bp, unknown
  gamma proteobacterium NOR51-B
ttggacaaagcccagttaaaagcccaggtcgctgccgcggcgattgagcgtgttgccgcgctgcataacgatgatctcgtgctgggtattggcacgggtagtacagcggaggcctttattcagctcctgggtccgctgcgagcgcgcatcgataccacggtgtccagctcggaacgttcaagtacgctgcttcgcgagatgaatatcccggtttcggatctcaatgccgtgggtgaagtggatatctacgtcgacggcgccgatgaggccaatgcggatctccagctgatcaagggcgggggcgcggcactgacccgcgagaaaattgttgcgggggcttccaggcagttcatttgtatcgccgacgagagcaagctggtacccaccctcggcgcgtttcccctgccggtggaggttattcccatggcacgaagttatgtggctcgccaaattgtcgcactcgggggtcagccggtctggcgcgaggacgtagtcaccgacaatggcaatgttatactcgacgtcttcaatctgttaatcgaccagcccctgaccctcgaaggtcaactcaatgatattcccggagttgtgtgcaatggtttattcgccctgcgcgccgcggacgaactgttactcggaacacctgacggcgttcgatccctgacccgatag

SEQ ID NO: 3202 - DNA, 675 bp, unknown
  Marine gamma proteobacterium HTCC2080
gtggatcagcaagggatgaaggaggccgtagcactggcggcgctcgaatgggtcaaggccctccccggtgacaatctggtattgggtattggtactggcagcacagccgagtgttttatcaggttactgcctgctattaaacagcgcatcaatatcaccgtatcaagctcacagcgctctgcagccttgttacaggaattgcaaattccattgggcgacctcaatgacgtagggcagttagatgcctatattgatggcgctgatgaagccaatcagcggctgcagctcattaagggaggaggcgccgctctgacccgtgaaaaaattattgccgctgccgcgaaacgttttttatgcattgcagatgcgtcaaagaaggtcgcaacgctgggcgcgttcccgttacctgtagaggtgattcccatggcaaggagtttcgtggcccgtgagctggtcaagctaggagggcagcctatttggcgcgacggtgtggtaaccgataacggaaatgtgattctcgacgttcatgggctttcaattgatcacgcgttggaaactgaggaggccattaatcacatcaccggtgtggtttgcagtggtctttttgcccgacggcctgcggatgtactaatgctaggtacccctcaaggcgtagaaactctgcaggctaattga

SEQ ID NO: 3203 - DNA, 663 bp, Nitrosococcus oceani ATCC 19707
atgagtcccgatgaaatgaaaaagctggccgctaaagctgcccttgagcatgtagaaccaggtactatcgttggtacgggcacaggctctaccgttaaccattttattgatctgctgggaacaattaaaggcaagatcgagggtgccgtctccagttccgaggcttccaccgcacggcttaaagctctcaatattcccgtttacgagctaaatgcggtaggagaaattcccctctatattgatggcgccgacgagtctaatcattatctgcagctcattaaagggggaggcggggcactaacccgggagaaaatcattgccgctgccagcaagaaatttgtctgtattgcagatcagtcaaagctcgttgatatattgggcaccttcccactccccgtggaagtcatccctatggcgcgcagctatgtggcgcggcaaatcgttaagcttggtggagagcccgtttaccgggaaggttttatcaccgataatggtaatcaaattctggatacccacgggctttccattatggagcctgctaaactggaaggacagctcaataatatccccggtgtagtcactaacggtctgttcgccatatatcccgcggacgtgcttatcctcggttctccagagggcgtcaaaaccatttaccctaaataa

SEQ ID NO: 3204 - DNA, 669 bp, Idiomarina baltica OS145
atgtccgcttccgataagttaaaacaacaagccgcgcaagctgccattaagtacgtcgagaaaggcgctatcgtcggcgtcggtactggctctactgttaacttctttattgatgaattagctaagatcaaagacgatatcgaaggcgctgtttcaagctcagacgcctcaaccgaacggctcaaacaacatggcattgaagttttcgaactgaacaacgcccccgaggttcctgtttatattgatggcgctgacgaaattgacgaacacggtcaaatgattaaaggcggtggtgccgcacttacacgtgagaaaatcgtcgctgcggttgccaaaaagttcgtctgcatcgctgatgaaagcaaattagtcggtcgactgggtacatttccgttgcccgttgaggtgattcccatggcacgttcctatgttgcgcgtgaaatagtcaagctcggcggcgatcctgtttggcgtcaaggcgtgaccaccgacaacggtaactggatacttgatgtgcacaacttcgatatccttaatgctgttgaactcgaagaacaactgaacaatgtagtcggtgttgtcaccaacggactatttgcagcccgttctgccgatgttgccttactggcaacctcagagggtgttaaagagctgacgtggggaaactaa

SEQ ID NO: 3205 - DNA, 672 bp, Idiomarina loihiensis L2TR
atgtcaggcaacgctgatgcactcaaaaaagcggcagcagaagctgctatgcaatacattgaagacggcactgtggtcggagtcggcaccggctcaacggtaaacttttttatcgatgccctggccgaacgaaagcatgacatagagggtgcggtatccagctctgaagcctcaaccgagcgcctgaaatcgcacggcattgaagtgtttgagcttaactcggttgtggaggtacccatttacgtagacggggctgacgaaattactgagcacggtcaaatggttaaaggcggcggtggcgcattaacgcgcgagaaaattattgccgcagtagccaggaagtttgtttgcgttgcagatgaaagcaaaatggttggccgcctgggtcaattcccggtgccggttgaagttattcccatggcgcgttcgtacgtggcccgagaaattgtgaagctgggcggagacccggtgtggcgtcagggttttactaccgacaacggcaactggatcctcgatgtgcataacttcgatattatggagccaatgaaacttgaagctgagctgaataatattgtcggcgtggtcactaacgggctgtttgcccagcgcggcgctgatatcgctttaattgctcgtgaagacggagtacaaaccctgaaggtaagtggctaa

SEQ ID NO: 3206 - DNA, 663 bp, Halothiobacillus neapolitanus c2
atgaccccacaagaccaactcaaacaacaggctgcaaaagcagcgcttcagtacgtacaaaccggcagtattgtcggggttggcacgggttcgactgtgaatttctttatcgatgaattggccaccatcaaacacaaaatcgaaggcgccgtttccagctccgaggccagcaccaagcgtttgcgggcacacggcatcgaagtgtttgatctcaatggcgtgggcgacatccctgtctacatcgacggtgcggatgaaaccaatgccaacttacagctcatcaaaggcggcggcggcgcgttgacccgcgaaaagatcattgcccacatggcgaaaaaatttgtctgcgtggctgatgaaaccaagctggtgccgcgtctcggtaaattcccgctgccgatcgaagttattcccatggcccgcagcatggtcgcgcgcgagctggtcaagcgtggcggtcagccggtgtatcgtgatggatttgtcaccgataacggcaaccagattctggatatccacaacatggacatcatggaaccggccaagctcgaagccgagctcaacaacatccccggcatcgtcaccgtcggtctgtttgccctgcgccccgccgatgtcttgattcttgccgccgccgaaggcgtgcgcacactcacgatctaa

SEQ ID NO: 3207 - DNA, 666 bp, Alkalilimnicola ehrlichii MLHE-1
atgatgagcgctgaccagggcaagcgcatggcggccgaggcggccatggagtacgtggaagagaacaccgtgatcggggtgggcaccggctccaccgtcaatttctttatcgacgccctggccgacatgaaggcccgcatcgacggcaccgtgtccagctccgaggcgagcaccgcccggctacgccagtacggcatcccggtgctggacctcaacgaggtgggcaccatgcccatttacgtggacggcgccgatgaatccaaccgcttcctgcagctgatcaagggcggcggtggcgcgctcacccgcgagaagatcgtggccgcggccgccgaacgcttcgtctgcgtggcggacgagtccaagctggtggacgtgctgggcgagttcccgctgccggtggaggtcatccccatggcccgcagctacgtcgcccgtgagctggtcaaactgggcggccggccgcaactgcgctccggtttcaccaccgacaacggcaacgtcatcctggacgtgcgcggcctcaagatcatggagccgatcaagctcgagcagcagatcaacaacatccccggcgtggtcaccaacgggctgttcgccctgcgccccgccgacgtcctgctgctcggcaccgccgagggcgtgcgcaaactcaccgcggagtaa

SEQ ID NO: 3208 - DNA, 660 bp, Halorhodospira halophila SL1
atgagcgatcagggaaagcgtctggccgccgaggcggcgctcgaatacgtcgaggaggatgcctacgtgggcgtcggcaccggctcgacggtgaatcttttcatcgatgctctggcggatatgcgcgatcgcatcgccggtgcggtctccagctccgaggcgagtacgcaacggctgcgcgatcgcggtatcgacgtgatcgacctcaatagcgccggccgcctgccggtgtacgtcgacggcgccgacgaggccaaccgcttcctgcagctgatcaaggggggcggcggtgcgctcacccgcgagaagatcgttgcctcggcgtcggatcggttcgtctgcgtggccgatgacggcaagatggtcgatgtcctcggggccttcccgctgccggtggaggtgatcccgatggcgcgcagcaccgtggcccgggaactggtccgtctcggggggcggccggagctgcgcgagggattcaccacggacaacggcaacgtcatcctggatgtccacggtctgtccatcactgagccgatcaagcttgagcagaccctgaacaacatcccgggtgtggtgaccaacggcatcttcgccctgcgcccggcggatctgctgctgttgggcagcgactcgggcgtgcgacgtctcaaggcagagtag

SEQ ID NO: 3209 - DNA, 663 bp, Nitrococcus mobilis
atggcttcagaccagcaaaaaaaggccgctgccgaggcagcgttgtcgcatttacaacatgccaacatcgtcggtatcgggaccggttccaccgtgaacttcttcatcgatgcgctgacatccatcaagggctccatcgatgccgtcgtttccagctcggaggcgtctaccgagcggctacgccgccacggtttcgaggtgcgcgaactgaacgcggtggatgagatccccgtgtacgtagacggcgccgatgagatcaaccgatacctgcagatgatcaaaggcggaggtggcgcactgacccgcgagaaaatcatcgccgcggtcagccgacggttcatctgtatcgcggatgcatccaagcgcgtagacgtgctgggagggtttccgctgccggttgaagtcattccgatggcacgcagctatgtggcgcgcgagatggtgaagctcggcggttggccggcactacgagaaggctttgctaccgacaacggtaatctcatcttggatgtacgcaacctgcagatcatggagccgagccatatggaacaaactatcaacaacatccccggtgtcgtaacggttggtatttttgccttgcgccccgccgacatgctgctattgggcaccgatcagggggtggaaacactcacagcggcttga

SEQ ID NO: 3210 - DNA, 663 bp, Methylophaga thiooxidans DMS010
atgaatgctgatgaaatgaaaaaacaagccgcgtgggctgcactggaatacatcaaaggtgatggcatcgtgggtgtcggtaccggctcaacagtgaatcactttatcgatgctttggcgaccatcaaaggccgtatcgaaggtgcggtttccagttcagaagcttctaccaaaaaaatgcaggaattaggcataaaagtcttcgatctcaacgagtgtaatgaaattgaagtgtatgttgatggcgctgatgaagccaactcgctgcttgagctagtaaaaggtggcggcggtgcgttaactcgtgaaaagatcattgcggccgccagcaaacagtttgtttgtatcgtcgatgcgaccaagcaagttgatattttaggcaaattccctttgcctgttgaagtgattccgatggctcgtagctatgtggctcgcgaaatcgtcaaactgggcggacagcctgtctaccgtgaaggcgttatcactgacaacggcaatgtcatcctcgatgtccacggcatggatatcatggaaccgattaagcttgaaaaaacattgaacgatatcgttggtgtggtgactaatggcctgtttgcgatgcgtcctgcggatgtgctgctggtgggctcggaagatggtacgcaaaccgttcacgctaaatag

SEQ ID NO: 3211 - DNA, 654 bp, Alcanivorax sp. DG881
atggatcaggatgcgctgaaaaagcaggtggccgaagccgcactgcgttttgtccccgaaggggaaatcatcggcgtgggcaccggctccaccgccaacttctttatcgacggactggcctccctcaaggatcgcatcaaaggcgccgtagccagctccgaggctactgccgaacgcctcaagcaacatggcattgaggttttctcgctgaatgatgtaggcaacctgtcggtgtatgtggacggggcagacgaagtgaacagccaccgggaaatgatcaagggcggcggcggcgcactcacccgggaaaaaattgtcgccgccgcagcgcgggaattcatctgcattgtggatgcctccaagcaggtgaaacgcctcggcgcgttcccgctaccggtagaagtgatccccatggcccgctcttatgtggcccgtaaactcgtcgcactgggtgggcaaccggaataccgcgaaggctttgtcacggacaacggcaatatcattctcgatgtgcacaacctggatatcaccaacccgattgaactggaaaccacgctcaacaatatcgttggcgtcgtcaccaatggcctgttcgccaagcggcctgccgacgtggtactggtaggcgaaaatggcaccgtgaaccaatactga

SEQ ID NO: 3212 - DNA, 657 bp, Alcanivorax borkumensis SK2
atggatcaggatgtgctgaaaaagcaggtagcagaagccgcgctgcgtttcgtcccagaaggggacatcatcggcgtgggcaccggctccaccgccaacttttttatcgacgcactagctaccctgaaagaccgaatcaagggtaccgtcgccagctcggaggccaccgccgagcggctcaagcaacacggcatcgaagtattctcactgaatgatgtgggcagcctatcggtttacgtcgacggcgccgatgaggtgaaccagcaccgggaaatgatcaagggcgggggcggcgcgcttacccgcgaaaaaattgtcgcggccatggccaaagagttcatctgcatcgttgatggttccaaacaggtaaaccgtctaggtgcctttcctcttcctatagaagtcatcccgatggcgcgctcttacgtggcacgtaaactagtcgcactaggcgggcagccgcaatatcgggaaggttttttgaccgataacggcaacatcatcctagatgtacataatttggacatcagcaatcccattgaactagaaaccacgctcaataatattgtcggcgttgtcaccaatgggctatttgccaaacgccctgcagatattgttctggtcggcgaaaaaagtggtgccgtaaaccaatactga

SEQ ID NO: 3213 - DNA, 660 bp, Lutiella nitroferrum 2002
atgcttacccagaaccagctcaaacttgccgtcgcccagaaggcgctggaattcgtccccgacaactgcatcgtcggtgtcggcaccggcagcaccgtcaacctgttcatcgaagaactggcgaccatcaaggggcgtatcaagggagccgtctccagttccgaggcctccaccgagcggctcaaggcccaccacattccggtatacgacctcaacaccgtggacgaggtcccggtgtacatcgacggcgccgacgaagtgaaccactacctgcacatgatcaagggtggtggcggcgcgctgacgcgtgagaagatcgtcggcgcggtggccaacgaattcatctgcatcgccgacgaaaccaagtacgtcgacgtgctgggcggctttccgctgccggtggaagtggtgccgatggcgcgcagctacgtggcgcgtgaactggtcaagctgggcggccacccggagctgcgcgagcatttcgtcaccgacaacggcaacatcatcctcgacgtataccgtctgcacatctccaagccggtggaactcgaggagaccatcaaccagatcgccggcgtggtcacttgcggcctgtttgctcgccgccgtgccgacgtgctgatcctcggccgccagagcgggatcgaggttctgcgctga

SEQ ID NO: 3214 - DNA, 660 bp, Chromobacterium violaceum
atgctgacccaggatcaactgaaactcgccgtcgccaagaaggcgctggaattcgtgccggaagacgccatcatcggcgtgggcaccggcagcaccgtcaacctgttcatcgaggaactggccggcatcaagggtcgcatcaagggcgctgtgtccagctcggaggcttccaccgcccgcctgaaggcccatcatatccaggtgttcgatctgaacgaagtggagaaactgtcggtctacatcgacggcgccgacgagatcaaccaccacctgcacatgatcaagggcggcggcgcggcgctgacgcgcgagaagatcgtcgccggcgtcgccgacgagttcatctgcatcgccgacgagaagaagtacgtgaccatgctgggcgccttcccgctgccgatcgaggtgatcccgatggcgcgcagctacgtcgcgcgcgagctggtgaagctgggcggccacccggagctgcgccagggcgtgaccaccgacaacggcaacgtgattctggacgtgcacggcctgcagatcatgaagccggtggagctggaggaaaccatcaaccacatcgccggcgtcgtcacctgcggcctgttcgcccgccgccgcgccgacgtgctgctgctgggcaagcaggacggcgtggaagtgctgcgctga

SEQ ID NO: 3215 - DNA, 663 bp, Laribacter hongkongensis HLHK9
atgaacgaacaagacaaaatgaaagcagcggctgccagaaaagcgatcgactacgtgccggaaggcgccattatcggcgtgggcaccggatcgactgccaactttttcatcgatgaactggccaggatcaaggaccgcatcgaaggcgccgtggcgagctcccaggcgactgccgaccgcctgaaggcgatcggcatccaggtgttcgacctgaacggcgtgggtgaattgccggtgtatgtggatggttgcgacgagatcaaccattacctgcacatgatcaagggcggtggcggtgcgctgacccgtgaaaagatcgtggccacctcgtcccgccagttcatctgcattgcggacgaaagcaagctggtcaagcggctgggggcgttcccgctgccggtcgaggtcatcccgatggcgcgcagcctggtggcccgcaagcttgtcaagctgggcggtcatccggaatggcgcgaaaatttcgtgaccgacaacggcaacctgatcctggacgtgcatgacctggccatcgaccagccgctggagatggaagaaaccatcaaccgcatggccggcgtggtgacctgcggcctgtttgcacgccgccgtgccgacgtgctgctgctgggtcgcagcgacggtaccgtccagaccattgaatga

SEQ ID NO: 3216 - DNA, 726 bp, Nitrosomonas eutropha
atgcgcaagcgctctgaatccttctcaatgagagcactatttcaagaaccaattattaaaatcatcatgacacaagacgaacaaaaacaggcagtggcacaagcagccctgcagtatgtgcaggtaggtgaaatcatcggtatcggaacagggtcgaccaccaatctttttattgatgaactggccaaaatcaaacacaagattgaaggggccgtggcaagctccgaagcaaccgcagcccgtctgaagcaacatggcattgaggttttgagcctcaattctgttgctgacctcccggtatatattgatggcgcagatgaaattacccggaacatgcacatgatcaaaggtggtggcggcgcactgacacgtgaaaaaatcattgcagccgtcgctcggaagtttatctgtattgctgatcaaagcaagctggtcaaggtattgggaaaatttccgctcccggtggaggtgattccgatggcacgcagttatgtcgcccgggaaattgcattactgggcggacaaccagcctggcgtcaggatttcaccactgacaatggcaatgtgattctcgacatacataatctaaatatcatgaatccggttgaactggaaagcacgctcaaccagatcacaggggtggtgaccaacggcctgtttgccagacgaggcgctgatgtactgttgatgggtactgatcagggcgtggaaaccattacgatctag

SEQ ID NO: 3217 - DNA, 660 bp, Nitrosomonas europaea
atgacacaagacgagcagaaacgggcagtggcacaagcagccctgcagtatgtgccgacaggtgaaatcatcggcatcggaacaggatcgaccgccaatctttttattgatgagctggctaagatcaaacacaggattgaaggcgccgtggcaagctccgaggttactgcaaaccgtctgaagcaacacggcatcgaggttctggatctcaattccgtcggcgaactcccggtgtatatcgatggtgcagatgaaatcacccggaatatgcacatgatcaaaggaggcggtggtgcgctgacacgtgaaaaaatcgtagcggctgttgcacgtaaattcatctgtattgctgaccagagcaagctggtcaaggtactgggaaaatttccactgccagtagaagtcatcccgatggcacgcagctatgtcgcccgggaaatcacattactgggtggacaaccggcctggcgtcagggatttactaccgacaacggcaatatcattctcgatgtccataacctgaatatcatgaatccggttgaactggaaactgccctcaaccagattgcaggggtggtgacgaacggtctgtttgccagacgagcggccaacgtgctgctgatgggtaccgaccagggagtggagaccattacagtatag

SEQ ID NO: 3218 - DNA, 660 bp, Nitrosomonas sp. AL212
atgacacaagacgaacagaaacgtgcagcagcggttgctgcaattcaatatattccagttgattgtattgttggagtaggtacaggttccaccgctaactattttattgatgagctggctaaaatcaaacataaaattgaaggggctgttgcgagttccgatgcaacggcacaaagacttaaggaacatggcatcgaagtacatgatctcaataacgttattgatatccctgtttatgttgacggtgcagatgaaatcactgagaatttgcatatgatcaagggtggcggtggcgcattgacacgagagaagatcgttgccgcggtagcacagaaatttatttgcattactgatcagagcaagctggtaaatattcttggcaacttccctttgcctgtagaggtcatcccgatggcgcgcagctatgttgcgcgtgaaattgttcatttgggtgggcatccggctttacgtcacgacttcgtcacggataatggcaatatcatactggacgtacacggattacaaattatgaagcctattgaactggaaaccacgcttaatcaaattgccggtgttgtaaccaatggtctttttgcacgacgcggggcggatacgctattattgggaacagataacgacatacgtgtaatttctatttga

SEQ ID NO: 3219 - DNA, 660 bp, Nitrosospira multiformis ATCC 25196
atgaatcaggacgagcagaaacgggcggccgcgcacgccgctattcaacatattcccgcaggctgtattgtcggagtcggcaccggctctaccgccaactacttcatagacgcactggccggcatcagaagcaggatcgatggagcggtagcgagttcagaagcaaccgcccggcggctcagcgcacatggaatcgaggtcatggaccttaataatgtcgacgagcttccgttatatgtggatggcgctgatgagataacgccgcatctgcatatgataaaagggggtggcggagctctgacccgggaaaaaatcgtggccgccgtggcgaaaaaatttatctgcattgcggaccagagcaagctcgtggacgtgcttggcaagtttccgctgcccgtggaggttatcccgatggcgcgcggtcacgtggcgcgcgagatagtacggctggggggacaacccatgctcaggcagggatttaccactgataacggtaacgtcattcttgatgtgcacgccttgcagatcctgaaccccattgaactggagacggaactcaatcagatcaccggcatcgtaaccaatggcctgtttgcaagacgccctgcggatttgctgttgctgggagacgaaggaggcattcgtaccattgctatctga

SEQ ID NO: 3220 - DNA, 666 bp, Sideroxydans lithotrophicus ES-1
atggctttgacgcaagacgatatgaaacgcgcggtcgcccaggcggcgatcgcttatgtgccgaacgattgcatcgtgggtgtgggtacgggctctacagccaacttcttcatcgacgaactggccaggatcaagaacaagatacgcggtgcggttgccagctctgaagcgtcggccaaacgcctgcaaggacatggcatcgaagttttgtcgttgaacgatgcgggcgacctgccggtctacgtggatggcgccgacgagatcacgcgccatatgcatatggtcaagggcggcggcggtgccctgacgcgcgaaaaaatcgtggcggctgccagccagaagttcatctgtgtgtgcgatgccagcaagcttgtggatgtgctggggaagttcccgctccccattgaagtgattccgatggcgcgcagctatattgcgcgtgaattagtgaagctgggtggccagccgaaattgcgcgagggctttaccactgataacggcaacgtcatactcgatgtgcataacttgcagatcatgaatccggtggagctggaaacgactttgaaccaattggccggtgtggtgaccaatggtttgttcgcgcgccgcggggcggatgtgctgctattgggcactcccgacggcgtcagaacgctcaccgcctga

SEQ ID NO: 3221 - DNA, 666 bp, Gallionella ferruginea
atgatgaatcaagatgatttaaaacgtgcggtagcgctggctgctattcaatatgtgcctgccgattgtattgtgggggtgggaacaggttcaaccgccaatttttttattgatgagttggccaaaataaagaacaaaatccggggtgccgtggcaagttctgaggcttccgcaaagcgtttgcaggggcatggtattgaagttatgtcgctgaacgaagcgggtgcgcttgaggtgtacgtggatggcgcggatgagatcacgcggcatatgcatatgctcaagggcggtggcggtgcattgacccgcgaaaaaatcgtggcgggcgcgagtcgaaaattcatttgcttgtgtgatgccagcaaattagtcgatgtgctgggtaaattcccgttgccgattgaagtgattccaatggcacgcagttctgttgcgcgtcagttggtggccttgggcggccagcctatgttgcgtgaaggatttacgaccgacaacggcaatatcattatcgacgtgcacggcttaaaaattatgaatccggttgaattggaatctgaactggatcatatcgccggtgtcgtgaccaacggactgtttgcacgtcgtgcggctgatgtgctgctgctgggtaccgcagacggcgtgaaaacgatgacggtcagctag

SEQ ID NO: 3222 - DNA, 660 bp, Methylotenera mobilis JLW8
atggcgtttacacaagacgaattaaagcaacaagttgcaaaagcagctgtggaatatgtaaaaagcggcatcattggtgtaggtacaggttctaccgctaacttttttattgaagagttggcgaaagtaaaacacaagattgatggcgcagtcgccagctctgaagcaacggcgcaacgtttgcgtggtcatggtattgaagtgtttgatttgaactcagtcgacaaccttgagatttatgtggatggcgctgatgaaattacagagcatatgcatatgctaaaaggcggcggcggtgcactcacacgtgagaagattgttgcagctgtagccaaaaaattcatctgtatctgtgatgcaactaaatacgtgccagtgttaggtaagttcccgttaccagtagaagtcctgccaatggcaaaaagccatgtagcgcgtgaactggttaaattaggtggtcagccacaattgcgtgatttcactaccgacaacggtaacctgattcttgatgtacatggtttaacgattactgatccggtagcgatggaagcaaaaatcaaccaaatcgtaggcgtggtaactaatggtctatttgccgctcgtccagcaaacgtactgttgttagcaacggctgagggtgtgaaaacctaccagaaataa

SEQ ID NO: 3223 - DNA, 657 bp, Methylovorus sp. SIP3-4
atggcaacacaagacgaattgaaacaacaagtagcgaaggccgcggttgaatacgttaagggcggcattattggcgtaggcactggctctactgccaacttttttatcgacgaactggccaaggtcaaaagcaagattgatggcgcggtagcaagctcggaagccactgcacagcgtttgcgcgcccacggcattgaagtatttgacctcaatagcgtggatggcatggaaatctatgtcgatggcgccgatgaaatcaccgagcacatgcacatgctgaaaggcggcggtggcgctttgacccgcgaaaaaatcgtcgcagcctgtgccaagacattcatttgtatctgtgatgccagcaagtacgtgcctgtgctgggcaaattcccgctgccagtcgaagtgttgcccatggcccgcagccacgtggcacgtgaactgaccaagctgggcggtcaacccaagctgcgcgactttaccaccgataacggcaacatcattctggatgtgcatggcctggaaatcctcaacccggttgagatggaagccaagatcaaccagatcgtgggtgttgtcaccaatggtctgttcgccgcgcgtcctgcagatgttctgctcttggccacgccggaaggtgtgaagacatacaagcgctaa

SEQ ID NO: 3224 - DNA, 660 bp, unknown
  beta proteobacterium KB13
atggcgttcacgcaagatgaattaaagcaacaagtggcaaaggcagcagtagggtatgttgaatctggaattattggagtaggcactggatcaactgcaaatttctttattgatgaattagcgaaagtgaaacataagattgatggcgcagttgctagcagtgaggctacagccaatagattaaaagaccatggcattcaagtatttgatttaaatagtgttgatggcatggaaatatatgtcgatggtgcggatgagattactgagcacatgcatatgttaaaaggtggtggtggtgcattaacaagagaaaaaattgttgcggcaaacgccaaagactttatctgcatctgtgatgaatcaaagtacgtggatgtgctcggaaaatttcctctgccagttgaagtgcttcccatggcaagaagctatgttgccagagaattagccaagcttggcggcaatcctgtgctcagagattttacaaccgacaatggtaatgtcattcttgatgtgcataacctcgtgatctcagatccgattgcaatggaagcaaaaattaaccagattgtgggcgtggtgactaatggactatttgcggcacgtccagcaaacacgcttcttttagctaccacagagggtgtgaaaacaataaaaaaatag

SEQ ID NO: 3225 - DNA, 660 bp, Methylobacillus flagellatus KT
atggctacacaagacgaattgaagcaacaggtcgccaaggcggccattgagtatgtaaagggcggcatcatcggtgtgggaacgggctccacagccaatttcttcattgatgagcttgccaaggtcaaagatcgcatcgatggtgctgtcgccagttccgaagcaacggcgcaacgcctacgcggccatggtatcaaagtattcgacctcaatgatgttgacggcatggaaatctatgtggatggtgcagatgagatcaccgagaagctgcatatgctcaagggcggcggcggagcattgacccgtgaaaagatcgtagcggcctgtgccaaggatttcatctgcatctgcgaccagaccaagctggtgccggtgcttggtaagttcccgctgcccgtagaggtcattccgatggcacgcgaatatgttgcgcgcgagttggtcaaattgggcggccagcccaagttgcgtgacttcaccactgacaacggtaacgtgatcctggatgtgcacggcctgaccattacggatccggtggcgctcgagtccaggatcaatgaaatcgtcggcgtggtgaccaacggcctgttcgcttcccgtccagccaatgtcctgctgctggcaaccgccgacggtgtcaagacattgacggccaggtag

SEQ ID NO: 3226 - DNA, 660 bp, Methylophilales bacterium HTCC2181
atggctttatcacaagatgaattaaaaaaacaagtagcaaaggcggcaatcgaatacgtagagtcaggcgttattggtgttggaacaggctctactgccaactattttattgattacctggctgaagtaaaacataagattgatggcgcagtagctagtagtgaggcgacagcagaacgtctccgcaaacatggaattgaagtatttgatcttaattcagtagatggtatggatatttatgtcgatggtgcggatgaaatcaccgaacatatgcatatgcttaaggggggcggtggtgcattaaccagagagaagattgtcgccgcaaatgccaaaaagtttatctgtatttgtgatgaatcgaaatttgtaccaacgctcggtaaatttcctttgcccgttgaggtccttcctatggcgagaagttatgttgctcggcagttatcggccttaggaggccaaccgcaattaagggactttacaacagataatgggaatattattcttgatattcatggaatgaatattgttgaccctatcgacaccgaagctaggatcaatcaaatcgtaggggttgtgactaatggactttttgctaagagagcggcagatatattattgcttgcaactgattcgggcgttaaaaccctgggtaagtaa

SEQ ID NO: 3227 - DNA, 657 bp, Thiobacillus denitrificans
atgacccaagacgaaatgaagcgagccgtagcgcgtgctgcggtggattatgccaagggcggcatcatcggcgtaggaaccggctcgaccgcgaaccatttcatcgacgccctggccgaagtcaaggggcgcatcgagggcacggtggcgagttccgaggcgacggcggcgcggctgaaaagccacggcatacaggtgctcgacctcaacagcgtcggagagctcgaggtctacgtcgatggggctgacgagatcacgcagcatttcgcgatgatcaagggcggcggcggcgcgctgacgcgggaaaagatcgttgcggcgtgcagcaagcaattcgtctgtatcgccgacgacagcaagctcgtcgacgttctcggcaaattcccgctgccggtcgaggtgatcccgatggcccgctcgcacgtcgcgcgggagctcgtgaagctcggcggccagccccgcctgcgcgagggcttcacgaccgacaacggcaacgtgatcctcgacgtgcacaacctttcgatcatcgacccggtatcgctcgagaccgcgatcaaccagatcgtcggcgtggtcaccaacggcctcttcgcccggcgcggcgccgacgtgctgttgctcggcacgtcgaccggggtcaagaccttcacgagatag

SEQ ID NO: 3228 - DNA, 660 bp, Kangiella koreensis DSM 16069
atgacacaggacgaattaaagaagttagtgggtgaagccgcgcttgaatatgtggtcgacgattcgattgttggcgtgggaactggctccaccgtcaactattttattgatgcgctggcgacgatgaaacacaaaatcaaaggtgcagtgtccagctctgaagcatcaaccgagcgtttaaagaagcacggtattgaagtattcgaactcaacgaagtgggcaagctcccagtctacgtagatggcgcagacgaatccaaccatctattggagctgattaaaggtggtggcggcgccctgacccgtgaaaaaattatcgcagcagctgccgatcaattcatctgcatcgctgacgagtctaagctggttcgtcgcttgggtgaattcccgttaccagtagaagttatcccaatggcgcgtagttatgtcgcacgccaaatcgtaaaactaggtggcgacccggtttatcgtacaggctttgtcactgataacggcaacgttattcttgatgtgcatggtctggttattaatgagcccatcaagcttgaacgaattcttaataatatcgttggtgttgtgactaatggtttatttgcggaaagagcagccgatgtattgttgctgggtaaagaaggtaaagtggaaacgataacgcgttag

SEQ ID NO: 3229 - DNA, 657 bp, Allochromatium vinosum DSM 180
atgaatcaagacgacctgaagaaacaggcggccgaggccgcgctcgactatgtcgagggtggcgtgatcggcgtgggtaccggctcgaccgtgaatcatttcatcgacgccctggccggcatcaagaaccggatcgagggtgctgtttccagctccgaggtctcgaccgaacgcctcaagcggcacggcatcccggtgttcgacctcaatgcggtgggtgagctggcgctctatgtcgatggcgccgacgaggccaatgggcggctggaactcatcaagggcggtggcggggcgctgacgcgcgagaagatcgtggcggcggcgagccgcaagttcgtctgcatcgccgacgagagcaagctggtcgaggtgctggggcgcttcccgctgccggtcgaggtcatccccatggcgcgcagctatgtggcgcgtgagctggttcggctcggtggcacaccagtctggcgcgagggcttcgtgaccgataacggcaatctgatcctggacgtccagaacctggaaatcaccgatcctcaggggcttgagcagcaggtcaacaatattgccggcgtggtcacggtcggtatcttcgcgctgcgtccggctgatgtgctgatcctgggctcagctcgtgggccgagagcgatcgcgccctga

SEQ ID NO: 3230 - DNA, 657 bp, Thioalkalivibrio sp. HL-EbGR7
atgaatcaggaccagatgaaaaaggccgcggcggaagccgccatcgaatacgtggaatccggcatgatcgtcggcgtgggcaccggctccaccgccaaccacttcatcgatctgctggcagccatcaaggaccgcatcgacggcaccgtcgcctcctccgaggccagtgcccagcgcctgcgcggccatggcatccaggtcatggacctgaacaccgccggccagctgcccctgtacgtggacggcgccgacgaatccaacgccgagctgcacctgatcaagggtggcggcggcgccctgacccgggaaaagatcgtggccgccgccagcgacaagttcgtgtgcatcgccgacgagagcaagctggtggacgtgctgggcgccttccccctgcccgtggaagtgatccccatggcccgcgcctacgtggcccgggagctgaccaagctgggcggccagccggtgctgcgcgaaggcttcaccaccgacaacggcaacgtgatcctggacgtgcacaacctgcagatcagcgacccggtggccatggaagaccatatcaaccagctgcccggcgtggtcaccgtgggcatcttcgcccagcgcccggcggacgtgctgatcctgggttctgccggcggcatcaggaagatcggctga

SEQ ID NO: 3231 - DNA, 663 bp, Thioalkalivibrio sp. K90mix
atgactcaggacgaaatgaagaaggcggtcgccgaggccgcgctcgaacgcatcgaaagcggctggatcgtgggtgtcggcaccggctcgaccgcgaactactttatcgatgccctggcccggatcaagggcaagatcgacggtgcagtggcctccagcgaggccagcgcggaacgcctgcgcgggcacgggatcgaggtcctggacctgaactccgccggcccccttccgatctatgtcgacggggctgacgaggccacccggcacctgcacctgaccaagggcgggggcggtgcgctaacccgcgaaaagatcgtcgcggcggcgtccaagaccttcgtctgcgtcgtggacgagaccaaggtcgtggattacctgggggccttcccgctgccggtcgaggtgatcccgatggcgcgcagccatgtggcccgtgccctgtcgaagctgggcggaaacccggagctgcgcgagggcttcaagaccgacaacggcaatgtaatcctcgacgttcacaacctgcgtatcatgaatccggtggagctggagtcggagctggaccatatcgccggcgtcgtcaccaacggcctgttcgcccgccgcccggcggacgtgatgctcgtgggctcgcccgcaggcgtcgaggagatgaccgccaagtaa

SEQ ID NO: 3232 - DNA, 657 bp, Methylococcus capsulatus
atgactcaagacgaactcaaacggaaagtcgccgaagcggcattggattatgtcaaggacgtcaccatcctgggggtgggaaccggctcgaccgtgaaccattttattgatttactggccgatctcaaaggcgggatcgaaggtgcggtgtccagctcccaggccagctccgagcgtctgaagaagatcggcatcccggtgctcgacctcaacgccgccggcaccctggatgtctacgtggacggcgccgatgaagtcaatgccgccaagcagatgatcaagggcggcggcgcggccctgacccgcgagaagatcgtggcggaggccagccgcaagttcgtctgcatcgtcgatgagaccaagtgcgtcgacgtgctgggcaagttcccgctgccggtcgaggtgatcccgatggcgcgcagcctggtcgcccgccgcctggtggaactggggggcacgccggtgtggcgggagaactgcatcaccgacaatggcaatgtgattctcgacgtgcacaacctcaccatcaccgatccggtcgagctggaacgccgaatcaacgatatccccggggtggtctgcaacggcgtgttcgcactgcggccggcggacgtcgtgctgatcggatcgcccagcggcgtgcgcacgctcccttga

SEQ ID NO: 3233 - DNA, 663 bp, Coxiella burnetii
atgtcaaaaaacgaacttaaaaaagcagccgctatggaagcgattcaattcgttaagaacgtcaatatcgttggagtaggaaccggttccaccgtcaattatttcatcgacgccttagcggaaattaaacatcaaattgaaggggctgttgcaagctctgtagccactgaaaatcgcttaaaagagcaccgtattccagttgttgaccttaattccgtttccaacgtggatgtctacgtggatggagctgatgaatttaataaacatttttatcttaccaaaggcggcggtggcgccctcacccgtgaaaaaatcatcgcggcagccgctaaacgctttatttgtattgtcgatgaaagtaaacaagtggacgtgctaggacaattccccttgccgattgaagttatcccaatggctcgcagctttgttgcacgtgaaatcgtcaagctcaagggagacccggtttatcgacaaggattcacaacggataacggcaatgtgattttagacattcacaacctgaccatcctcaaccccgttgagttagaggccattctcaataacatcccaggcgtgatcgccaacggcctcttcgcgcagcagcccgccgatgatttgttaataggtaccccggcaggcgttcagcttcatcatagaaaatga

SEQ ID NO: 3234 - DNA, 672 bp, Neptuniibacter caesariensis
atgacccaggacgagatgaaaaaagcagttgctgaagctgctgtggagtacatcaaacctaaacttacagaagatagcattgtcggggttggtaccggctcaacggctaatttctttatcgatgccctcgcagagatcaagcatatgtttgagggagcagttgccagttcagaagcgactgcagaacgtttgaaaggtcatggtattgaggtgttcgatatgaactcagtatcagagatggaagtttatgtagatggtgctgacgaatttgattcaggcctgaaccttgtaaaaggtggcggtggcgcattaacccgtgaaaagattgttgcggctgtagctaaagagtttgtctgcattgtggatagcagtaaaaaagtggacgttctaggggagttcccattgcctgttgaggtgattccaatggcacgttcgcaagtggcgcgtgagctagtcaaactggatggtatgcctgagtggcgacagggttttgtaacagataatggtaatctgattcttgatgttcatgaccttgaaatcatgcgtccgaaggagctggaaaaacagcttaataatatcgtcggtgtagtgaccaatggtctgtttgcaaaccgtggagcggatgtagtccttatgggaactgagtctggcgttgagacgataaagctttaa

SEQ ID NO: 3235 - DNA, 663 bp, Thiomicrospira crunogena
atgacacaagatgaattaaaacaacaagttgctatagcagcaatcgaatacgtcgttccagacacctttattggtgtaggaacaggctctacagcaaactttttcattgatgagcttgctaagatcaaaggcaaaatcaaaggcgctgttgccagttccgaagccacggcagaacgtttaaaagatcatggcatcccagtaatggaattgaattctgtcgatgagttatctgtttatattgatggcgctgacgaagcggaccctaaactcaacctaattaaaggtggtggcggtgctttaacacgtgaaaaaatcgttttagccgttgcgaaacagtttgtatgtattgccgatgacagtaagaaagtggctgtactaggtaaattcccacttccaattgaagtgattccgatggctcgcagttacgtcgctcgtgaagttgttaaacgcttcggtggcgagcctgtcttgcgtgaagggtttacaacagacaatggtaatgtcattttagacatccacggtttggaaatcaccgatccagtcgcgatggaaacagagctgaacggtattgttggcgtggtaacaaatggattgtttgcagcacgtaacgcagacatcttcctatgtggtaccgccaacggtgttgaaaccatcaaggcgtaa

SEQ ID NO: 3236 - DNA, 603 bp, Beggiatoa sp. PS
gtggttgaagacagcatcatcggtattggtactggaagtactgccaactactttattgatgtactcgcttccatcaaacacaaaattgaaggtacggtagccagttctaaagcatcgcttgaacgccttaaatggcatggtatttcagtctttgatatcaatagtgtggatgaaatttctgtttatattgatggggctgacgaatctaatcaatatcgtcatctcattaaaggcggtggtggtgcattaacccgggaaaaaattgtcgccgcagttagtcgaaaattcgtctgtatcgctgacgacagcaaattagtcgaagtgcttggcaaattcccactacccgttgaagttattccgatggcacgtagttatgtggcgcgtgaattggtgaaaatgggagggaaaccggtttggcgggaagcttttaccactgataatggtaacgtcattttagatgtacacaatttagaaataattgatccggtgatattagaaaccgaactaaatgcgataactggggttgttaccaatggtttatttgcagctcgtccagcagatatattgctattaggtagtgataaaggcgtgaaagtgctgtaa

SEQ ID NO: 3237 - DNA, 714 bp, Reinekea blandensis MED297
atgagcgtgatgacacaagacgaactcaaacaacaggtggcaaaggctgctttggactacatcaagcctgagctgacgtcagacgccattatcggtgttggcaccggctcgacggccgaattttttattgatggtctggctgcttaccgagatgatttcaaaggtgcggttgccagcagtgacgccacggccaaacgtctggcgggtcacggtatcgaagtctttgacatgaacgacgtgacgcaactgtctgtctatgttgacggtgcggatgaggccaacaagaagctgcagctgatcaaaggcggcggcgcggcgttaacccgcgaaaaaatcgtagcctccattgccaaaacctttgtctgtattgccgatgagtccaaggctgtggaagtcctgggggcgttcccattgccggtggaagtcattccgatggcgcgcagcgcggtggcccgacgaatccgtgatttgggcggtaacccggtgtatcgcgaaggtgtggtgaccgacaacggcaacgtgattctggacgttcatggtctgcagattaccgatgcgaaagaactggaacgtgagctgaataacatggtcggcgtggtgaccaatggcttgtttgccgcgcggcctgccgatgtgttgctgttgggtaccgcgtccggggtgaaaacgctgacagtgattaacacagccgccagtgcgggcgagtttttctga

SEQ ID NO: 3238 - DNA, 480 bp, Mycobacterium tuberculosis
atgcgcgtctacctgggggccgaccacgccggatatgagctcaagcagcggatcatcgagcacctgaagcaaaccggccacgagccgatcgactgcggcgcgttgcgctacgacgccgacgacgactacccggcattctgcattgccgcagcgacgcgcactgtcgccgatccgggcagcctgggcatcgtgctgggcggatcgggcaacggggagcagatcgccgccaacaaggtgcccggcgctcgctgcgcgctggcctggagtgtgcagaccgcggcgctggctcgcgagcacaacaacgcccaattgatcggcatcggcggccgcatgcacacggtggccgaggcactggcgatagtcgacgccttcgtcaccacgccgtggtcgaaagcgcaacgccaccaacggcgtatcgacattctcgccgagtacgaacggacccacgaagcgccgccggtgcccggcgctccggcctga

SEQ ID NO: 3239 - DNA, 432 bp, Thermotoga maritima
gtgaagatcgctattgcatcggaccacgcagcttttgaactgaaagagaaggtgaagaactaccttctgggcaagggaatagaagtggaagatcacggtacctattccgaggaatccgttgattatccggactacgcaaaaaaagttgttcaatccattctgtcgaacgaagcggattttggaatccttttgtgtgggacagggctcgggatgtcaattgctgcaaacaggtacaggggcataagagcagctctctgtcttttcccggacatggcaagactcgcgagatcgcacaacaatgcaaacatcctcgttcttccgggaaggctcatcggagcagagctcgctttctggatagtggataccttcctttcaacacccttcgatggaggaaggcacgaaaggagaatcagaaagatcgatgaggtttaa

SEQ ID NO: 3240 - DNA, 450 bp, Clostridium thermocellum
atgaaaattggaattggaagcgaccacggaggttacaatttaaaaagggagatagccgattttctaaaaaaaagaggttatgaagtcatagactttggaacacacggaaatgagtcggtggattatccggatttcggacttaaggttgcagaggctgtaaaaagcggcgagtgtgacaggggtattgtaatatgcggtaccggacttggcatatcaatagctgcaaacaaggttccgggcatcagagctgccgtatgcaccaacagttacatggcaagaatgagcagggaacacaatgatgccaatatcctggctttgggagaaagagttgtgggacttgatcttgctttggatattgttgacacttggctcaaagctgagttccagggaggaagacatgccaccagggttggcaaaatcggtgagattgaaaaaaaatacagcaaatag

SEQ ID NO: 3241 - DNA, 450 bp, Escherichia coli
atgaaaaagattgcatttggctgtgatcatgtcggtttcattttaaaacatgaaatagtggcacatttagttgagcgtggcgttgaagtgattgataaaggaacctggtcgtcagagcgtactgattatccacattacgccagtcaagtcgcactggctgttgctggcggagaggttgatggcgggattttgatttgtggtactggcgtcggtatttcgatagcggcgaacaagtttgccggaattcgcgcggtcgtctgtagcgaaccttattccgcgcaactttcgcggcagcataacgacaccaacgtgctggcttttggttcacgagtggttggcctcgaactggcaaaaatgattgtggatgcgtggctgggcgcacagtacgaaggcggtcgtcatcaacaacgcgtggaggcgattacggcaatagagcagcggagaaattga

SEQ ID NO: 3242 - DNA, 480 bp, Trypanosoma cruzi
atgacgcgccgagtcgcaatcggtacggatcatccggcattcgccattcatgagaatctgattctgtacgtgaaggaggctggcgacgagtttgtgcctgtgtactgtggaccgaagacggcggagagtgtcgactacccggactttgccagtcgtgtggcggaaatggtggcaaggaaggaggtagaatttggcgtgctggcatgcggtagtgggatcggcatgtccatcgcagccaacaaagttcccggggtgcgggctgccctctgctatgaccactacaccgcagcgatttcgcggatccacaacgatgcgaacattgtttgcgtgggagagcggacgactggtgtggaggtcattcgggagatcatcattacattcttgcagacgccgtttagcggcgaggagcgccatgcacgacgtattgagaagatacgggccattgaagcctcccacgccgggaacaaaggggtaaaatga

SEQ ID NO: 3243 - DNA, 471 bp, Desulfurococcus kamchatkensis 1221n
ttgaataattattttaggagggatgaatccatgcgtgtagcggttggatcagatgacgtatatagtgttgcaagattcctcgtggactacctgaggaagaagggattcgaggttaaactagtcggcgccctcgcgacgggaaagccgtatccatggcccgatgtaggctttgaggtgggctctatggtggctagaggcgaggtagattatggcattgttatatgttacactggtacaggtgtatcaatagcagccaataagatcaagggagttagggcagcactcgtcacagatgccaggaacgctgagggagctaggagatggaatgatgccaatgtcctcgcgttaagtgccaggttaactagtgaggagctggctaaggagatagtggatgcgttcttcaatactagggaaatagattcatctgaggtagagaacatagagaagctgaaggctattgataatgcttga

SEQ ID NO: 3244 - DNA, 444 bp, Thermofilum pendens
atgaaggtagctttcggggcggacgataactactcgatagcgaggttcgtagtagaggagcttaagcgcaggggccacgaggtcgtgctggtaggctccccgctgacggggaagccctacccctggccaaaagtggctgtggaggttgcggagctcgttgcgagcggcaaggtggatacggggatagtcatgtgctacaccgggacgggggtgagcatagccgcgaacaaggtcaagggagtcagggctgctctctgcaccgacgcgaagaacgccaggggcgcgcgcctgtggaacgacgccaacgtgctcgcgctaagcgcgaggctcctctcggaggaggtcgcgaaggagatactcgacgagtggttctcggtcgagaagccggaccccagcgagctggagaacatagagttcgtgaagaagctggacctctcaaggtga

SEQ ID NO: 3245 - DNA, 471 bp, Acidimicrobium ferrooxidans
gtgagtcggatcatcgcattgggcgccgaccacgccggctacgcgctgaaggaggccgtcaagcgccacctcgtcgaggctggactcgacgtcctcgacttcggcaccgactctgaggagtccgtcgactacccgctcttctgccagcctgctgccgaggcggtcgcgaccggcgcggccgaactcgggatcgtcttcggaggttcgggtcagggcgagcagatcgtggcgaacaaggtccggggcgtgcgtgcagccctgtgctacaacgagctgtccgctcgcctcgccagggcgcacaacgacgccaacgtcctcgcactcggggcgcgtctgctcggtcacgacctcgcgctcgccatcgtcgatgcgttcctcgcggccgacttcgatggggggcgtcacgcgcgaaggatcgcgcagatcgcggaggtcgagaacggcgtctcgttcacgcagactcagggctag

SEQ ID NO: 3246 - DNA, 450 bp, Actinomyces coleocanis DSM 15436
atgcgcgttcatattgctgccgatcatgctggtttcgaactccgcgaacacctaatcaagcacctgagcgagaaaggctacgaagtagtcgaccacggtgcaaccgaatacgacgctttggacgcgtatccaaccatgtgtattccttgcggtgaagcggtagccgccgaaccgggttctctgggcatcgttatcggtggctctggaaacggcgaacagattgctgcaaacaaagtaaagggcgtgcgcgcagcactcgcatggagtgaagcaactgcagcacttgcgcgtgaacacaatgacgcaaatatcgtggcagttggcgctcgccagcacacccttgaagaagctacgcacttggtagatgttttcttagaaactccattctcaaacgaccagcgtcatatcgatcgcatcaacatgatgagcgcctacgaagaagcacgctga

SEQ ID NO: 3247 - DNA, 510 bp, Actinomyces odontolyticus
atgtgtgccatactagtggacgttgcttgtttgagaactcttcaggaggatcccatgcgcgttcatatcggcaccgatcacgccggtttcgaactcaaggaaaaggtcgttgcgcacctgcgcgaggctggtcacgatgtcgtcgaccatggcgcccacacctacgatgcgctcgacgactacccgccgttctgcatcgaggcagcccaggctgtcgtcgacgagccgggtagcctcggcatcgtcatcggcggctccggtaacggcgagcagatggccgccaactgtgtggaaggcgtgcgcgccgccctcgtgtggtcggatgcgaccgcgcgtctggcccgcgagcacaacgatgcgaacgtcgtggccgtcggtgcccgccagcacagcgaggaagaggctctggccctcatcgacgctttcctggagacccccttcagcggcgacgagcgccaccagcgccgcatcgacctgatgaaggactacgagcgctccgtgcgcgcctga

SEQ ID NO: 3248 - DNA, 468 bp, Actinomyces sp. oral taxon 848 str. F0332
atgggattgcgcatcgtcgtcgctgcggatttcgcaggatacgactacaaagaagccatcaagagggacctcgagcaagatgagcgcgtcgacgagatcatcgacgtcggcgtcaaggacggcgagaagaccccctatccgcatgtcggcgtcgccggcgcccggctcatcgcggaagggaaggccgaccgtgggatcttctgctgcgggacgggcatgggcatggccatttctgcgaacaaggttcccggcattcgcgcgagcacggcgcacgacagcttctccgtagagcggctcatcctttcaaacgacgcacacgttttgtgcctcggccagcgcgtcatcgggctcgagctcgccagaaggcttgctcgcgagttcctcggctacgaattcgacccctcgtcgcactcgaaagccaacgttgacgtccttgtagaatacgaaaacggttcggctggctgctag

SEQ ID NO: 3249 - DNA, 453 bp, Actinomyces sp. oral taxon 848 str. F0332
atgcggatacacattgcaacggaccatgcggggttcgaactgaaagaatacattgcgggcaagctccgcgaggggggccacgaggtgatcgaccacggcgcccattcatatgatccgatggacgattacccgcccatgtgcatcgcctgcggcgaggccgtggtggccgaccccggcagcctggggatcgtcatcggaggctctggaaacggcgagcagatagcggcgaacaaggtcaggggagtgcgggcggccctcgcgtggaaccttgagaccgcgaggctcgggcgggagcacaacgacgcgaacgtcgtcgcgataggcgcgcgccagcacggccacgaggaggcgctttcgttcgtcgagctgttcatcggcacgcccttcagcggagacgaacggcatcagcggcgcatcgacctcgtagcgcagtacgagtcctcggagcgctga

SEQ ID NO: 3250 - DNA, 459 bp, Actinomyces urogenitalis DSM 15434
atgcgtattcacattggaacggaccatgctggatttgagctcaagggtgtgctcgtcagccacctcactgagcagggtcacgaggttgtggaccacggctgctacgtctacgaccgcctcgatgactaccctgagttctgctttgccgcagccgaggccgtcgtcgctgaccccggctcgctcggcatcgtgctgggcggatcgggcaacggtgagcagatcgccgccaacaaggtcgacggcgtgcgcgcggcactggtctggaacgtcgagaccgccaggctcgcccgccagcacaacaacgccaacgtggcgggcctgggcgcgcgtcagcactccaccgaggaagccatcgagatcctcgacgccttcgtggccgagcccttctctggcgaggagcgtcaccagggccgcattgaccaggtcctggactacgagcgcgcccaccacagcgcctga

SEQ ID NO: 3251 - DNA, 501 bp, Mobiluncus curtisii
atgttcttggctgtgcccaggcgggccagattcgacacgaaaggaaaagctatgcgcgtacacattggtaccgaccacgccggattcgagttgaagcagcatctggttacttggctgcgggaacgcggctatgaagttgttgaccacggacctgccgcctacgaccctgatgacgactacccaggcttctgcattgcttgtgcccaaggcgtgatagctgacgaaggctctttgggtatcgtgttgggcggctcgggcaacggtgaacaaatcgctgctaacaaggtaaaaggtatccgcgcggcgctggtgtggaacgaagaaatcgcgagtcttgcccgccagcataacaatgccaacgtgatttccttgggtgcccgccaacattcggttgaggactgcgaacgtttcgtggaagtgttcctgactacggacttttccgatgaagaacgccactctcggcgcatcggtcagctcagcgattacgataaccagcgctag

SEQ ID NO: 3252 - DNA, 438 bp, Mobiluncus mulieris
atgaagatagcatttggatgcgaccctaacgcggccgatttgaaactggctttgattgcgaaagcccagcagcttggacacgaggtcaaagatttcggcgccgaagacccgatttacgccaatacggccgtggcggtggctaaggctgtggccgccggggaattcgaccggggcgtgctggtttgtggcaccggcatcggggtgtcgattgcggcgaacaaggtcaagggggcgtattgcgcgtgtgtgacggatatttaccaggcacagcgcgccacgctgagtaataacgcgaatctaattgcgatgggctcgcaggtcgtgggcgtgaaatcggccgagatgttcctagaggaatacctcaagtacaccttcgatccggcttcgcgcagcggggcgaaagtcgcgcggatttgcgagtttgagcgcgaagactag

SEQ ID NO: 3253 - DNA, 435 bp, Catenulispora acidiphila DSM 44928
atgcgcatcgcggtgtcggcggacgaggtggccggagtggctgcgcagatcggtccggaactggagcgccgaggtcacacggtgctcctgttcggagccctggtacctggcgagcgcgccgattgggcctggtccgcggaggccgccgcgcgagccgtcgccgaaggccgcgcggaccaggcggtcgtggcgtgctggaccggtgccggggcgtcgatcgccgcgaacaaggtggacggcgtccgggcggcgctgtgcaccgacgccgtgatggccgacggagcgcgcaagtgggccgacgccaacgccctcgccctgagcctgcgcctcacctcccagccgctgctgatggagatgctggacgcctggttcgccggcgcgccgagccccgatccggtggacgcggcgaacgtggcgcacgtcgccgagatctga

SEQ ID NO: 3254 - DNA, 480 bp, Catenulispora acidiphila DSM 44928
atgcgcatctacctcggcagcgaccacgccggctacgacctgaagaaccacctcgtcacctggctgaccgccgccgggcacgaagcagtcgactgcggcccccacaccctcgacccccaggacgactaccccccctacgtgatgctcgccgccagcaaaacagccgccgaccccgacaccctcggcatcgtcatcggcggctccggcaacggcgaagcaatcgccgccaacaaagtagacggcatccgagcagccctagcctggagcgaagaaacagcccgcctaggccgcctccacaacaacgccaacgtcatcagcatcggcgcccgcatgcacaccgaagcagaagccacccacttcgtagaactcttcatcaccacccccttcaccaacgaagaacgccacaaccgccgcatccaactgatgaccgactacgaaaagaccggcgaactcccacccctccccaacaccaccagctga

SEQ ID NO: 3255 - DNA, 480 bp, Corynebacterium accolens
atgcgcgtatatcttggagctgaccacgcaggttttgaaaccaaaaacctgatttctgaacacctcaccaaacaaggccatgacgttatcgactgcggcgcccatacctatgacgccgaggatgactaccccgcattctgcattgaagcggccctgtgtaccgtcaacgatccaggttccctgggaatcgtgctgggcggatccggaaatggcgagcagattgccgccaataaggtcaagggcgcgcgctgcgcgctggcatggtcgccagaaaccgcgcgcctggcccgcgagcacaataatgcgcagctcatcggcatcggcgggcgcatgcactcgcaagaagaggccctagaaatcgtggatgccttcttggatcaagaatggtcccgcgccgagcgtcaccagcgccgcatcgatatcctcgcagaatacgagcgcaccaatatcccacctgagctgcccaaggacccgcgctaa

SEQ ID NO: 3256 - DNA, 474 bp, Corynebacterium amycolatum
atgcgtatttaccttggtgcagaccacgccggttttgagatgaagaacctgattaaggcccacctggagaaggctggccacgacgtcgttgactgcggcgctcacacctacgaccctgcagatgactatccagcattctgcatcgaggcggcttcccgtaccgtcgctgacccgggcagcctgggcatcgtgctcggcggctctggcaacggcgagcagattgccgctaacaaggtcaagggcgctcgctgtgcgctggcttggtcggtggagaccgcgaagctcgctcgcgagcacaacaacgctcagctgatcggcctcggcggtcgtatgcactctgaagaagaggctctggccatcgtcgatgctttcgtctcccagccgtggagcgaggaggagcgccaccagcgccgcatcgacattctggcagagtacgaaaagactggcgtcgccccggagctgccggaggcttaa

SEQ ID NO: 3257 - DNA, 474 bp, Corynebacterium aurimucosum ATCC 700975
atgcgcgtttatttaggagcagaccacgcagggttcgagacgaagaacgtcatcgccgaacacctgaagaagcagggccacgacgtcattgactgcggtgcccatgagtacgacgccgaggatgactacccggcattttgcattgaagccgcgctgcggaccgtcaacgatccgggctcgctcggcatcgtgctgggcggttccggcaacggtgagcagatcgccgctaacaaggtgaagggcgcgcgctgcgccctggcgtggtccccggagactgcacgcctggcccgcgagcacaacaacgcccagctcatcggcatcggcggccgcatgcactccgaggaggaggcgctcgccatcgtggacgccttccttgatcaggaatggtcccgtgctgagcgccaccagcgccgcatcgacattcttgccgagtacgagcgcaccaacattccgccggagcttccggaggcttag

SEQ ID NO: 3258 - DNA, 474 bp, Corynebacterium diphtheriae
atgcgcgtatacctaggagcggaccacgcagggttcgatatgaaaaacattattgccgatcacctcaaagccaaaggccacgaggtgatcgactgcggagctcacacatacgatgctctcgacgattaccccgcctactgcatcgaagcagcaagccgcgtagtaaacgacccaggctcattgggcatcgttctcggcggatccggcaacggcgagcaaattgccgctaacaaggtcaaaggcgctcgctgcgcactcgcatggtcggttgaaactgcccgcctcgcacgcgaacacaacaacgcacagctgatcggcctcggcggccgcatgcactccgaagaagaagcactagcaattgtcgatgccttcctcgaccaagagtggagcaaagaagaacgccaccagcgtcgcatcgacatcctctgcgaatacgagcgcaccggaatcgcacctgttattccagaatcctaa

SEQ ID NO: 3259 - DNA, 474 bp, Corynebacterium efficiens YS-314
atgcgcgtataccttggagcagaccacgctggtttcgaaactaaaaatgcaattgcagagcacctcaaggcccacggccacgaggtgatcgactgcggagcccacacctacgaccccgacgatgactacccggccttctgcatcgaagcagccaaccggaccgtcaacgaccccggttccctcggcatcgtgctgggtggatccggtaacggtgagcagatcgccgcgaacaaggtcaagggcgcacgctgcgcactggcctggtccgtggagaccgcccgcctggcacgtgaacacaacaacgcgaacctgatcggcatcggtggccgcatgcactccaccgaggaggcactcgagatcgtcgatgccttcctggatcaggagtggagcaacgcggagcgccaccagcgacgcatcgacatcctctctgattatgagcgcaccggtgtcgcaccggttgtccccaacgagtaa

SEQ ID NO: 3260 - DNA, 489 bp, Corynebacterium genitalium
atgcgtatttaccttggagcagaccacgccggattcgagcgcaagaacgagatcgccgagcacctcaaggctgccggccatgaggtcgtcgactgcggcgcacacgagtacgacgctgcagacgactacccagcgttctgcatcgccgcagcggagaagactgtcgccgatccgtcgtcgctgggcatcgtgctcggcggttcaggcaacggcgagcagatcgccgcgaacaaggtcaaaggtgcccgttgcgctctggcttggtcggttgagaccgctcagctcgcacgggagcacaacaacgcccagctgatcggcatcggtggtcgcatgcactctcttgaggagacgctcgcgattgtcgacgctttcgtcggcatcaccccggaccaccaggtcgaggagcgtcaccagcgtcgcatcgacatcctcgcccgctacgaggagaccggcgagactgaggagatcccagctccgaagacgctctag

SEQ ID NO: 3261 - DNA, 468 bp, Corynebacterium glucuronolyticum
atgcatatttatttgggtgctgaccacgcaggatacgaggctaaagaagctatcaaggcccacctgatcgaggccggctatgaggtgacggattgcggcgcgcacgaatacgacgcgcaggatgattacccggctttctgcatcgccgcagctgaggctgtggccaaggatccgggttcgctcggtttcgtgctcggcggttccggcaacggcgagcaaatggctgccaacaaggtcaagggcatccggtgtgccctcggctggaatgaggacaccgcccgtcttgcccgcgcacacaacaatgcgcaggttctgtccatcggtgggcgccagcattccgaggaagaggtgctcaagcttgtcgacgctttcctcgacgagccctggagcgaagaggagcgccaccagcggcgcatcgatattctcgccgagtacgagaagaccggcgtcgctcccgaggtcaagtaa

SEQ ID NO: 3262 - DNA, 474 bp, Corynebacterium glutamicum
atgcgcgtataccttggagcagaccacgctggtttcgaaactaaaaatgcaatcgcagaacaccttaaggcccacggccacgaagtgatcgactgcggagcccacacctatgatgcagaagatgactacccagccttctgcatcgaagcagctagccgcacagtaaacgacccaggctcactcggcatcgtcctgggtggatccggaaacggcgagcagatcgccgccaacaaggtcaagggtgcacgttgtgcacttgcttggtctgttgaaactgcacgcctcgcccgcgagcacaacaatgcgaacctcatcggcatcggcggccgcatgcactcagaggaagaggcattggcaattgtcgacgccttcctcgagcaggaatggagcaacgccgagcgccaccagcgtcgtatcgacatcctcgctgattacgagcgcactggaatcgcacctgtcgttcctaacgaataa

SEQ ID NO: 3263 - DNA, 474 bp, Corynebacterium jeikeium
atgcgtatttacctaggtgcagatcatgccggtttcgagatgaagaacgtgatcaaggatcacttgacctccaagggcttcgaggttgtggactgtggcgcccacacctacgacgcgaacgacgactacccggcgttctgtatcgcagcggccaagtccgtggtggaggatgagggctcgctgggcatcgtgctcggcggatccggcaacggcgagcagattgccgccaacaaggttccgggcgcgcgctgtgctctggcgtggtccgtggagaccgcgaagctggcccgtgaacacaacaacgcccagctgatcgggctgggcggtcgtatgcactccgaggaggaggcgctggcgatcgtcgacgctttcgtcacccagccgtggtccgaggcggagcgccaccagcgccgcatcgacatcctggctgagtacgagcgcacgggggaggcccccgctctgccggagaactaa

SEQ ID NO: 3264 - DNA, 477 bp, Corynebacterium kroppenstedtii DSM 44385
atgcgcgtttatcttggtgcggaccacgctgggttcgagttgaaaaatactattgctgctcatttggaaaagaacggccacgagatcgtcgattgcggggctcattcctttgatcccaaggatgattaccctgcttactgcatcgaagcctctgcccgggtcgtgaacgatcccggatcattgggcatcgtgatcggcggttccggaaacggtgagcagatcgctgccaacaaggtcaagggagcccgctgtgctttggcctggtccgtggagacggccaagcttgcccgggagcataacaatgcacagctcatcggtttaggggctcgccagcactccgaggaggaagccctcgagattgtcgacgctttcatcgaaacgccgtggtcaaatgaggaacgccaccagcggcggcttgacgtcctcgcggagtatgaacgtacggggatggcacccgcgttgcccgaagaccagtag

SEQ ID NO: 3265 - DNA, 474 bp, Corynebacterium lipophiloflavum DSM 44291
atgcgtatttatcttggggcagaccacgccggtttcgagcggaagaaccagatcaaggagcacctcgaggccgccggtcacgaggtcatcgactgcggcgcgcacgtctacgacgccgccgacgactatcccgcgttctgcatcgccgccgccgagtgcacggtcgcggacccgggctccttgggaatcgtgctcggcggctccggcaatggcgagcagatcgccgcgaacaaggtcaagggcgcgcgctgcgccctggcgtggtccgcggagaccgcgcgcctggcccgcgagcacaacaacgcccagctcatcggcatcggcgggcgcatgcacaccgaggcagaggcgctcgcgattgtcgacgccttcatcggccaggagtggtcgaacgaacagcgacaccagcgccgcattgacatcctcgccgagtacgaggacaccggcgtcgccccggccctgccgcaggagtag

SEQ ID NO: 3266 - DNA, 480 bp, Corynebacterium matruchotii
atgcgaatttaccttggtgcagatcatgcaggctttgaactcaaaaacactatcaaggaccacctgctggcgggaggatacgaagtaatcgactgcggcgcccacacctatgacgccaacgacgattacccagcattttgtatcgcggccgcccaaggggtggttgacaaccccgggtcgcttgggatcgtgctgggcggctccggcaacggggaacaaatcgctgccaataaagtcaagggcgctcgctgcgccctggcctggtccgtagagaccgcccgactggcccgagaacacaacaacgcccagctcatcggcatcggcggtcgcatgcactccgacgcggaagccctcgcaatcgtcgacgctttcctcgaccaggcgtggagtggaaacccccggcaccagcggcgcatcgacatcctttccgaattcgaaaccaccggtgtggcccccgaggtccccgaagccaccaaataa

SEQ ID NO: 3267 - DNA, 480 bp, Corynebacterium matruchotii
atgcgaatttaccttggtgcagatcatgcaggctttgaactcaaaaacactatcaaggaccacctgctggcgggaggatacgaagtaatcgactgcggcgcccacatctatgacgccaccgacgattacccagcattttgtattgcggccgcccaaggggtggttgacaaccccgggtcgcttgggatcgtgctgggcggctccggtaacggggaacaaatcgctgccaataaagtcaagggcgctcgctgcgccctggcctggtccgtagagaccgcccgactggcccgagagcacaataatgcccagctcatcggcatcggcggtcgcatgcactccgccgcggaagccctagcaatcgtcgacgccttcctcgaccaggcgtggagtggaaacccccggcaccagcggcgcattgacatcctttccgaattcgaaaccaccggtgtggcccccgaggtccccgaagccaccaaataa

SEQ ID NO: 3268 - DNA, 483 bp, Corynebacterium pseudogenitalium
atgtgggccatgcgcgtatatctaggagcagaccacgcaggtttcgaaaccaagaacctgatcgttgaacacctcaccaagcaaggccacgaagtcattgactgcggcgcccttacctacgatgccgaggatgactacccggccttttgcatcgaagcggcacaacgcaccgtcaatgacccaggttccctgggcatcgtgcttggcggctccggcaacggcgagcagattgccgccaataaggtcaagggtgctcgctgcgcactggcgtggtccgcagagaccgcccgccttgcccgcgagcacaacaatgcccagctcatcggcatcggtggccgcatgcacaccgaggagcaagcactggaaatcgtcgacgccttcctggaccaagaatggtcccgcgcggagcgccaccagcgccgcatcgatatcttggcggaatacgagcgcaccggcattgccccggagctgccggaggcctaa

SEQ ID NO: 3269 - DNA, 474 bp, Corynebacterium striatum
atgcgcgtttatctaggagcagaccatgcaggtttcgagacgaagaatgtcatcgccgaacacctgaagaagcagggccacgacgttatcgattgtggcgcacacgtttatgacgctgaggatgactacccagcattttgcatcgaggcagcactgcgtactgtcaacgacccaggctccctcggcattgtccttggtggctctggcaacggtgagcagattgcagcgaacaaggtaaagggcgctcgttgcgctttggcgtggtccccagagaccgcccgcctggctcgcgagcacaacaatgcacagctcatcggcattggcggccgtatgcactctgaggaagaggcgctcgctattgtcgacgccttccttgaccaagagtggtccgctgctgagcgccaccagcgccgcatcgatatccttgcagagtacgagcgcactgagattccaccggagattccggaggtttaa

SEQ ID NO: 3270 - DNA, 474 bp, Corynebacterium tuberculostearicum
atgcgcgtatatctaggagcagaccacgcaggtttcgaaaccaagaacctgatcgctgaacacctcaccaagcagggccacgaagtcattgactgtggcgcccatacctacgatgccgaggatgattacccggcattttgcatcgaagcggcacaacgcaccgtcaacgatccgggttccctgggcatcgtgctaggcggttctggcaatggtgagcagattgccgccaataaggtcaagggtgctcgctgcgcactggcgtggtccgcagagaccgcgcgccttgcccgcgagcacaacaatgcccagctcatcggcatcggtggccgcatgcacaccgaggagcaggcgctggaaatcgtcgacgccttcctagaccaagaatggtcccgcgcggagcgccaccagcgccgcatcgacatcttggcggaatacgagcgcaccggcattgccccggagctgccggaggcctaa

SEQ ID NO: 3271 - DNA, 474 bp, Corynebacterium urealyticum
atgcgaatttatcttggtgccgaccacgccggttttgacatgaaaaacctcatcgcagaccacctgaaggccgctggccacgaggtgatcgactgcggtgcacatacctacgacgcgaacgacgactacccggctttctgcatcgaggcagcccgccgggtcgtcgccgacgagggctccctgggcatcgtcctgggtggttccggcaacggcgagcagatcgcggcgaacaaggtaccgggcgcgcgctgcgcattggcctggtccgtggagaccgcgaagctcgctcgcgagcacaacaacgcccagctcatcggcctgggcggtcgcatgcactccgaggaggaggcgctggctatcgtcgacgccttcatcgcgcaggagtggagcgaggcggagcgccaccagcgtcgcatcgacatcctcgctgagtacgagaagaccggcgaggctccggccctcccggaggcctaa

SEQ ID NO: 3272 - DNA, 477 bp, Gordonia bronchialis DSM 43247
atgaccaccacatccggaatgaccatcgccatcggcagcgacgacgccggcatcgactacaaggccatcctggccgccgacctcgtcgacgacgcgcgcgtcgcctcggtgatcgacgtgggcgtgggccccgacgagcacacccattacccccatgtcgccgctgcggccgcccgtctggtggccgacggcaccgccgaccgggccttgctgatctgcggcaccggcctcggagttgccatcagcgccaacaagatcccgggaatccgcgcagtcaccgcccacaacagtttctcggtggagcgcgctgtcctcagcaacgacgcgcaggtcctgtgcttcggtcagcgcgtgatcggcgtcgaactcgcgcgtcgcctgacccgggaatggctgggctaccggttcgacccgcagtccgcgtcggcggagaaggtcgcggctatcgccgactacgaggtcgccagtcccgtctga

SEQ ID NO: 3273 - DNA, 474 bp, Gordonia bronchialis DSM 43247
atgcgtgtttacctgggtgccgaccatgccggtttcgaacggaagaaccagatcgccgaacatctcgaggccgctggacacgaggtcgtcgactgcggagcccacgagtatgacgccgacgacgactacccggcgttctgcatcgacgccgcccggcggacggtcgccgacccgggcagcctgggcatcgtcctcggcggcagcggcaacggagaacagatcgcggccaacaaggtgcacggtgcgcgatgcgcactggcatggagtgtggagaccgcccagctggcgcgccagcacaacaacgcgcagctgatcggcatcggcggccgcatgcacagccgcgaggaggcgctggccatcgtcgacgccttcatcgccaccccgtggtcggaggaaccgcgccaccagcggcgtatcgacatcctcgccgagtacgagcgcaccggtcaggcgccacccgttccgggcgcctga

SEQ ID NO: 3274 - DNA, 480 bp, Mycobacterium avium
atgcgcgtctacctcggctctgaccacgccggattcgagctcaagcagcagatcatcgcccacctcgagcagtccggccaccagccgatcgactgcggcgccttcagctacgacgccgacgacgactacccggcgttctgcatcgccgccgcgacgcgcaccgtggccgacccggacagcctcggcatcgtgctcggggggtcgggcaacggcgagcagatcgccgccaacaaggtccccggcgcccgctgtgcgttggcctggagcgtggaaacggcgcagctggcgcgcgagcacaacaacgcccagctgatcggcatcggcggtcgcatgcacaccgtggccgaggcgctggccatcgtcgacgccttcgtgaccacgccgtggtcgaaagccccacgccaccaacggcgtatcgacatactggccgaatacgaacgcacccaccaagccccgccggtacccggcgccgtgggctga

SEQ ID NO: 3275 - DNA, 480 bp, Mycobacterium intracellulare
atgcgcgtctacctcggctctgaccacgccggattcgagctcaagcagcagatcatcgagcacctcgcaaagtccggccacgagccgatcgattgcggcgccttcacctacgacgccgacgacgattacccggccttctgcatcgcgaccgcgacgcgcacggtggccgacccggacagcctgggcatcgtgctgggcgggtcgggcaacggcgagcagatcgcggccaacaaggtgcccggcgcccggtgcgcgctggcctggagcgtcgaaaccgcaagcctggcccgcgaacacaacaacgcgcaactgatcggcatcggcggtcgcatgcacacggtggccgaggcgctcgccatcgtcgacgccttcgtgaccacgccatggtcgaaagccgaacgccaccaacggcgtatcgacatcctcgccgaatacgaacgcacccaccaagccccgccggtacccggcgcggcgggctga

SEQ ID NO: 3276 - DNA, 480 bp, Mycobacterium abscessus
atgcgcgtctatgtgggagccgatcacgccggttacgagttgaagcagaagatcatcgagcatcttcggggccggggtcacgagccggtggattgcggggcctttgagctggacccgcaggacgattaccccgcgttctgcatcgacgccgcccggcgcacggtcgccgacccgggcagcctcggcatcgtgttgggcggttcgggcaatggtgagcagattgccgccaacaaggttccgggcgcgcgctgcgcactggcgtggagcctggagaccgcggtgctggcccgtgagcacaacaacgcacagctgatcgggatcggcggccgcatgcacacggtgccggaagcgcttgccatcgtcgacgcgttcctggccgccaagtggtcggaggagccgcggcaccagcgccgcatcgacatcctggccgagtacgagaccacgcgcgtggcgccgccggtacctggcgccagctcgtaa

SEQ ID NO: 3277 - DNA, 474 bp, Mycobacterium gilvum
atgcgcgtctacgtcggagccgaccacgccggatacgagctcaagcaggccatcgtcgagcatctcgccgcgaccgggcacgagccagtcgactgcggtgcgttcgcctacgacgccgaggacgactacccggcgttctgcatcgccgccgccgagaagaccgtcgcggacccgggcagcctgggcatcgtgctcggcggctccggcaacggtgagcagatcgcggcgaacaaggtgcccggtgcgcgctgcgcgctggcatggagcaccgagacggcgacgctggcgcgcgagcacaacaacgcccagctcgtcggcatcggcggccggatgcattcgaccgacgaggcgctggcgatcgtggacgcgttcctggcggcgaagtggtcggaggcaccgcggcatcagcggcgcatcgacatcctcgccgagttcgagaagacgcacgtcgctccggccgttcccggggcctga

SEQ ID NO: 3278 - DNA, 480 bp, Mycobacterium kansasii
atgcgcgtctacctgggctctgaccacgccggattcgaactcaagcagcacgtcatcgagcacctcaaggcgtcgggacacgaaccgatcgactgcggcgccttcgcgtacgacgccgacgacgactacccggcgttttgtatagccgccgcgcagcggacggtggctgatccgggcagcttgggcatcgtgctgggtggatccggcaatggcgagcaaattgcggccaacaaggtgccgggcgcgcgctgcgcgctggcgtggagtgtggagacagcgtcgctggctcgtgaacacaacaacgcccagttgatcggcatcggcggccgcatgcacagcgtcgccgaggcgctggcgatcgtcgacgcatttctgtccgcgcagtggtcggaggccgaacgccatcagcgccgaatcgacatcctcacgcagtacgagcgcacccaccaagcaccaccggtacccggcccggtggcctga

SEQ ID NO: 3279 - DNA, 489 bp, Mycobacterium leprae
atgtcgggcatgcgtgtctacctgggggccgatcacgccggctacgagctcaagcggcagattatcgagcatctgaaacaatccggtcatcagccgatcgactgtggcgcctttagttacgatgtcgacgatgaatatccggcgttttgcatcactgccgcgacgcgcacggtggccgatccaggtagcctcggtatcgtgcttggggggtcgggcaacggcgagcagatcgcggccaacaaggttgtcggcgcacggtgcgcgctggcgtggagcgtcgagaccgcgaggctggcgcgtgaacacaacaacgcgcagttgatcggtattggcggccgcatgcacaccgtcgctgaggcgctgactattgtcgacgctttcgtgaccacaccgtggtcggaagcgcagcgccaccaacggcgtatcgatatcctcgccgaattcgaacgtacgcaccaagcgccgccggtgcccggcgctcaggcctga

SEQ ID NO: 3280 - DNA, 480 bp, Mycobacterium marinum
atgcgcgtctacctgggggccgaccacgccggcctggagctcaaacagcagatcatcgagcacctgaaagcaactgggcacgagccgatcgactgcggtgcattcacctatgacgccgaggacgactacccggcgttttgcatcgccgccgcgcaacgcaccgtggcagacccgggcagcctgggcatcgtgctgggcggatcgggcaatggtgagcagattgccgccaacaaggtccccggtgcccgctgcgctctggcctggagcgagcaaaccgcatcgttggcgcgcgagcacaacaacgcgcagctcatcggcatcggcggtcggatgcacaccgttgccgaggcgctggctatcgtcgacgccttcctgtccacaccgtggtccaaagccgagcggcatcaacgtcgaatcgacatcttgtccgagtacgagcggacccaccaagcgccgccggtgcccggcgctcaggactga

SEQ ID NO: 3281 - DNA, 462 bp, Mycobacterium smegmatis
atggcactacgggtcgtcgtcggcgcggatgacgccggctacgagtacaaggaagcactcaagggcgacctcgccgcggacgaccgcgtcaccgaggtgatcgacgtcggcgtcggcgccgacgaggacaccgcctacccgcatgtcgcggtcgcggccgcacgtctgatcgccgaaggcaaggccgatcgcgcgttattggtgtgcggtaccggtctcggggtggcgatcagcgccaacaaggtgcccggcatccgcgcggtcaccgcccacgacagcttctccgtcgagcgctcggtgctgtccaacaacgcgcaggtgctgtgcttcgggcagcgggtcgtgggcctggagctcgcacgccgcctggcgcgcgagtggctcggctacgagttcgacccgaccagcaagtcggcggagaaggtccaggcgatctgcgggtacgaaccggccacgagctag

SEQ ID NO: 3282 - DNA, 459 bp, Mycobacterium smegmatis
atggcgttgaagatcgtcatcggcggcgacaacgccggattcaactacaaggaagccctgcgcaaggacctcgaggccgacgaccgcgtcgcgtccgtcgaggacgtcggcgtcggtggtgtcgacgacaccacctcctatccgaacgtcgccgtcgctgccgccgagaaggtcgcacgcggcgaggccgaccgggctctgctgatctgcggtaccggcctcggtgtcgcgatcgcggccaacaaggtcaagggcatccgcgccgttacggcacacgacgtgtactccgtgcagcggtccgtcctgtcgaacaatgcgcaggtgctgtgcatgggcgaacgcgtcgtgggactcgagctggcgcgcgccctggtgaaggagtggctgggcctcgagttcgatccgcaatcggcgtccgccgcgaaggtcaatgacatctgcgcgtacgagggtgcctga

SEQ ID NO: 3283 - DNA, 480 bp, Mycobacterium smegmatis
atgcgcgtctacgtcggtgccgatcacgccggtttcgagttcaagaaaacgatcatcgcccacctcgagaagaacggccacgagcctatcgactgcggggcttacgagtacgacgccgacgacgactacccggcgttctgcatcgccgcggccgagaagaccgtggccgacccgggcagcctcggcatcgtgctcggcggttcgggcaacggcgagcagatcgccgcgaacaaggtgcccggcgcgcgcgccgcgctggcctggagcgtcgagaccgctcaactcgcgcgcgagcacaacaacgcgaacctgatcggcatcggcggccggatgcacaccaccgaggaggcgctcgcgatcgtcgatgcgttcctgaccaccccgtggtcggaggccgagcggcaccagcgtcgcatcgacatcctcgccgagtacgagcgcacccacgtcgcacccgcggtcccgggcgcgccggcctga

SEQ ID NO: 3284 - DNA, 480 bp, Mycobacterium sp. MCS
atgacggcgcaacagacgtccaaactccgcatcgtcgtcggatccgacgacgccggctacgaatacaaggaagccctcaagggggacctgaaagcagacgaccgcgtcgccgaggtcaccgacgtcggtgtgggcaccgacgaggacacggcctatccgcacatcgcggtcgcggcggcccggatggtcgccgacggcaaggccgaccgtgccctgctggtgtgcggtaccggtctcggcgtggccatcagcgcgaacaaggtgccgggcatccgtgcggtcaccgcccacgacagtttctccgtcgaacggtcggtgctgtccaacgacgcccaggtgctctgcttcggacagcgggtcatcggactcgagttggctcgccgtctggcccgcgaatggctgaactacgagttcgacccggccagtaagtccgcggacaaggtggaggcgatctgcgggtacgaaccgcgcaccgactga

SEQ ID NO: 3285 - DNA, 489 bp, Mycobacterium sp. MCS
atggccgccatgcgcgtctacctgggagccgaccacgccggctacgagttgaagcaggtcatcatcgagcacctccgcagcaccggccacgaaccggtggactgcggtgcgttcgactacgacgccgacgacgactacccggcgttctgcatcgccgcggcggagaagaccgtcgccgatccgggcagcctcggcatcgtgctgggcgggtcgggtaacggtgagcagatcgccgcgaacaaggtgcccggcgcccgctgcgcgctggcctggagcgtcgagaccgccaagctggcccgcgaacacaacaacgcgcagctcatcgggctcggtgggcgcatgcactccgaggccgacgcgctcgcgatcgtcgacgcgttccttgccacgccgtggtcgaaagccgaacgccaccaacggcgtatcgacatcctctccgaatacgagcggacccacgaagcgccgccggtgcccggcgcccctgcctga

SEQ ID NO: 3286 - DNA, 489 bp, Mycobacterium bovis
atgtcgggcatgcgcgtctacctgggggccgaccacgccggatatgagctcaagcagcggatcatcgagcacctgaagcaaaccggccacgagccgatcgactgcggcgcgttgcgctacgacgccgacgacgactacccggcattctgcattgccgcagcgacgcgcactgtcgccgatccgggcagcctgggcatcgtgctgggcggatcgggcaacggggagcagatcgccgccaacaaggtgcccggcgctcgctgcgcgctggcctggagtgtgcagaccgcggcgctggctcgcgagcacaacaacgcccagttgatcggcatcggcggccgcatgcacacggtggccgaggcactggcgatagtcgacgccttcgtcaccacgccgtggtcgaaagcgcaacgccaccaacggcgtatcgacattctcgccgagtacgaacggacccacgaagcgccgccggtgcccggcgctccggcctga

SEQ ID NO: 3287 - DNA, 480 bp, Mycobacterium ulcerans
atgcgcgtctacctgggggccgaccacgccggcctggagctcaaacagcagatcatcgagcacctgaaagcaactgggcacgagccgatcgactgcggtgcattcacctatgacgccgaggacgactacccggcgttttgcatcgccgccgcgcaacgcaccgtggcagacccgggcagcctgggcatcgtgctgggcggatcgggcaatggtgagcagattgccgccaacaaggtccccggtgcccgctgcgctctggtctggagcgagcaaaccgcatcgttggcgcgcgagcacaacaacgcgcagctcatcggcatcggcggtcggatgcacaccgttgccgaggcgctggctatcgtcgacgccttcctgtccacaccgtggtccaaagccgagcggcatcaacgtcgaatcgacatcttgtccgagtacgagcggacccaccaagcgccgccggtgcccggcgctcaggactga

SEQ ID NO: 3288 - DNA, 474 bp, Mycobacterium vanbaalenii PYR-1
atgcgcgtctacgtcggggctgaccacgccggatacgaactcaagcagaccatcgtcgagcacctgaaagcgaccggccacgagccggtcgactgcggggcgttcacttatgacgccgaggacgattacccggcgttctgcatcgcggccgcgcagaagacggtcgccgacccgggcagccttggcattgtgctcggcggctcgggcaacggtgaacagatcgcggccaacaaggtgccgggggcgcggtgcgcgctggcgtggagccccgagactgcgtcgctggcccgcgagcacaacaatgctcaactcatcggcatcggcggccgcatgcattccaccgaagaggcactcgcgatcgtggacgccttcctgaccaccaagtggtcggaggcgccgcgtcaccagcgccgcatcgacatcctcgccgagtacgagaagacgcacgtcgccccgccggttcccggagcctga

SEQ ID NO: 3289 - DNA, 474 bp, Nocardia farcinica
atgcgcgtatacctgggtgccgaccatgccggtttcgaactgaagaatcacgtcaaggctcatctggagcaggcgggccacgaggtcgtggactgcggcgcgctcgagtacgacgccctcgacgactacccggccttctgcatcgaggccgcgcgccgcaccgtcgccgatccgggcagcctcggcctggtgttcggcggcagcggcaacggtgagcagatcgccgccaacaaggtgcccggcgcccgctgcgcgctggcctggagcgtggagaccgccaagctggcccgcgaacacaacaacgcgcagctgatcggcatcggcgggcgcatgcactccaccgaggaggcgctggccatcgtcgacgccttcctggccaccccgtggtcgaacgaggagcgccaccagcgccgcatcgacatcctcgccgagtacgagaagaccggcgtggcccccgcggtgcccgcctactga

SEQ ID NO: 3290 - DNA, 474 bp, Rhodococcus erythropolis
atgcgcgtatacctgggtgccgaccatgccggattcgaacgtaagaacgagatcatcgaacacctcaaagcgaacggccacgaggccatcgactgtggtgctcacgagtacgacgccgtggacgactacccggcattctgcatcgaagccgcaaagcgcgtcgttgccgacgagggcagcctgggaatcgtcctgggtggcagtggcaacggtgagcagatcgccgcgaacaaggttcccggcgcacggtgcgctctcgcttggagcgtcgaaacggcgaagctggcccgcgagcacaacaacgctcagctgatcggcatcggtggacgtatgcattccctcgaggaatcactcgccatcgtcgatgctttcctcgccaccgcatggtcgggtgaagagcgtcatcagcgtcgtatcgacatcttgtccgagtacgagaagaccggcgtcgcaccggctctgccgcaagcctga

SEQ ID NO: 3291 - DNA, 474 bp, Rhodococcus jostii RHA1
atgcgcgtatacctgggtgccgaccatgccggattcgaacgtaagaacgagatcatcgaacacctgacggccgcgggccacgagaccgtcgactgcggcgctcacgtctacgacgccctcgacgactaccccgccttctgcatcgagacggcccgtcgtgtcgtcgccgacgagggcagcctcggcatcgtgctgggcggcagcggcaatggtgagcagatcgccgcgaacaaggtgaagggtgcgcgatgtgccttggcgtggagcgtcgagaccgcgcagctggcccgccagcacaacaacgctcagctgatcggcctcggcgggcgcatgcactccctcgaggagtccctcgcgatcgtggacgccttcctcgccgccgagtggtcgaacgaggagcgccaccagcgccgcatcgacatcttgtccgagttcgagaagaccggcgtcgcccccgccctgcccgaggcctga

SEQ ID NO: 3292 - DNA, 474 bp, Rhodococcus opacus
atgcgcgtatacctgggtgccgaccatgccggattcgaacgtaagaacgagatcatcgaacatctgaaggccgcgggccacgagaccgtcgactgcggcgctcacgtctacgacgctctcgacgactaccccgccttctgcatcgagacggcccgtcgcgtcgtcgccgacgagggcagcctcgggatcgtgctgggcggcagcggcaacggcgagcagatcgccgcgaacaaggtgaagggtgcgcgatgcgccctggcgtggagcgtcgagaccgcgcagctggcccgccagcacaacaacgctcagctgatcggcctcggcgggcgcatgcactccctcgaggagtccctcgcgatcgtggacgcgttcctcgccgccgagtggtcgaacgaggagcgccaccagcgccgcatcgacattctgtccgagttcgagaagtccggcgtggccccggccctgcccgaggcctga

SEQ ID NO: 3293 - DNA, 528 bp, Tsukamurella paurometabola DSM 20162
gtgccgccgtcggacgcgaaggcgacgcgtgcaaaacttgtcatcatgcgcgtttacctcggcggcgaccacgccggattcgaactcaagtcccagatcgctcggcacctcaccgccgccggccatgaggtcgtcgactgcggtgcgcacacctacgacgctctcgatgactatccggcgttctgcatcgacgccgccaagcgcgtcgtcgccgatcccggcagcctcggcatcgtgctgggcggcagcggtaacggcgagcagatcgccgcgaacaaggtgcccggcgctcgctgcgcgctcgcctggagcgtggagaccgcccagctcgcgcgccagcacaacaatgcgcagctgatcggcctgggcggccgcatgcacaccgtcgacgaggccctggccatcgtcgacgccttcctcgccaccccgtggtccgatgaggagcgccaccagcggcgtatcgacatcctcgccgagtacgagcgcactggcgtcgcaccggccgtgcccggcgctcccgaggcctag

SEQ ID NO: 3294 - DNA, 483 bp, Acidothermus cellulolyticus
gtgcgggtctacgttgcctcggatcacgccgggttcgagctgaagacacgcctgatcgaatggctcgctgagcagggctacgagccggtcgactgcggcccggtcgtcttccaaccggacgacgactatccgccgtacgtgatcgatgcggcgcggcggacggccgccgaccgggacagcttcggtgtcgtgatcgggggatccggcaatggcgagcagatcgcggcgaacaaggtccggggcatccgcgccgcgttgatctggaatgacgagaccgcggcgctggctcgagcccacaatgacgccaacgtggcaagcatcggcgcccggcagcacaccattcgtgacgcgatccggttggtggacatcttcctccgcaccccgttctccggggaaccccggcatgcgcggcggatcggcatgatcagcgagttcgaggcgaccggcacacccccggaggttccgacagtcgactggcgctga

SEQ ID NO: 3295 - DNA, 489 bp, Frankia sp. CcI3
atgcgtgtccatctgggatctgaccatgcgggcttccacctgaaggaggcgctcgccgagcgtctggtggagctgggccacgcgcccgtcgaccatggtcctgtcgagtacgaccccgacgatgactaccctccgttcgtcctcgccgccgccgccgccaccgctgtcgaaccgggcagcatgggcatcgtcatcgggggatcgggcaacggggaggccatcgcggcgaacaaggtcgccggggtgcgcgcggccctggcatggagcgagcagacggcgacgctggcccgccagcacaacgatgccaacgtgctgagcctcggcgcgcgcatgtacaccgtcacggcggccctgacgttcgccgaggtcttcctcaccacgccgttcagcggggagcaacgacacgtgcggcggcttcggatgctctcggcctacgagcggaccggggacgtaccgtcggtgcccgggtcggcctcgtcggcttcctga

SEQ ID NO: 3296 - DNA, 486 bp, Frankia sp. EAN1pec
atgcgcgtccatctgggttctgatcacgccgggttccacctgaagaaggctctcgtcgcgcgcctcgcggagctcggccacgcccccgtcgaccacgggcctgtcgagtacgaccccgacgacgactacccgccgttcgtcatggccgccgcggccgccgccgcggcggaacccgacagcctggggatcgtgatcggcggctcggggaacggcgaggtcatcgccgcgaacaaggtcgacggggtgcgtgcggccctggtctggagcgaacagacggcgaccctcgcccgtcagcacaacgacgccaacgtgatcagcgtgggcgcccgcatgcactcgctgcccgaggcggtggagctggtcgagatcttcctcgcgacgccgttcagcggagagcagcgtcacctccgccgactgcggatgatctccgcctacgagcgttccggggagatccccgagccgtccccctcctcgccggcgtcctga

SEQ ID NO: 3297 - DNA, 405 bp, Frankia sp. EuI1c
gtgatttttggtgcggacgacaccaatgagtgcgtggccgcggtgcgggagtatctgcgggcgaactacgagaccacggtcgtcgatccgaccagctggccggagctttccgaaatggtggcccgtggcgtcgccgcgggcgagtaccgtttcggcgtgctgatgtgctggacggggacgggcacggcgatggcggcgaacaaggtccccggtgtgcgggccgctcaggcctgggagccgtggatcgcgaccaacgcgcgcctctggaacgatgcgaacgtcctcacgatgagtctgaagagaacggcccccgaggtcgcgctcgactgtttgcgggcatttctcgcggtagcggacccggatcccgaggagctatcgcagatcgaaaaggtccggggccggtag

SEQ ID NO: 3298 - DNA, 495 bp, Frankia sp. EuI1c
gtgcgcgtccatctcggttctgaccacgccggctatcacctgaaggccgccctcgtcgagcggctggccgagctcggccacactccggtcgaccacggccccagcgactacgaccccgacgacgactacccgccgttcgtcatggcggctgccgcggccgtcgccgccgagccgggcagcctcggcatcgtcatcggcggctccggcaacggcgaggccatcgcggccaacaaggttgacggcgtccgggccgcgctggcctggagcgaggagaccgcccgcctcggccgtcagcacaacgacgcgaacgtgctcagcctgggcgcccggatgcacgaggtgtccgaggccatcggcttcgcgcaggtgttcctggacacgccgttctccgacgagtccaggcacacccgccggctgcggatgctgaccggctacgagcggaccggggagctgccgccggtgccgaccggagcgcccgccccgccggctgtctga

SEQ ID NO: 3299 - DNA, 492 bp, Geodermatophilus obscurus
atgcgcgtcttcgtcgggaccgaccacgcgggcctggagttcaaggaccacctcaagcaggcgctgaccgacgccggccacgagccggtcgactgcggggcgttcgagtacgacgcccaggacgactacccgccgttctgcttcgaggtcggcgagcggacggtcaccgagcccggcagcctcggcgtggtcatcggcggctcgggcaacggcgagcagatcgcggccaacaaggtgcccggcgtgcgcgccgcactcgtgtggaaccgggagacagcggagctcgcccgtcagcacaacgacgccaacgtcgtctcgatcggcgcccggcagcacggcgtcgaggaggccaccgagctggtgctgcacttcctcgcgacgccgttcagcggcgacgagcggcacgtccgccggatcgggctggtcagcgactacgagcgcgaccggcaccgcccggccggcggactgcccacccgcgacgagccccggtag

SEQ ID NO: 3300 - DNA, 498 bp, Nakamurella multipartita DSM 44233
atgtccgagccgtggagcatcgtgatcggttgcgacgacgctggccttgagtacaagcaggcgctgaaggcggatctgctggccgacccgcgggtgggccaggtcatcgacgtcggcatcgacccggcgaaccccgccgcgtacccgcacgtggccgtcgcggccgcccgggcggtcgccctcggccaggccgaccgggccctgctgttctgcggcaccgggctcggcgtggccatcagcgccaacaaggtgcccggcatccgcgcggtcaccgcgcacgacagcttctcggtcgagcgatcggtgctgagcaacgacgcccaggtgctgtgcatgggccagcgggtcatcggcctggaactggcccgccggctggtccgcgaatggctcgactaccgcttcgacaccacgtccgcctccgcggccaaggtcgaggtcatcaaggcctacgaccgggccgagaccacgcaggacttcgacctggccgccgccagctga

SEQ ID NO: 3301 - DNA, 435 bp, Nakamurella multipartita DSM 44233
gtgcgcatctccgtctccgccgacgaggacaccggggtcgcccgggccgtgctcgacgagctgacggcccgcgggcaccggcccatccggcacggcgcgctggccgcgggagagcgagcggactgggcgtgggcctctgcggccgccgcccgcgacgtcgccgagggccgggccgagtcggccgtggtctgctgctggaccggcaccggcgccagcatcgccgccaacaaggtgccgggcgtccgggccgccctgtgctgggatgcccccaccgcggccggggcgcgccgctggaacgatgccaacgtgctggcgttgtcgctgcggagcacctcccgggcggtgctgaccgagatcctggatgcctggttcgctgccgacccgtcggacgatcccggcgaccgcgccaacatcgagcatctggacgcgctctga

SEQ ID NO: 3302 - DNA, 471 bp, Stackebrandtia nassauensis DSM 44728
atgagcagccgacagtggcggatcgccgtgggagccgacgaagccgggttccagtacaaggaggccatcgcgcgggacctcgccgaggactcgcgggtggggtccgttgtggatttcggggttgccgagggcgagaccaccccgtatgccagcgttggactgactgtcgctgaggccgtcgcgcggggtgaggtggatcgggcgatcctcatctgcggtaccggcatcgggatggcgatcagcgctaacaaggttccgggtgtgcgggccacgactgtttccgacagttactcgtgtgagcggtcggtgttgtccaacgactgtcagatcatctcgttcggacagcgggtcgtcggcctcgaactggcccgccgactggccagcgagtggcttggctacgagttcgaccccgcatcaccgtccaattcgaaggtcagcgtgatctcagcgtatgaacggaggaccccatga

SEQ ID NO: 3303 - DNA, 444 bp, Stackebrandtia nassauensis DSM 44728
atgcgtatttccgtagccgccgactgcaccgacggcgtcgccgggtcgcttatccaggcgctggaatcccgggggcacacggtgatcccgcacggcatcctcgccgaggacgaccgcgacgactgggcctggtgctgcgccgcagcagccgccgacgtggcggcgggccgggccgatcagggactggtcgcctgctggaccggcaccggagcctcgatcgccgccaacaaggtcgacggcgtccgagcggccctgtgcaccgacgcggccaccgccgacggtgcccgcaagtggaacgacgcgaacgtgctggcgttgagcctgcgactgacctcggcaccgcagctggaggagatcctggacgcctggttcggcggtcagcccagcaccgacgccgatgacgcggcgaacatccgccacctgggcgaactcgaacgccgctga

SEQ ID NO: 3304 - DNA, 468 bp, Stackebrandtia nassauensis DSM 44728
atgcgggtatacatcggcagcgaccacgccggattcgagctcaaaaccgccctggtgaagcacctgaccggtgtcgggcacgaggtcgtcgacgtcggcccccacgccttcgacgccgaggacgactatccgccgttctgcctgaacaccgcggcgcgcgtcgtcgccgacccgggcagcctcggcatcgtccttggcggttcgggcaacggcgaacagatcgccgccaacaaggtcgccggtgcccgcgccgcgctggcctggaaaccggagatcgcgaagctggcgcgcgaacacaacgacgccaacctcgtgtccatcggggcccggatgcactccaccgacgaagcgatcgccattgtggacgagttcctgtcggtgcggttctcgggcgccgagcgccacgcgcgccgcatctcacagctggacgactacgagcggacccgccaactgccgccactggtgtga

SEQ ID NO: 3305 - DNA, 504 bp, Kineococcus radiotolerans SRS30216
atgactgatctgcagtggcgcgtggtgctggccgccgacgaggcgggtgtctcctacaaggacgccatcaaggcggacctgctgaaggacccccgcgtgaaggaggtcctcgacgtcggcgtgaacggtgacgacgacaagaccgcctacccccacgtggccgtcgccgccgcccgcaagatcgccgccggtgaggccgaccgcggcatcctcgtctgcggcaccggcatgggcgtggccatcgcggcgaacaaggtccccggcatccgcgcctcggtggcccacgactccttctccgtggagcgcctggtgctctccaacgacggtcaggtcctgaccctgggcgagcgggtcatcggcaaggagctggcccgtcgcctggccaaggagttcctcggctacgtcttcgaccccagctccgcctccgcggccaaggtcgaggccatcaccggttacgagaccgtggccaacaccgacgccgacgtggccgcctcctcctgctga

SEQ ID NO: 3306 - DNA, 504 bp, Kineococcus radiotolerans SRS30216
atgactgatctgcagtggcgcgtggtgctggccgccgacgaggcgggtgtctcctacaaggacgccatcaaggcggacctgctgaaggacccccgcgtgaaggaggtcctcgacgtcggtgtgaacggtgacgacgacaagaccgcctacccccacgtggccgtcgccgccgcccgcaagatcgccgccggtgaggccgaccgcggcatcctcgtctgcggcaccggcatgggcgtggcgatcgcggcgaacaaggtccccggcatccgcgcctcggtggcccacgactccttctccgtggagcgcctggtgctctccaacgacggtcaggtcctgaccctgggcgagcgggtcatcggcaaggagctggcccgtcgcctggccaaggagttcctcggctacgtcttcgaccccacctccgcctccgcggccaaggtcgaggccatcaccggttacgagaccgtggccaacaccgacgccgacgtggccgcctcctcctgctga

SEQ ID NO: 3307 - DNA, 489 bp, Kineococcus radiotolerans SRS30216
atgcgcgtccacgtcggtaccgaccacgccggtttcgagctcaaggagcacctcgtcgcccacctgcgcgagcagggccacgacgtcgtcgaccacggggcgccggtgtacgacgccgccgacgactaccccccgttcgtcctgcgcgcggccgcgggggtggccggcgacccgggcagcctgggcatcgtcatcggcggttcgggcaacggcgagcagatcgccgccaacgtcgtccccggcatccgctgcgccttggcctggtcggtggacaccgcccgcctggcccgggagcacaacgacgcccaggtcgtggggatcggggcccgcatgcacacgctggaggaggccaccctgctggccgacaccttcctggcgacgccgttctcgaacgacccccgccacgtgcggcgcatcgagatgctcgacgcctacgcgcgcacgggggagctgccgccgctgccggcgggcgccgccgaccaggggtga

SEQ ID NO: 3308 - DNA, 459 bp, Beutenbergia cavernae DSM 12333
atgggactgcggatcgtcgtcggcgcggacagcgcgggcttcgagtacaaggaggcgctcaagcgcgacctcgaggctgacgagcgcgtgagcgacgtcgtcgacgtgggcgtggacgcgggcgggcagacggactacccgcacgtggccgtgtctgcggcccggctcgtggcgcggggggaggccgaccgggcgctgctcgtgtgcggcacggggctcggcgtcgcgatcgcggcgaacaaggtgccggggatccgggccgtgacggcgcacgactcgtactccgtcgagcgctcggtgctgtcgaacgacgcccaggtgctgacgttcggccagcgcgtcatcgggctcgagctggcgcgcaagctcgcggcggagtggctcgcgtacacgttcgacgcctcgtcgccgtcggcggtcaaggtgtcggcgatctcggagtacgaggcgcgtgactag

SEQ ID NO: 3309 - DNA, 471 bp, Beutenbergia cavernae DSM 12333
atggcatggcgcgtggtggtgggctcggacggagccgggttcgactacaaggaggcgctcaagcaggatctcttcgtgagcgatctggtgagcgacgtcgtggacgtcggagtacccgccgcggacgacggcgccaactatccgagcgtggcgttcgaggccgcgcgccgggtcgccgcgggcgaggcggaccgggcgctgctcgtgtgcggcacggggctcggcgtggcgatctccgcgaacaaggtcaagggcgtccgggccgtcacggcgcacgacgtctactccgtgcggcggtcggtgctgtcgaacgacgcccaggtgctctgcctcggccagcgggtgatcgggctggagctcgcgcgcgccctcaccgaggagtggctgacgctgacgttcgacccgacgtcggcgtccgcgccgaaggtggcggagatcgacacgtacgaggccgggaccggggcgtgctga

SEQ ID NO: 3310 - DNA, 450 bp, Beutenbergia cavernae DSM 12333
atgcgcatccacatcgccgccgaccacgccggcttcgagctgaagtccgtcctcgccgagcacctccgggcggcgggccacgacgtcgtcgaccacggcgccgacgcgtacgacgagctcgacgactacccggcgttctgtttcgccgccggcgaggccgtcgtcgccgagccgggcacgctcggcatcgtcatcgggggcagcgggaacggcgagcagatcgcggcgaacaaggtgcggggcgtgcgcgccgccctcgcctggagcacgacgacggcgtctctcgcgcgggcgcacaacgatgcgaacgtcgtggcgatcggcgcccggcagcactcggtggacgaggcgatcgagctcgtcgaggcgttcctcgctgaggcgttctcgggggacgcgcgccaccagcgccggatcgaccagctcgcggcgtacgagaccgcacgctga

SEQ ID NO: 3311 - DNA, 474 bp, Brevibacterium linens
atgaaggttcatctcggcaccgaccacgcaggattcgaattcaaagaggttctcaaggcccacctcggcgattcggggtacgaggtcatcgaccacggcgcgctcgaatacgacgcactcgatgactatcccgcgttctgcatcgccgcggcacaggctgtcgtcgatgatcaggcagcgggagttgaggccctcggcgtcgtcatcggcgggtccggcaacggagagcagatcgctgcgaacaaggtcaagggagcccggaccgccctggcctggaacaccgacaccgccaaactcgcgcgcgagcacaacaacgcccagatcgtgtcggtgggcgccaggcagcacacagaggctgagtcgatcgccatcgtcgatgccttcctctcggagcccttctccggcgaagagcggcacgagcgtcggattcggatcatggacgagtacgaggccacaggcaaggccggtctgtga

SEQ ID NO: 3312 - DNA, 516 bp, Cellulomonas flavigena
atgagcgtcgcgaggatcgtggtcggggccgacgaggcagggctggcgtacaaggacgcgctcgcggacctgctgcgcgcggacccgcgcgtcgaggtcgtcgaggacgtcggcgtgcacgcggacgacgacaccgcgtacccgcacgtcgccgtcgccgcggcgcgtcgcgtcgccgagggcggggccgaccgcgcgctgctcgtctgcggcacgggcctgggcatggcgatcgccgccaacaaggtgcgcggggtgcgcgcggtgaccgcgcacgacactttctccgtgcagcgctccgtgctgtccaacgacgcgcaggtgctgtgcctcggtcagcgcgtcatcgggctggagctcgccaagaccctcgtgcgcgagtggctcgcgcacgagttcgaccccgcgtccgcgtccgccgccaaggtcgacgcgatccgcgggtacgagaccgcggagcctggggagggctccgccgggatcgacggcaccgccaggggaggcgggagctgctga

SEQ ID NO: 3313 - DNA, 453 bp, Cellulomonas flavigena
atgcgcatccacgtcgccgccgaccatgccgggtacgagctgaaggtcgcgctcgtcgagcacctgcgggccgccgaccacgaggtcgtcgaccacggtgccttcgagtacgacgccgaggacgactaccccgcgttctgcttctccgccggggaggccgtcgtcgccgagcccggctccctgggcgtcgtcatcggcggctcgggcaacggcgagcagatcgcggccaacaaggtgaccggcgtgcgcgcggcgctcgcgtggaacgtcgagaccgcgcgcctcggccggcagcacaacgacgcgaacgtcgtcgcggtcggcgcgcggcagcactccgtcgacgaggcgatcgagctcgtcgacgcgttcgtcgccgagccgttcagcggcaacgcgcgccaccagcgccgcatcgaccagctggcggcgtacgaggccgcgcgctcctga

SEQ ID NO: 3314 - DNA, 471 bp, Brachybacterium faecium
atggcactgaagatcatcgtcggcggcgacaacgccggctacggccacaaggaagagctcaaggccctgttcgaggcggacgaccgcgtcgagtcggtcgtcgacgtgggcgtgggctccgcggacgacggcacctactaccccaacgtcgcggtcgccgcggcggagaagatcgccgcgggcgaggcggatcgcgccctgctgatctgcggcacgggactgggcgtcgcgatcgcggcgaacaaggtctccggcgtccgcgccgtgaccgcgcacgatctctactccgtgcagcgctccgtgctctcgaacaacgcgcaggtgctgtgcatgggccagcgcgtgatcggcctcgagtccgcgaaggagctggtgaaggtgtggctggacctggagttcgatccggagtcctcctcggccgcgaaggtcgacgccatctgcgcctacgacggctccctcgaccaggcctga

SEQ ID NO: 3315 - DNA, 471 bp, Brachybacterium faecium
atgggctggaagatcgtcaccggatcggacaacgccggtgtgggccacaagagcgccctgaaggacctgctggagaacgacccgcgcgtcgacgaggtcatcgacgtcggcgtcaccggccgcgaggacggcacctactaccccaacgtcgcggtcgccgcggcggagaaggtcgccgccggcgaggcggaccgggcgctgctgatctgcggcacgggcctgggcgtcgcgatcgcggcgaacaaggtctccggcgtccgcgccgtgaccgcgcacgatctctactccgtgcagcgctccgtgctctcgaacaacgcgcaggtgctgtgcatgggcgagcgggtcgtgggcctcgagctcgcgaaggagctggtgaaggtgtggctggacctggagttcgatccggagtcctcctcggccgcgaaggtcgacgccatctgcgcctacgacggctcgctcgacgaggcctga

SEQ ID NO: 3316 - DNA, 483 bp, Brachybacterium faecium
atgcgcgtgcacatcggtaccgaccacgctggtttcgagctgaagaaccgcctggtcgccgtgctgcagaagaagggccacgaggtcaccgaccacggggcccaccagtacgacgccctggacgactacccgccgttctgcaccgccgtgggcgaggccgtggtcgccgacccctcctcgctcggcgtcgtcatcggcggctccggcaacggggagcagatcgcggcgaacaaggtcgccggggtgcgcgccgccctggtgtggaacgaggacaccgcgcgcctggcccgccagcacaacgacgccaacgtcatctccgtcggcgcgcgccagcactccgaggaggagctcgaggcgctcatcgatctgttcctcgccgagccgttcacgggcgaggagcgccaccagcgcaggatcgacctcgtgggcctctacgagcgcaccggcggctacacggggtccgccgcgcccgcgaccgagtag

SEQ ID NO: 3317 - DNA, 462 bp, Kytococcus sedentarius
atgatcatccacatcggcggcgaccacgccgcccacgagttgcaacgccacctggtggcgtggctcaccgagcggggccacgaggtcgtggaccacgggccgctggagtacgacgcacaggacgactacccggtcttcgtgctgcccaccgcgcaggcggtggccgcggacccggactcgcgggggatcgtgctgggcggatcgggcaacggtgagcagatggcggccaacaaggtggccggcgtccgggcggccctggcctggcagcccgagctcgcggcgctcgcgcgccagcacaacgacgcccgcgtcgtcagcatcggcgcgcgcttcaccgacaccgcgaccgccgaggcgatcgtggaggccttcctgaccaccgagttcgagggggaggagcgccacgcccgccgcgtggccatggtggaggcctacgagcgcgacggctcgctgcccggctga

SEQ ID NO: 3318 - DNA, 468 bp, Janibacter sp. HTCC2649
atgcgcgttcacatcggcggcgaccacgcggcatacgagctgcagcaggacctcatcgcgttcctcgggaccgaagggcacgaggtgaccaaccacggtcccttcgacctcgacccgctcgatgactaccccgtcttcgtgctgcgcgcggccgaggccgtcgccaccgacgagggctcgctcggtgtcgtcctcggcggctcgggcaacggtgagcagatggccgccaacaaggtcgccggtgtgcgggccgcgctctgctacaacgacgagctggcccagcttgcgcgcgaacacaacaacgcccaggtcatctccatcgggggccgcatgaacaccgtcgaggaggcgcgctccatggtgcgcaccttcctcgcgacccccttctcgggtgaggaacggcaccagcgccggatcgacatggtgagcgcctacgaggacaccaaaaccctgcctgatctgccctga

SEQ ID NO: 3319 - DNA, 453 bp, Jonesia denitrificans
atgcgtgtacacattgcttcagatcatgccggattcaagctcaaggcgtacctcatcgctcacctcgcagagcaaggccacgacgttgtggatcacggcgcccaccactacgacgctctcgacgactacccctccttctgcttcgacgcagcgcaagcagtcgttgacgaacctgacaccctcggcatcgtcatcggcgggtcagggaacggcgaacaaatcgccgccaacaaagtcaacggagtacgtgccgtcttggcatggtcaaccaccaccgcacaacttggccgccaacacaacaacgccaacgtcatcgccatcggagcgcgccaacacacagtagaagaagccgcatccttcgttgacgccttcctcaacgagcccttttcccaagacccacgccaccaacgccgcatcgaccaacttgcccagtacgaggcaacccgttcctaa

SEQ ID NO: 3320 - DNA, 462 bp, Clavibacter michiganensis
atgaccaggacctggcgcatcgtcgtcggcgcggacgacgcgggatacgaccacaaggaggcgatcaaagccgacctcgaggcgagcggcctcgtcgtctcggtggtggacgtgggcgtcgacgccgacgggcacaccgcctacccgaccgtcgcgaccacggcggccgagatggtcgcgcgcggcgaggccgaccgggccgtgctgatctgcggcacggggctcggcatggccatcgcggcgaacaaggtggccgggatccgcgccgtcaccgcgcacgacggcttctcggtggagcggagcgtgctgtccaacgacgcgcaggtgctctgcatggggcagcgcgtcgtggggctggagctcgcgcggcggaacgtgcgcgagtggttgacgtacgagttcgacacctccagcgcctcggccgacaaggtggacgagatccgcgcgtacgaagcgaagtag

SEQ ID NO: 3321 - DNA, 489 bp, Clavibacter michiganensis
atgcgcatccacatcgcgaccgaccacgcgggcctcgacttctcgaggtacctcaccgggcacctgaccgacgccggccacgacgtcgtcgaccacgggcccacgtcctacgacgcgctcgacgactacccgtcgttctgcatccgcgctgcccgagccgtcgtcgccgaccagcgcgacggcgcgaccgcgctcggcgtggtgttcggcgggtcgggcaacggcgagcagatcgcggccaacaaggtcgagggcgtccgcgcggcgctcgtctggaacctgtcgacggccgtgctcgcgcgccagcacaacgacgccaacgtgatctccatcggcgcccgccagcacacggtcgaggaggccacggccttcatcgacgccttcatcgccgagccgttctccgcggaggagcggcacgcgcgccgcatcgcgcagctggccgagtacgagacgacgggggccatcgccggtcaccccgtcaccgactag

SEQ ID NO: 3322 - DNA, 462 bp, Clavibacter michiganensis
atgaccaggacatggcgcatcgtcgtcggcgcggacgacgcgggctacgaccacaaggaggcgatcaaggccgacctcgaggcgagcggcctggtcgcctcggtggtggacgtgggcgtcgacgccgacggccacaccgcctaccccaccgtcgcgaccacggcggccgagatggtcgcgcgcggcgaggctgaccgggccgtgctgatctgcggcacgggcctcggcatggcgatcgcggcgaacaaggtcgccggcgtccgcgccgtcaccgcgcacgacggcttctcggtggagcggagcgtgctctccaacgacgcgcaggtgctctgcatggggcagcgcgtcgtcgggctcgagctcgcgcggcggaacgtgcgcgagtggctgacgtacgagttcgacacgtcgagcccgtcgaacgacaaggtcgacgagatccgcgcgtacgaggcgaagtag

SEQ ID NO: 3323 - DNA, 489 bp, Clavibacter michiganensis
atgcgcatccacatcgcgaccgaccacgccgggctcgacttctcgcggttcctcgccgagcacctgggcgcccaggggcacgacgtggtcgaccacggccccacctcgtacgacccgctcgacgactacccgtcgttctgcatccgcgcggcccgcgcggtcgtcgccgaccaacgcggcggcaccaccgccctgggcgtggtgttcggcggatccggcaacggcgagcagatcgccgcgaacaaggtcgagggcgtgcgcgccgcgctcgtctggaacctctcgaccgccgtgctcgcgcgccagcacaacgacgccaacgtgatctccatcggcgcccgccagcacaccgtcgaggaggccacggccttcatcgacgcgttcatcgccgagccgttctcggcggaggagcggcacgcgcgccgcatcgcgcagctcgccgagtacgagacgacgggggccatcgccggtcaccccgtcacggactag

SEQ ID NO: 3324 - DNA, 489 bp, Leifsonia xyli subsp. xyli str. CTCB07
atgcgcatccacatcgccaccgatcacgccggtctcgatttcagcaagcacctccaggcgcacctggcgcaggccgggcacgaggtcatcgaccacggtccggccgagtacgacccgatcgacgactacccggcgttctgcgtcaacgcggccaagggggtcgtgcgcgaccagcaggcgggcatcgaggccctcggcgtcgtgttcggcggctccggcaatggcgagcagatcgctgcgaacaaggtcatcggcgcgcgcgcagccctcgtctggaacgagagcactgccctgctcgctcgccagcacaacgacgccaacgtcatctcgatcggcgctcgccagcacacggtggcggaggcgacgcgcttcatcgaactgttcatcgccgagccgttctcgctcgaagaacggcacctccgccgcatcgcgcagctggccgagttcgaggcgaccggcgacatcgccggcaagaacgtggatcgctga

SEQ ID NO: 3325 - DNA, 546 bp, Microbacterium arborescens
atgcgcatccatatcgcgaccgaccacgccggtctcgagttctccactcagctccagcaccatctcgccgaggcgggtcacgatgtcgtcgaccatggcccgatcgagtacgacccgctcgatgactaccccgcgttctgcatccgcgcggcgcaggccgtggtgcgggaccagcaggccggcgtcgaggccctcggcgtcgtcttcggcggctcgggcaacggcgagcagatcgcggcgaacaaggtccacggggtccgagccgcactcgtgtggaacatcccgaccgccgagctcgcacgggagcacaacgacgcgaacgtgatcgcgatcggcgcccggcagcacacgttcgacgaggctgtgaccttcatcgaccgcttcatcgcgactccgttcagcggcgaggagcgtcacgcgcgccgtatcggtcagctcgcggcgtacgaggccgacggcagcctgctgcccgaccctcgagcaggtgcggagggcattgcgtcgccgctccccgccacggactcgttcgatccggaagcgggctga

SEQ ID NO: 3326 - DNA, 483 bp, Arthrobacter aurescens
atgagcaacaaccacggctggcgcatcgtcgtcggcaacgatgaagccggtgtcgagtacaagcaggcactccttgccctgctggaagcggacccgcgcgtggcttccgtgacggacgtcggcgttgacttcaacgactccacggcctacccgcacgtcgccgtcgatgccgcccgcaaggtggctgagggcgaagctgaccgggccttgttgatctgcggcacgggattgggtgttgcgattgccgccaacaaggtccccggagtccgcgcggttaccgcccacgacagctactccgtggaacggtccgtcctgagcaacaatgcccaggtcctgacgctgggccagcgggtgattggcttggaactggccaaaaagctcgtaggggagtggctcgaccaccgcttcgatcaaaactcatcctccgccgccaaggtggacgccatctgctcgtacgagcccgactacacgaaggcagtctga

SEQ ID NO: 3327 - DNA, 459 bp, Arthrobacter aurescens
atgcgcatcattgtgggcgccgacgaagccggcgttgattacaaagaccggatcatggccgatcttgaggccgactccaggatcaccgaagtgatcgacatcggagtgaaccgcgcggatgaggacttcaccaggccctacccctatgtgggcattgccgccggtgaaatgatccgggacggcaaggctgaccgggccatccttttctgcggcacgggaatcggcgtggcaatcgcggccaacaaggttccgggcatcagggccacggcagcccatgattcgttctccgtggagaggtccatccggtccaacgactgccaggtcctcaccatgggccaacgcgttgtgggcgtggaactggcccgtcgcttggccaaggagtggatcggctacgccttcgatccctcctcggggtcggccgccaaggtgaaggtgctcagcgacttcgagggctgctag

SEQ ID NO: 3328 - DNA, 483 bp, Arthrobacter aurescens
gtgacaacaccccgcgtccacattgctaccgaccacgccggcatggaactcagtgcccacctggtcagccacctcacggccaaaggctacgaagtggtggatcacgggcccaaggagtacgacgccctggacgactacccctcgttctgcatcaatgccggccttgcggtggtggcggaccagaaagccggtgtgcacgctctcggcatcgtgctgggcggctcaggcaacggggaacaaattgctgccaacaaggtcaacggcgtccgcgctgcgctggcttggaacctctccacagctaagttggcccgcgagcacaatgacgccaacgtcgtagctgttggcggacgccagcacaccgttgaagaagccacggagctcattgaagccttcctgcaggaaccgttcagcaacgacgaacgccacgttcgccgaatcggaaaaatcgcggtgtacgaaaccaccggcgagatcgtcgagtag

SEQ ID NO: 3329 - DNA, 492 bp, Arthrobacter chlorophenolicus A6
atgagcacggaagggcaggccatggggctgaggctgattgttggcgcggacgaagccggcgtcgactacaaggacagggtgctggaggacctgcgcaacgatccccgggtcagcgaggtcatcgacatcggcgtcaaccgcggtgattcgccggaggacttcaccaggccgtatccgtacgtgggcatcgctgccggtgaaatgatccgggacggcgctgccgaccgcgccatcctcttctgcggtaccggaatcggcgtggccattgccgccaacaaggtggaaggtatccgcgccacggcggcgcacgattcgttctccgtggagcgctcggtgctgtccaatgactgccaggtgctcaccatgggccagcgggtggtgggcatcgagctggcccgcaggctggcgaaggaatggatcggctacaccttcgacccgggctccgcctcggccggcaaagtcaaggtcctcagcgacttcgagtcctgctag

SEQ ID NO: 3330 - DNA, 495 bp, Arthrobacter chlorophenolicus A6
gtgacctcatccccttccttcccgcgggtccacatcgccaccgaccatgcagggatggagctcagcgcccatctggtctcccacctcaccgccaagggctacgacgtggtggaccacgggcccaaggcctacgacgcccaggacgactacccgtccttctgcatcaacgcagccctcgccgtcgtggccgaccagcaggcaggcgtccacgccctgggcatcgtgctgggcggctcgggcaacggcgagcagatcgccgccaacaaggtcaagggcgtccgggcagcactggcgtggaacctttccaccgccaccctggcccgtgagcacaacgacgccaacgtggtggccgtcggcggccgccagcactccgtggaggaagccaccgggctgatcgaggcgttcctggccgagccgttcagcaatgacgaacgccacgtccgccggatcggcaagatcgcggcttacgaatcaaccggcgaggtcatcgagtag

SEQ ID NO: 3331 - DNA, 492 bp, Arthrobacter sp. FB24
atgagcgcagaccagagcactgcaggatggcgcattgtcatcggcaacgatgaagcgggcgtcgaatacaaggaagcgctgaaggcgctgctcgaagcggacagccgcgtcgcgtccgtggtggatgtgggagtcggcgccaacgactcgaccgcatacccgcacgtcgccgttgacgccgcccgcaaagtggccgaaggcgaggcagaccgcgccctgctgatctgcggcaccgggctgggcgtggccatcgcggccaacaaggtccccgggatccgcgccgtcaccgcccacgacggctactccgtggaacgctcggtcctgagcaacaacgcccaggtcctcaccatgggccagcgcgtgatcggcctggaactggccaagaaactggtgggcgaatggctcgactaccgtttcgacgagacctcatcctccgccgccaaggtggacgctatctgctcttacgagcccgactacacgaaggcagtctga

SEQ ID NO: 3332 - DNA, 492 bp, Arthrobacter sp. FB24
atgaccagggaaggacaggccgtgggtatccgactcatcctgggcgccgatgaagccggcgtggactacaaggaacggatcatggaggacctgcggaaggacccccgggtcagcgaaatcatcgacattggcgtcaaccgcagtgatgcccccgagaagttcaccaccccgtacccgtacgtggggatcgccgccggggaaatgatcaaggacggcctggccgaccgggccatcctgttctgcggcaccggcatcggcgtagccatcgccgcgaacaaggtggagggaatccgggcagccacggcccacgactccttctcggtggaacgctcggtgctgtccaacgactgccaggtgctcacaatgggccagcgcgtggtgggtgtggagctcgcccgccggctcgcccgggagtggctgggctacaccttcgaccccgcatccgcctcggcgggcaaggtcaaggtcctgagcgacttcgaaggctgctga

SEQ ID NO: 3333 - DNA, 495 bp, Arthrobacter sp. FB24
gtgaccacatcttccgacttcccgcgcgtccacatcgccacagaccacgccggcatggagctcagcgcccatctggtaacccacctcacggccaagggctacaccgtggtggaccacgggcccaaggtctatgacgcactggacgattacccgtccttctgcatcaacgcggcgcttgccgtcgtggcggaccaggcggcgggaatcaacgccctgggtatcgtgctcggcggctcggggaacggcgagcagatcgccgcaaacaaggtcaagggtgtccgtgcggcgcttgcctggaacctgtccacggcaaccctggcccgcgagcacaacgatgccaacgtcgttgcggtcggcggccggcagcacagcgtggacgaagcgacggaaatcatcgaagccttcctgcgggaaccattcagcaacgatgaacggcacgtgcgccgcatcggcaagatcgcggcctacgagaacaccggcgaggttatcgcctag

SEQ ID NO: 3334 - DNA, 513 bp, Kocuria rhizophila DC2201
atgcgcgtgcacatcgccactgaccacgccggcctcgacctctcccaccacctcatgcagaagctcaccgagcacgggtacgagatgatcgaccacggaccgcaggagtacgacccggcggacgactaccctgcgttctgcatcagcgccgccctgggcgtgcgggaggaccgcgcgaacggcctcgactcgctgggcatcgtgctgggcggctccggcaacggcgagcagatggccgccaacaaggtggagggcattcgtgccgccctcgtgtggaaccaggacaccgccaagctcgcgcgcgagcacaacgacgcccaggtcatggccatcggcgggcggcagcacgagacggacgaggccctgcagctcgccctgaccttcctggccgagccgttctccggggacgagcgccacgtgcgccgcatcgcccagctgggcgagtacgagcgcaccggggatgtcgcgggcaggttgtccgcgatcacgccccgccccttcacggcgaactga

SEQ ID NO: 3335 - DNA, 474 bp, Micrococcus luteus
atgcgcgtccacatcgccaccgaccacgccggcatggagctgtccgcccacctcgtggagcacctcaccgccgccggctacgagatggtggaccacggacccaccgagtacgacccgcaggacgactacccgggcttctgcatcaacgccgcccgcgccgtcgtcgccgaccgcgagcaggggctggactcgctcggcatcgtgctgggcggctccggcaacggcgagcagatcgccgccaacaaggtggccggcgtccgcgccgccctggcctggaacctggacacggcgcggctggcccgcgcgcataacgacgcgaacgtcgtggccgtcggcggtcggcagcactcgctcgaggaggccaccgagctcatcgaggcgttcctggccgaaccgttctcccaggacgagcgccacgtgcgccgcatcgggaagatcgcgcactacgaggccaccggagaggtgctgatgtga

SEQ ID NO: 3336 - DNA, 537 bp, Renibacterium salmoninarum
gtgccgaaagctagtacgctcgatacagaatcaattactaatccgaggagaactatgtctaccccccgcgttcacattgccactgatcacgccggccttgagcttagcgctcacctgatttcgcatcttggcgatcgcggctatgaagtgattgatcacggaccaagttcctacgacccggaggacgactacccggcgttttgtatccatgcggcgcaggcagcgatggcggacactaaagctggtgttttcgcattaggaattgttctgggtggctctggaaatggtgaacagattgcggctaacaaggtcgaaggcatccgagcggcgcttgtttggaacctagagaccgcaaagctggcccgcgaacataatgatgcaaatgtggtcgcagttggtgggcgtcaacacagcgtcgatgaagcaactggcctcatcgaagcgttccttgcggagccgtttagcgatggtgagcggcatgtgcggcgcatcggcaaaatcgctcatttcgaacaaaccggtcaggtccaagactag

SEQ ID NO: 3337 - DNA, 492 bp, Rothia mucilaginosa ATCC 25296
atgcgcgtacacatcgcaaccgaccacgctggcctcgaactgagccactacctgattgagtccctcaccgctgcgggctacgaaatgattgaccacggccccgccgactacgacccgctggacgactacccctcgttctgcattaacgcagcccttggcgtgaagcgtgaccgcgaggctggcctggactccctgggtattgtgctgggcggtagcggcaacggcgagcagatggctgcgaacaaggttgatggtatccgcgcggctctggcatggaaccacgacaccgcagcgctggctcgcgagcacaacaacgcacaggttgtagctgtgggcggtcgccagcacagcaaggaagaagcactggaaatcatcaaggtcttcctggctaccccctggaccaacgaggagcgtcacgcacgccgtatcggtcagctggctgagtacgagcagaccggcgacattgccggcaagcagattgacgctgcctaa

SEQ ID NO: 3338 - DNA, 459 bp, Xylanimonas cellulosilytica DSM 15894
atgcgtcttcacatcggcaccgaccacgccggattcgagctcaagaaccacctcgtggagcacctgcgctccgagggtcacgacgtcgtcgaccacggcgcgcacgtctacgacgcgctcgacgactacccggccttctgcatctccgcggccgaggccgtcatcgccgagcccggctcgctcggcatcgtcatcggcggctcgggcaacggcgagcagctcgccgccaaccgcgtgcccggcatccgcgccatcctcgcctggtcggtcgagacggcgaagctcggccgccagcacaacgacgccaacgtgatctccgtgggcgggcgcatgcacaccgtcgaggagtcgacggcgatcatcgacgcgttcctcgccgagccgttctccggcgacgagcgccaccagcgccgcatcgaccagatgctggcctacgaggcccagcgcgacgcccgctga

SEQ ID NO: 3339 - DNA, 450 bp, Sanguibacter keddieii DSM 10542
atgcgcgttcacatcgcttccgaccacgccgggtacgagctcaagagccacctcgtcgagcacctgaccaccgagggccacgacgtcgtcgaccacggtgcccacgagtacgacgccctcgacgactacccctcgttctgcttcgcggccggtgaggccgtcgtcgccgacccgggcagcctcggcgtcgtcatcggcggctccggcaacggcgagcagatcgccgccaacaaggtgcccggcgtccgcgccgcgctcgcctggaacctcgacacggctcgcctggggcgccagcacaacgacgcgaacgtcgtggccgtgggcggccgccagcacacggtcgaggaggccacgtccttcgtcgacgcgttcctcgccgagccgttcagcggagacgcgcgccaccagcgtcgtatcgaccagctcgcggactacgaggcctcccgctga

SEQ ID NO: 3340 - DNA, 468 bp, Tropheryma whipplei str. Twist
atgagcggcagggttcatctggctaccgatcatgccggttatgagttctctaaaggtcttttgaactttcttgctgatgagcattatcaggttgttcatcatggtgcagttaattgtgatcctgaggatgattatccatctttctgcatcgctgcggcagaggctgtagtacgggatattacagacggtattccatctcttggggttgttatcggtggcagcggaaacggtgaacagatagctgcaaataaggttaagggtgcaagggccgccctggcgtggaatgagtgtaccgctcgtcttgccagggcacacaataatgcaaacgtagttgccatcggtgcaagaatgcatgcccatgacgagggttttcggatagttttggcatttctacgggaaccattcagtgaggactcgcggcatatcagaaggatagatgcgataagtttgtatgagtgtcagtcttga

SEQ ID NO: 3341 - DNA, 468 bp, Tropheryma whipplei TW08/27
atgagcggcagggttcatctggctaccgatcatgccggttatgagttctctaaaggtctcttgaactttcttgctgatgagcattatcaggttgtccatcatggtgcagttaattgtgatcctgaggatgattatccatctttctgcatcgctgcggcagaagctgtagtacgggatattacagacggtattccatctcttggggttgttatcggtggcagcggaaacggtgaacagatagctgcaaataaggttaagggtgcaagggccgccctggcgtggaatgagtgtaccgctcgtcttgccagggcacacaataatgcaaacgtagttgccatcggtgcaagaatgcatgcccatgacgagggttttcggatagttttggcatttctacgggaaccattcagtgaggactcgcggcatatcagaaggatagatgcgataagttcgtatgagtgtcagtcttga

SEQ ID NO: 3342 - DNA, 471 bp, Micromonospora aurantiaca
atgcgcgtctacctgggatccgaccacgctggtttcgagttgaaggtgcacctcgccaaccacctggccaagcagggctacgaggtggtcgacgtgggaccgcacgtcttcgacccggacgacgactacccggcgttctgcctgcacaccggtgaccgggtggtcggcgacccgggcagcctcggcgtggtgatcggtggctccggcaacggcgagcagatcgcctcgaacaaggtcgcgggcgtccgggcggcgctcgcctggaacgtcgacaccgcccagctggcccgcgagcacaacgacgcgaacgtcgtcgccatcggcgcccggcagcacacgctggacgaggccacagcgctcgtcgaggcgttcctcaccacgccgttctccggcaacccccggcacagccggcgcatcgagcaggtggccgcctacgagcagagccgccgcctgcccgagctgcccgcctga

SEQ ID NO: 3343 - DNA, 477 bp, Micromonospora sp. ATCC 39149
ctgcgcggtatgcgcgtctatctgggatccgatcacgccggtttcgagctgaaggtgcacctggccagccacctcgccaagcaggggtacgaggtggtcgacgtcgggccgcacgtcttcgacccggacgacgactacccggtgttctgcctgcacgccggcacccgcgtggtcgccgacccgggcagcctcggcgtggtcatcggcggttcgggcaacggcgagcagatcgccgccaacaaggtcgccggcgtccgggcggcgctggcctggaacatcgacaccgcccagctcggccgggagcacaacgacgcgaacgtggtggccgtcggtgcccgccagcacaccctggacgaggcgaccgccatcgtcgaggcgttcctcaccacgtcgttctccggcaacccccggcacgcccgccgcatcgaccaggtcgccgcgtacgagcagagccacgagctgcccgaactgccctga

SEQ ID NO: 3344 - DNA, 468 bp, Salinispora arenicola CNS-205
atgcgtgtctacctgggatccgaccacgccggcttcgagctgaaggcgcacctggccaaccacctggccaaggaggggtacgacgtggtcgacgtcggcccacaggcctacgacccggacgacgactacccggcgttctgcctgcacaccggggaccgggtggtggccgacgggggtagcctcggggtggtcatcggcggctcgggcaacggcgagcagattgccgcgaacaagatcgacggtattcgggccgcccttgcctggaatatcgatacggcacacctggcccgagagcacaacaacgccaacgtcgtcgcgatcggcgctcggcagcacaccctcgatgaggccaccgccatcgtcgaggcgttcctgaccaccccgttctccggtaaacagcgtcactcccgccgcatcgaccaggtggccgactacgagcgcacccgggagctcccggacctgccctga

SEQ ID NO: 3345 - DNA, 468 bp, Salinispora tropica CNB-440
atgcgtgtctacctgggatccgaccacgccggtttcgagctgaaggcgcacctggccaaccacctggccaaggaggggtacgacgtgattgacgtcggcccgcacgcctatgacccggacgacgactacccggcgttctgcctacacaccggcgaccgggtcgttgccgaccagggtagcctcggggtggttatcgggggctccggcaacggtgagcagatcgcggcgaacaagatcgacggtgttcgggccgcgctcgcctggagcattgacaccgcgcacctggcccgggagcacaacaacgccaacgtcgtcgcggtcggcggccggcagcacaccctcgatgaggccaccgccatcgtcgaggcgttcctgaccaccccgttttccgaaaaacaacgtcacgtgcgccgcatcgaccaggtggccgactacgagcgcacccgggagctcccggacctgccctga

SEQ ID NO: 3346 - DNA, 459 bp, Aeromicrobium marinum DSM 15272
atgcgcgttcacgtcgcggcggaccacgccggtttcgagctcaagacccatctgctggcctggctgaccgggcagggccacgagccggtcgaccacggcgccttcacctacgacgccgaggacgactacccgccgttctgcgtcgccgcggcccaggccgtcgtcgacgaacccggatcgctcggcatcgtcatcggcggatcgggcaacggtgagcagatggccgccaacaaggtcaccggcgcacgggccgccctggcgtggagcaccgagacggccgccctggcccgtcagcacaacaacgcccagatcgtgtcgatcggggcccgcatgcactccgtcccggaggtcgaggcgatcgtcgagaccttcctgacgacaccgtggagcgaggccgaccggcaccagcgacggatcgacctgctgctgggctacgagaccagcggcacctttgcctga

SEQ ID NO: 3347 - DNA, 477 bp, Kribbella flavida DSM 17836
atgcgagtgcacatcggctctgaccacgccggcttcgaactgaagaaccacctggtccagcacctcacggctgccgggcacgacgtcgtcgaccacggcccggccgtgtacgacgcggtggacgactacccgccgtactgcctgcgcacggccgtggcggtggtccaggacgacggcagcctgggcgtcgtgatcggcggctcgggcaacggcgagcagatcgccgcgaacaaggtgaagggcgcccgggccgcgctggcctggagcgacgagaccgcccggctgggccgcgagcacaacaacgcgaacgtgatcagcatcggcgcccggatgcacagcaccgagcaggccaccggtttcgtcgagacgttcctggcgaccggctactccgacgaggaccggcacacccggcggatcgagatgctgagctcctacgagcggaccggcgagctgccgccgctgccggaatcgtcctga

SEQ ID NO: 3348 - DNA, 489 bp, Nocardioides sp. JS614
atgcgcgtgcacctcggctgcgaccatgccggactcgacctcaaggaccacctcagtcgctggctcaccgaccacggctacgagcccgtggaccacggcccgttcgcctacgacgccctcgacgactaccccgtgttctgcctgcgcgccgcggcggcggtggccgaggagcgggccgccgggcgggacagcctgggcgtggtgatcggcggctccggcaacggcgagcagatggccgcgaacaaggtgcacggcatccggtgtgcgctggtctggtcggaggagaccgcggtcctcgcccgtcagcacaacgatgccaacgtcgtctcggtcggcggccggatgcactccttggaggacatgacccgcttcgtcgagatcttcctcgccgagccgttcagcggcgaggagcgacacgtgcgtcggatcgggcagctggcggcgtacgagagcaccggcgagctccccgccctccccggcgatgcctga

SEQ ID NO: 3349 - DNA, 483 bp, Propionibacterium acnes
atgggactaaggatcgttgtcgccgctgatccggcggcagtcgagtacaaggatgtcgtcaaggctgacctggaagcggattcgcgagtcgatgacgttatcgacgtcggtgttcaggctggtgacgacaccctctacccgcacatcggcatcaaaggagctcacgtcatcaaagatggaaaggccgatcgaggaatcttcttctgcggcaccgggatgggcatggccatcacggccaacaaggtgccaggcattcgcgcctgtaccgcccacgactccttctccgtagagcggctcatcatgtccaacgacgcccacgtgctatgcctcggccaacgcgtcatcggtcgcgaacttgcccgtcgcttagcccacgagttcatcgggtacaccttcgacccgagttcccactccaaggccaacatcgatctcatcgacgcatatgagtcaggtgctggggaatccgcccctggcaactgctga

SEQ ID NO: 3350 - DNA, 474 bp, Propionibacterium acnes
atgacctttaagccttcacatgttcatatcggcaccgaccatgcggcctttgagcttaaggagtacctcgttggcaagttgaccgaagctggataccaggtcgtcgatcatggtgcggctagctatgactctcaggatgactatcccgactactgcatcccgtgtgctcaggccgtgatggccgacccggggtcgcttggcatcgtgctgggtggttccggcaacggagagcagatcgctgcgaacaaggtcaaggggattcgcgccgcactggcgtacaccgtcgagatcgcggaactggcacgtctccacaacaatgcgaacgttgtctctttgggtggccggatgcagactcaggaggaagcctggcagatcgtcgaaactttcctgacgaccgatttctcccccgaggaccgccaccagcgtcgtattgacaagctcattcgctgggaggacaagggctcactggggtga

SEQ ID NO: 3351 - DNA, 474 bp, Propionibacterium acnes
atgacctttaagccttcacatgttcatatcggcaccgaccatgcggcctttgagcttaaggagtacctcgttggcaagttgaccgaagctggataccaggtcgtcgatcatggtgcggctagctatgactctcaggatgactatcccgactactgcatcccgtgtgctcaggccgtgatggccgacccggggtcgcttggcatcgtgctgggtggttccggcaacggagagcagatcgctgcgaacaaggtcaaggggattcgcgccgcactggcgtacaccgtcgagatcgcggaactggcacgtctccacaacaatgcgaacgttgtctctttgggtggccggatgcagactcaggaggaagcctggcagatcgtcgaaactttcctgacgaccgatttctcccacgaggaccgccaccagcgtcgtattgacaagctcattcgctgggaggacaagggctcactggggtga

SEQ ID NO: 3352 - DNA, 489 bp, Propionibacterium freudenreichii subsp. shermanii
atgggattcaaggttgcagtggccgcagacgcggctggtgtggattacaaggaagccatcaaggctgacctcgaagctgatccgcgcgtggacgaagtgatcgacgtgggcatcgcccccggagagaccaccccgtacccgcgcaagggcattgccggcgcacgcgtgatcgccgaaggcgacgctgaccgcggcatcttcgtgtgtggcaccggcatgggcatggccatttcggccaacaaggtgcccggcatccgtgcctgcaccgcccacgacagcttctcggtggagcgcctggtgatgtcgaacaacgcgcaggtgctgtgcctgggcgagcgcgtgatcggcctggagctggcgcgccgcctggcccacgagttcctcgactacacctttgaccccacctcgcactcgaaggccaatgttgacctgatcgtggagtacgagaaggagaccggagccgacgacaactcagtgacgagctgctga

SEQ ID NO: 3353 - DNA, 447 bp, Propionibacterium freudenreichii subsp. shermanii
atgcgtattgcgatgggaagtgaccatgcaggtttcgagctcaaggaacacctgaagggctacctgcagggcaagggtcacgacgtgattgatgtgggcacccacagcacggagagcgtcgactaccccgtgtatggcgccggggcggcacgcaaggtggccgccggtgaggccgatcgcgcgatcgtggtgtgtggcaccgggttgggcatcggcatggccgccggcaaggtgcccggcatccgctgcgccatcgtctccgaggtgtactccgcgcagatgtcgcgcctgcacaatgacgccaatgcgctcgcgctgggtgcgcgggtgatcggcaccggcgtggccgaggaaatcgtcgacgtgtggaccaccaccgacttcctgggtggacgccacgggcgtcgcgtcgacatgatcgaggatccgccggcgctggacgcgtag

SEQ ID NO: 3354 - DNA, 483 bp, Propionibacterium freudenreichii subsp. shermanii
atgcgcatcgcgatgggcagcgaccatgccggtttcgatctcaaggaacacctcaaggaatacctgcagggcaagggccatgaggtgatcgacgtcggcacgcacagcaccgagagcgtcgactacccgatctatggggcggccgccgcccgcaaggtcgccgacggcgaggccgccacggccatcgtggtctgcggcaccggcgtgggcatcggcatctcggccaacaaggtgcacggcatccgctgcgccatcacctccgacgtctacgccgcccgcatgtcgcgcgcccacaacgacgccaacgcgcttgccctgggcggacgcgtggtcgccgacggcctggccgaggagatcgtcgacgtgtggcttgccaccgacttcgagggtggacgccacgcccgccgggtcggtgagatcaccgcgctcgaggacggccaggacatcaccgccgacgaccttgacgagcacgatcagctgtaa

SEQ ID NO: 3355 - DNA, 483 bp, Actinosynnema mirum
atgaccgcgcagctccggatcgtcgtcggctccgacgacgccggcttcgagtacaaggaagccctcaagcgggacctggaggccagcggcgccgtcgtgtccgtcgtcgacgtcggcgtcgaccccgacggccacaccccgtacccggcggtcgcggtctccgccgccgagatgatcgccaggggcgaggcggaccgcgcgctgctggtgtgcggcaccggcctcggcgtggccatcgccgccaacaaggtgaccggcgtgcgcgccgtcaccgcgcacgacagcttctccgtcgagcgcgccgtgctcagcaacaacgcccaggtgctgtgcttcggccagcgcgtcgtgggcctggagctggcccgccgcctggcccgcgagtggctggagtaccgcttcgacgagggctcggcctccgcgcagaaggtcgccctgatcaccgagtacgacgagggccgcgagaccgcggggacgcgctga

SEQ ID NO: 3356 - DNA, 486 bp, Actinosynnema mirum
atggcagacttcaccgacgtgcgcgtttaccttggatcggaccacgcgggcttcgagctgaagacccacctcgtgcagtacctgaccgagacgggccacgaggtcgtcgacgtcggcccggcggtgtacgacgccgaggacgactaccccccgttctgcatcgaggcggcccgccgcgtcgtcgccgacgagggcagcctgggcatcgtgatcggcggctccggcaacggggagcagatcgcggcgaacaaggtccccggcgcccgctgcgccctggcctacaacgtcgagaccgcccagctcgcccgccagcacaacaacgcccagctgatcggcgtcggcggccggatgcacaccaccgaggaggcgacggcgatcgtcgaggcgttcctcgcgaccccgttctccgagcaggagcggcacgcccggcgcatcgacatcctcgccgagtacgagcgcaccggtcaggccccggccctgccctga

SEQ ID NO: 3357 - DNA, 459 bp, Saccharomonospora viridis
gtgggactgcggatcatcgtcggcggtgacaacgccggctacaactacaaggaagccctcaagaaggacctcgaggcggacgaacgcgtcgactcggtcgtcgatgtcggcgtcacgggtaccgaggacgagacctactacccgaacgtcgcgatcgccgccgcggagaagatcgccgccggtgaggcggatcgagccctgctgatctgcggcacgggtcttggggtggccatcgccgcgaacaaggtcaagggcgtgcgcgcggtcacggcgcacgacgtctactccgtgcagcgctccgtgctgtcgaacaacgcacaggtcctctgcatgggagagcgggtcatcggactcgaactcgcacgcgccctggtcaaggagtggctcgggctcaccttcgacccgaactccagctccggccccaaggtcgacgcgatctgcgcctacgagggtgtgtga

SEQ ID NO: 3358 - DNA, 462 bp, Saccharomonospora viridis
atgcgcgtcgtggtggcagcggacaacgccggtgtcgacctgaagaacctcgtgcgtgaccaattgcgcgccgacgaacgggtgagcgaggtcatcgacctgggggccgcgagtgtggacgacgacacggcctacccgcacttcggtctcgccgccgccgagaagatcgcgaacggtgaggccgatcgcggcatcctcgtctgtgggaccgggatcggcatggcgatctcggccaacaaggtgaccgggatccgagctacagtcgcacacgactcctactcggcggaacgctcgatcaagtccaacaactgccagatcatcaccttcggcgctcgggtcatcggacccgaactggcgaagaagatcacgcacgagtggatcggctacaccttcgaccccacttcggccagcgcggccaaggtcgcacgcatcaccgagtacgaaacccaggccgcctgctga

SEQ ID NO: 3359 - DNA, 474 bp, Saccharomonospora viridis
gtgcgtgtgtacctgggaagtgaccatgccggttacgagttgaagaaccatctcgtcgcccatctgcgcgagcggggctacgaggtgaccgacgtcggcccgcacgtctacgacgccgccgacgactaccccgctttctgcatcgagaccgctcgcagggtggtggccgacgagggcagcctcggcatcgtcatcggtggctcgggcaacggtgagcagatcgccgccaacaaggtccccggcgcccgtgccggactggcgtggagtgtcgagaccgccagactcacccgtgagcacaaccatgcccagctgatcggcgtgggtgcgcggatgcatacgctcgaggaggccacggagatcgtcgaggcgtttttgaccacccctccgtccgaggacgcccgacatgtgcgtcgagtgggccagatcagcgactacgagcgcaccgggacacctccggcgctgccgcagagctga

SEQ ID NO: 3360 - DNA, 492 bp, Saccharopolyspora erythraea
atgactgatcagactccctggaggatcgtcgtcggttccgacgacgccggactggcgtacaaggacgcgctgaagaaggacttggagaacgacgagcgggtcgccgaggtggtcgacgtcggggtcggttccgatgagcacaccgcgtacccgcacgtcgccgtgaacgccgcgcggatggtcgccgagggcaaggccgatcgggcgctgctggtgtgcgggaccgggctcggagtggccatcagcgcgaacaaggttcccggcattcgcgccgtgaccgcgcacgacagctactcggtgcaacgctcggtgctgagcaacaacgcccaggtattgtgcttcggtgagcgggtgatcggtctcgaactcgcccggacgctggcctcgcagtggttggaccaccgcttcgacgagacctcggcctcggcggagaaggtcgccgcgatcggttcgtacgagtccacatcggactcatcaggagtggcgtgttga

SEQ ID NO: 3361 - DNA, 450 bp, Saccharopolyspora erythraea
ttgcgcgtcgtcgtgggttcggacgacgccggcctgcagtacaaggacgtcctgaaaggcgacctggcggaggacccgcgcgtcgggtccgttgtggacgtcggggtcaacggcgacgacgtgaccgcgtacccgaacatcgccatcgccgcggccgagatggtcgcgcgcggcgaggccgaccgcgcgttgctggtgtgcggaaccggtctgggggtggcgatcagcgccaacaaggtcaagggcatccgagcggtcaccgcgcacgacagcttctcggtggagcggtccgtgctgagcaacaacgcccaagtgctgaccttcggccagcgcgtcatcggcctggagctggcgcggcggctcgcccgggaatggctcggctaccgcttcgacccggactccgcgtcggccggcaaggtcgccgtcctctccgactacgaagggtgctga

SEQ ID NO: 3362 - DNA, 471 bp, Saccharopolyspora erythraea
gtgcgcgtctacctaggctccgatcacgcaggattcgaactcaagaaccatctggtcaagtggctgaccgagcagggtcacgaggtgaccgacgtcggcccggcggaatacgacgcccaggacgactacccgccgttctgcgtcgagaccgcccgccgggtggtggccgacgagggcagcctcgggctggtcctcggcggctccggcaacggcgagcagatcgcggcgaacaaggtgcccggcgcccgcgccgcgctgacctggaacgtcgacaccgccaagctggcccgccagcacaacaacgcgctgctggccggcatcggtgcgcggatgcacaccgtcgaggaggtgcaggcgatcgtcgaggcgttcctcggcaccgacttcgagggcggcaggcaccagcgtcgcatcgacctgctcaccgactacgagcggaccggcgagccgcccgccctgccgggcaactga

SEQ ID NO: 3363 - DNA, 492 bp, Streptomyces albus
atgcgcgtgtacctcggctccgaccatgccggctacgaactcaagaaccacctcgtcgactggctgaaggccaacggccacgacccggtggactgcggcccccacgtctacgacgccgccgacgactacccgccgttctgcctgcgggcggccgagcggaccgccgccgaccccgactcgctcggcatcgtcatcggcggctccggcaacggcgagcagatcgccgccaacaaggtcaagggcgtccgctgcgccctcgcctggagcaaggagaccgccgccctcggccgcgagcacaacaacgccaacgttgtctccgtcggcgcccgcatgcacaccgaggaggaggcgaccgacttcgtcgccaccttcctggccaccccgtactccgacgaggcgcgccacacccgccggatcgacatgctctcggcctacgagaccaccggcgagctgcccccgatcccggcccaccacccccagcacgacgcctga

SEQ ID NO: 3364 - DNA, 456 bp, Streptomyces ambofaciens
atgcggatctccgtctcctccgacatggacgaacccgtggcccgcctcctcgtggaggagctgcgcggacgcggtcacgaggtgcgcgcgcacggcgccctgagcccgggggccgacgcccggtgggcggtgtgctccgagcgtgcggcgcgcgaggtcgccgacggcacggccgaccaggcggtggtgtgctgctggaccggcacgggcgcgtccatcgcggcgaacaaggtgccgggcgtacgggcggccctgtgcacggacgcctacacggcggacggtgcccgccgctggaacgacgccaacgtcctcgccctcagcctgcgcctgacctcggggccgctgctgggggagatcctcgacgcctggttcgcggggacgcccagcgaggacgccgaggaccgggacggggtgacgcgggtgcggcggctcgacgagggccgagccgctccgtga

SEQ ID NO: 3365 - DNA, 471 bp, Streptomyces avermitilis
atgcggatctccgtctcctcggacatggacgaacccgtggcccgctctctgctcgcggaactgcgcggccgcggccacgaggtcgtggcgcacggcgcgctgcgccccggcgacgacacgcggtgggcggcgtgctcggcggcggcggcccgggaggtcgccaccgggacgtcggaccaggcggtcgtgtgctgctggaccggcacgggcgcgtcgatcgccgcgaacaaggtgcccggcgtgcgggcggctctgtgcacggacgcgtacacggcggacggcgcacgccgctggaacgacgccaacgtgctggcgctcagcctgcggctgacgtcccagcccctgctcagggagatcctcgacgcctggttcgccgccgaggccggcgaggacgccgacgaccgggagaacgtggcgcacgtcgggcggctggacgcggacaggaccgggggcgccgccgaccgcgggtga

SEQ ID NO: 3366 - DNA, 480 bp, Streptomyces avermitilis
gtgtacctcggctctgatcatgccggtttcgaactgaagaaccacctcgtcgagtggctcaaggcggccggccatgagcccgtcgactgcgggccccacatctatgacgcccaggacgactacccgccgttctgcctccgtgccgcagagggggcggcggcggaccccgacgccctcggcatcgtgatcggcggctccggcaacggtgagcagatcgcggcgaacaaggtgaagggggtgcgcgcggcgctcgcctggagcgaggagaccgcgtcgctgggccggcagcacaacgacgcgaacgtggtcgcggtgggtgcgcgcatgcacacgcaggaggaggcgacgaagttcgtcgagaccttcctgaacacgccgttctccggtgacgcccgccacatccgccgcatcgacatgctgtcggcgtacgagacgacgggcgacctgccggccatcccggcccaccacccgcagcagtag

SEQ ID NO: 3367 - DNA, 468 bp, Streptomyces clavuligerus
ctgcgtgtcgtcgtcggttctgaccgtgccggtgccgcttactgcaccgtcctggtcgaccatctgcatgatcagcctcgcgtccagcagatcatcaccactggaaccggcgaaggcgacgtccggccctatccggagatcgccttggccgctgctcaactgatcggcgtcgggctcgcggaccgtgccttgctggtctgccataccggcgtcggcatggcgatcgccgccaataaggtcaccggaatccgcgccgccactgcccacgatccgctcagcgtggaacacgccgtcacccacaacaacgcccaggtgctgtgcctgggagccggtgtcatcggtctggccctggcacagcagctcaccaagtcgtggctgaaccactccttcgaccccgcttcccgcgccgccgccaggatcgctctgatcaccgatgccgagcaccgtcgccggtccgcgctgtactga

SEQ ID NO: 3368 - DNA, 513 bp, Streptomyces coelicolor
atgaccgacaagctccgcatcgtcgtcggctccgacgacgccggccaccagtacaaggaagccctcaagcaggacctgcgcggcagcgccctggtcgccgaggtcaccgacgtcggcgtcgacgccgacggccacaccgcctacccgaaggtggccatcgccgccgccgagatggtcgcccggggcgaggccgaccgcgccctgctggtgtgcggcaccggcctcggcgtcgccatcgccgccaacaaggtcaggggcatccgggccgtcaccgcccacgactccttctccgtcgagcgggcgatcctctccaacaacgcccaggtcctcaccttcggccagcgcgtcgtcggcctcgaactcgcccgccgcctcgccgccgagtggctcacctaccgcttcgacgagaactcggcgtcggccgccaaggtccagctgatgagcgactacgagaccgccgacgacgccggtgcggcgagcgggagcgcggccgacggcggggcggccgcctga

SEQ ID NO: 3369 - DNA, 459 bp, Streptomyces coelicolor
atgcgtatctccgtctcctccgacatggacgaacccgtggcccggctcctcgtcgaggaactgcgcgcacgcggtcacgaggtgcgcgcgtacggcgcgctgagccccggggcggacccgcggtgggccgcctgttccgagcgggcggcgcgcgaggtcgccgagggacgggccgaccaggccgtcgtgtgctgctggaccggcaccggcgcgtccatcgcggccaacaaggtgccgggcgtccgtgcggccctgtgcgccgacgcgtacaccgccgacggggcccgccgctggaacgacgccaacgtgctcgccatcggcctgcggctgacgtccgctccgttgctgcgcgagatcctcgacgcctggttcgcgggcggcccgagtacggacgccgaggaccgggacaacgtcgcgcacgtggagcggctcgacgaggaccgccgagccgctcggtga

SEQ ID NO: 3370 - DNA, 480 bp, Streptomyces coelicolor
gtgtatctcggctcggaccatgcgggcttcgaactcaagaaccacctcgtcgagtggctcgcggcggcgggacacgagcccgtcgactgcggtccgcacatctacgacgcccaggacgactacccgcccttctgcctgcgcgccgccgagcgcacggccgcggaccagggcgccctcggcatcgtgatcggcggttccggcaacggcgagcagatcgcggcgaacaaggtgaagggcgtgcgcgcggcgctggcctggagcgaggagacggcgtcgctgggccgccagcacaacaacgccaacgtcgtcgcggtcggcgcccgcatgcacacgcaggaggaggcgacgaagttcgtcgagaccttcctcggcaccccgttctccggcgacgaacgccacatccgccgcatcgacatgctcacgtcctacgagacgacgggcgaccttcccccggtcccgtcccaccacccgcagcagtag

SEQ ID NO: 3371 - DNA, 489 bp, Streptomyces roseosporus
atgcgcgtgtacctcggatccgaccatgccggctacgaactcaagaaccacctcgtcgagtggctcggcgctcacggccacgaggccgtcgactgcggcccccacatctacgacgcccaggacgactatccgccgttctgcctgcgggccgccgagaagacggccgccgacccggacagcctcggcatcgtgatcggcggctccggcaacggcgagcagatcgccgccaacaaggtcaagggcgtccgcgccgcactggcctggagcgagcagaccgccgcgctgggccgcgagcacaacaacgccaacgtcgtcgcgatcggcggccggatgcacacggtcgaggagtccacgaagttcgtcgagatcttcctctccacgccgtactcgaacgaggagcgccacacgcgccgcatcgagatgctctcggcgtacgagaacaccggcgagctccccccgatcccggcccaccacccccagcagggctga

SEQ ID NO: 3372 - DNA, 495 bp, Streptomyces flavogriseus ATCC 33331
atgtccgagaagctccgcatcgtcgtcggctccgacgacgccggccacgcctacaaggaagccctccggaaggacctggaggccagcggcctcgtcgccaccgtcaccgatgtgggggtcgacgcggacgggcacaccgcctacccgaaggtcgccatcgccgccgccgagatggtcgcccggggcgaggccgaccgcgccctgctggtctgcggcacgggcctcggggtggccatcgccgcgaacaaggtcaagggcgtccgggccgtcaccgcccacgactccttctccgtcgagcgcgcggtcctgtccaacaacgcccaggtcctcaccttcggccagcgtgtcgtcgggctggagctcgcccgccggctggcctccgagtggctgacgtaccgcttcgacgaggcgtcggcatccgccgccaaggtcgcactgatggacgactacgagaacaagaacgaccacgagaaccagcaggaagccgcagcctga

SEQ ID NO: 3373 - DNA, 489 bp, Streptomyces flavogriseus ATCC 33331
atgcgcgtgtacctcggctccgaccatgccggctacgaactgaagaaccacctcgtcgagtggctcacggcccacggccacgaggccgtcgactgcggtccccacatctacgacgcccaggacgactacccgccgttctgcctccgcgccgccgagcggacggcagcggacaaggacagcctcggcatcgtcatcggcggctccgggaacggcgagcagatcgccgcgaacaaggtcaagggcgtccgcgccgcgctcgcctggagcgagcagaccgccgcgctcggccgcgagcacaacgacgccaacgtggtggccatcggcggccgcatgcacacgctggaggagtccacgaagttcgtcgagatcttcctggccacgccgtactcgggtgaggagcgtcacacccgccgcatcgagatgctctcggcgtacgagaacaccggcgagctgcccccgatcccggcccaccatccgcagcagggctga

SEQ ID NO: 3374 - DNA, 456 bp, Streptomyces ghanaensis
atgcgcatctccgtctcctccgacatggacgaacccgtggcccgtgccctcctcgccgagctgcgcgagcgcggtcacgacgtgcgcgcgcacggcgccctgagccacggggacgacccgcagtgggcggtctgctccgaggcggcggcccgcgaggtcgccgccgggacggcggaccaggcggtggtgtgctgctggaccggcacgggcgcctcgatcgccgcgaacaaggtgccgggcgtccgggccgccctgtgcacggacgcgaccacggcggacggcgcgcgccgctggaacgacgccaacgtgctggcgctcagcctgcggctgacgtcggagccgctgctgaaggagatcctcgacgcctggttcgccggtacgcccagcgacgacgcggaggaccggcggaacgtggaccgggtgcgccgcctcgaccaggagcgcacgggggcctga

SEQ ID NO: 3375 - DNA, 486 bp, Streptomyces ghanaensis
atgcgcgtgtacctcggttccgaccatgccggctacgaactcaagaaccacctcgtcgagtggctcaagggcgcgggtcacgagcccgtcgactgcgggccccacatctacgacgcccaggacgactacccgcccttctgcctccgcgccgccgagcggaccgccgccgaccccggcgccctcggcatcgtgatcggcggctccggcaacggcgagcagatcgccgcgaacaaggtgaagggcgtgcgggcggccctggcgtggagcgaggagacggcggccctgggccgtcagcacaacaacgccaacgtggtcgcggtgggtgcgcgcatgcacacgcaggacgaggccaccgcgttcgtggagaccttcctgaacaccccgttctcgcaggacgagcgccacatccgccgcatcgacatgctcgccgactacgagaccaccggcgacctccccccgatcccgccccaccacccccagcagtaa

SEQ ID NO: 3376 - DNA, 456 bp, Streptomyces griseoflavus
atgcggatctccgtctcctccgacatggacgaacccgtggcccgcgccctcgtcgccgagctccacgaacgcggccacgaggtgcgcgcgcacggcgccctcagcctcggggacgacacgcagtgggccgtctgctccgaggcggcggcccgcgaggtcgcctccggcacggccgaccaggcggtggtgtgctgctggaccggcaccggcgcctcgatcgccgcgaacaaggtgcccggcgtccgggccgcgctgtgcacggacgccggcacggcggacggagcgcgccgctggaacgacgccaacgtgctggcgctcagcctgcggctgacgtcggggccgctgctgaaggagatcctcgacgcctggttcgccggagtgcccagcgacgacccggaggaccggcgcaacgtggagcgcacggcacggctcgaccgggagcgcgccgggtcctga

SEQ ID NO: 3377 - DNA, 486 bp, Streptomyces griseoflavus
atgcgcgtgtatctcggctcggaccatgcgggctacgaactcaagaaccacctcgtcgagtggctcgagaaggcgggccacgagcccgtcgactgcggaccgcacatctacgacgcccaggacgactacccgcccttctgcctccgggccgccgagcggaccgccgcggacgagggcgccctcggcatcgtgatcggcggctccggcaacggcgagcagatcgccgcgaacaaggtcaagggcgtacgggcggccctggcgtggagcgaggagacggcggcgctcggccgccagcacaacaacgccaacgtggtcgcggtgggcgcgcgcatgcacacccaggacgaggccgtgaagttcgtcgagaccttcctgagcaccccgttctccggtgacgagcgtcacatccgccggatcgacatgctcgccgggtacgagacgacgggcgacctcccgcccgtccccgcgcaccacccccagcagtaa

SEQ ID NO: 3378 - DNA, 489 bp, Streptomyces griseus
atgcgcgtgtacctcggatccgaccatgccggctacgaactcaagaaccacctcgtcgagtggctcggcgcccacggccacgaggccgtcgactgcggcccccacatctacgacgcccaggacgactacccgccgttctgcctgcgcgccgccgagaagacggccgccgacccggacagcctcggcatcgtgatcggcggctccggcaacggcgagcagatcgccgccaacaaggtcaagggcgtccgcgccgcactggcctggagcgagcagaccgccgccctcggccgtgagcacaacaacgccaacgtcgtggcgatcggcggccggatgcacacggtcgaggaatccacgaagttcgtcgagatcttcctcgccacgccgtactcgaacgaggagcgccacacgcgccgcatcgagatgctcacggcgtacgagaacaccggcgagctccccccgatccccgcccaccacccgcagcagggctga

SEQ ID NO: 3379 - DNA, 477 bp, Streptomyces hygroscopicus
atgaccggacagcagcagccactgcgactgatcgtcggctgtgatgacgcgggcctggagtacaaggaggctctgaagagcgatctgctcgctgacggccggatcgccgaggtcgtcgacgtgggggtgagcgtcggggataccaccgcgtatccgcacgtggcggtcaccgcggccaggctggtggccgaagggaaggcggagcgggcgctcctcgtctgtggcaccgggctcgggatggccatatccgcgaacaaggtgccgggtgtccgggctgtgaccgctcacgacagcttctccgtcgagcgggccgtactgtccaatgacgcccaggtgctgtgcttcggccaacgggtggtgggcttggaactcgctcgccgtcttgcccgcgagtggctcgactaccggttcgacaccagctcggcctccgcggccaaggtcgcggcaatctgcggatacgaggagcgcggcggttga

SEQ ID NO: 3380 - DNA, 465 bp, Streptomyces hygroscopicus
atgaccaccgcgactccgttccggatcgtcgtcggctgcgacgacgccggatacggctacaaggaagccctcaagcaggacctgctggacgacccccgggtcgccgaggtcatcgacgtcggtgtgggcagcgacgagcacaccgcctacccgcacgtcgcggtcgaggcggcccgccgcgtcgccgacggcaccgccgaccgcgccctcctggtgtgcggcaccggcctcggcgtggccatcagcgccaacaaggtccccggcatccgcgcggtcaccgcccacgacagctactccgtacgccgctccgtcctcagcaacaacgcccaggtgctctgcttcggccagcgcgtcataggactcgaactcgcccgcgcgctcaccgacgactggctcgcccagcggttcgacgagacctcctcctcggcggagaaggtggccgccatccagagctacgagagctga

SEQ ID NO: 3381 - DNA, 489 bp, Streptomyces hygroscopicus
atgcgcgtgtacctcggctccgatcatgccggatacgaactgaagaaccacctcgtggagtggctccgggcgggcggtcatgaccccgtcgactgcggcccgcacatctacgacgcccaggacgactacccgccgttctgcctgcgcgccgccgagcggaccgccgccgacgccgacagcctcggcatcgtgatcggcggctccggcaacggcgagcagatcgcggcgaacaaggtcaagggcgtacgcgccgcactggcctggagcgagcagaccgccgccctcgcgcgcgagcacaacgacgccaacgtgatcagcatcggcgggcgcatgcacacccaggacgaggcgaccaagttcgtcgagatcttcctggccaccccgtactcgggcgaggagcggcacacccgccgcatcgacatgctcgccgcctacgagaccaccggcgacctgccgcccatcccggcccaccaccccgccggcgactga

SEQ ID NO: 3382 - DNA, 513 bp, Streptomyces lividans
atgaccgacaagctccgcatcgtcgtcggctccgacgacgccggccaccagtacaaggaagccctcaagcaggacctccgcggcagcgccctggtcgccgaggtcaccgacgtcggcgtcgacgccgacggccacaccgcctaccccaaggtggccatcgccgccgccgagatggtcgcccggggcgaggccgaccgcgccctgctggtgtgcggcaccggcctcggcgtcgccatcgccgccaacaaggtcaggggcatccgggccgtcaccgcccacgactccttctccgtcgagcgggcgatcctctccaacaacgcccaggtcctcaccttcggccagcgcgtcgtcggcctcgaactcgcccgccgcctcgccgccgagtggctcacctaccgcttcgacgagagctcggcgtcggccgccaaggtccagctgatgagcgactacgagaccgccgacgacgccggtgcggcgagcgggagcgcggccgacggcggggcggccgcctga

SEQ ID NO: 3383 - DNA, 459 bp, Streptomyces lividans
atgcgtatctccgtctcctccgacatggacgaacccgtggcccggctcctcgtcgaggaactgcgcgcacgcggtcacgaggtgcgcgcgtacggcgcgctgagccccggggcggacccgcggtgggccgcctgttccgagcgggcggcgcgcgaggtcgccgagggacgggccgaccaggccgtcgtgtgctgctggaccggcaccggcgcgtccatcgcggccaacaaggtgccgggcgtccgtgcggccctgtgcgccgacgcgtacaccgccgacggggcccgccgctggaacgacgccaacgtgctcgccatcggcctgcggctgacgtccgctccggtgctgcgcgagatcctcgacgcctggttcgcgggcggcccgagtacggacgccgaggaccgggacaacgtcgcgcacgtggagcggctcgacgaggaccgccgagccgctcggtga

SEQ ID NO: 3384 - DNA, 486 bp, Streptomyces lividans
atgcgcgtgtatctcggctcggaccatgcgggcttcgaactcaagaaccacctcgtcgagtggctcgcggcggcgggacacgagcccgtcgactgcggtccgcacatctacgacgcccaggacgactacccgcccttctgcctgcgcgccgccgagcgcacggccgcggaccagggcgccctcggcatcgtgatcggcggttccggcaacggcgagcagatcgcggcgaacaaggtgaagggcgtgcgcgcggcgctggcctggagcgaggagacggcgtcgctgggccgccagcacaacaacgccaacgtcgtcgcggtcggcgcccgcatgcacacgcaggaggaggcgacgaagttcgtcgagaccttcctcggcaccccgttctccggcgacgaacgccacatccgccgcatcgacatgctcacgtcctacgagacgacgggcgacctccccccggtcccgtcccaccacccgcagcagtag

SEQ ID NO: 3385 - DNA, 483 bp, Streptomyces pristinaespiralis
gtgtacctcggctcggaccatgccggcttcgaactcaagaaccacctcgtcgagtggctcaaggcccatggccacgagcccgtggactgcggtccccacatctacgacgcccaggacgactacccgccgttctgcctgcgtgccgcggagcggacggccgcggacgagggcagcctcggcatcgtgatcggcggctcgggcaacggcgagcagatcgccgccaacaaggtcaagggcgtgcgtgccgcgctcgcctggagcgagcagaccgccgctctcggccgtgagcacaacaacgccaacgtcgtggcgatcggcgggcggatgcacaccctcgaggagtcgacgaagttcgtcgagatcttcctcggtaccccgtactcgggtgaggaacgtcacacccgccggatcgagatgctctccgcgtacgagaccaccggcgagctccccccgatcccggcccaccacccgcagcagggctga

SEQ ID NO: 3386 - DNA, 465 bp, Streptomyces scabiei 87.22
atgcggatctccgtctcctcggacatggacgagcccgtcgcgcgtctcctgctcacggagctgcgcgaccggggccacgaggtgctggcccatggcgcgctgcgcgagggcgacgatccccggtgggcggtctgctcggaggcggcggcgcgcgatgtcgccgccgggagggcggaccaggccgtcgtgtgctgctggacgggcaccggcgcgtccatcgccgcgaacaaggtgcccggggtacgggccgccctgtgcgcggacgcgtacacggccgacggcgcccgacgctggaaccacgccaacgtcctggcgatcgggctgcggctgacctccgggccgctgctcaaggagatcctcgacgcctggttcgccgccgaggacggccgggacgccgacgaccgggagaacgtggcccacgtcgaccggctcgacgtcagccgggggcacggccgggccggatga

SEQ ID NO: 3387 - DNA, 558 bp, Streptomyces scabiei 87.22
ttgggtagctcacgtttcgctgggtcggcaccccgtcgtgccatgccgaaacacgcgtgtcacactcggaccatgcgcgtctacctcggctctgatcacgccggatacgaactcaagaaccacctcgtggagtggctgaaggccgccggccacgagcccgtcgactgcgggccccacatctacgacgcccaggacgactacccgccgttctgcctccgcgcggcggagcgcacggccgcggaccccgggtccctcggcgtcgtcatcggcggctccggcaacggcgaacagatcgccgcgaacaaggtggccggcgtccgcgccgccctcgcctggagtgccgagaccgccgcgctgggccgcgagcacaacaacgccaacgtcgtcgccgtcggcgcccgcatgcacgcgcaggacgacgcgacgaagttcgtcgagaccttcctcaacaccccgttctccggtgacgagcgccacatccgccgcatcgacatgctggcggcgtacgagaccacgggcgacctgccccccgtcccggcccaccacccccagccgtag

SEQ ID NO: 3388 - DNA, 456 bp, Streptomyces sp. AA4
atgcgcatcgtggtggcggcggacaacgccggggtcgaactgaagaatcagctgcgcgacctgctgcgggccgacgaacgagtcaccgaggtgaccgatctcggcgtgcccgacgcggcggacgaccgggcgtacccgttgctggggctggccgcggcggaagcgatcgcgcgcggcgaggcggaccggggcgtcctggtctgcggcaccggcatcggcatggcgatctcggcgaacaaggtgcccggcgtgcgggcgacggtcgcgcacgattcgtactccgccgagcggtcgatcaaatcgaacgactgccaggtgatcaccttcggagcgcgtgcgatcggtcccgaggtggcgaagaagatcgtcgccgaatgggtcggctaccgcttcgacccggcgtcggccagcgcgaccaaggtcgcgcacatcaccgaatacgagaacgcccactga

SEQ ID NO: 3389 - DNA, 474 bp, Streptomyces sp. AA4
gtgcgtgtctacttgggatccgaccatgccggtttcgagctgaagaaccaccttgtccgccacctcggcgaacaggggcacgaggtgaccgacatcggtccgttcgtctacgacgcggccgacgactacccggcgttctgcgtcgaaaccgcgcgccgcgtggccgccgacgagggcagcctcggcatcgtcatcggcgggtccggcaacggcgagcagatcgccgcgaacaaggtgccgggcatccgcgccgggctcggctggagcgtcgaaaccgcgcagctgacccggcagcacaaccacgcccaggtgctcggcgtcggcgcccggatgcacacgcaggagcaggcgaccgagatcgtcgacgccttcctggccacgccggtggacccggccgagcggcacacgcggcgcgtgcggcagctgctcgactacgagcgcaccggcaccccgcccgccctgccggaggcctga

SEQ ID NO: 3390 - DNA, 456 bp, Streptomyces sp. Mg1
atgcggatctccgtttcctcggacatggacgaacccgtggctcgcgcgctcctcgggcagctgcgcgaccgcggacacgacgtggtggcgtacggggcgctgagccccggcgacgatccgcagtgggcggcctgctcggaggcggcggcccgtgaggtcgccgccgggaacgccgctcaggccgtcgtgtgctgctggaccggtacgggcgcgtcgatcgccgcgaacaaggtccccggggtacgcgcggccctgtgcacggacgcctacacggcggacggtgcgcgccgctggaatgacgccaacgtgctcgcgctcagcctgcgcctgacttcggagcccctgctcaaggaaatcctcgacgcgtggttcgccgccgaggcgagcgcggacgccgaggaccgggcgaacgtggcacgcgtcgaacggctcgaccacaccagaaccagaagctga

SEQ ID NO: 3391 - DNA, 486 bp, Streptomyces sp. Mg1
atgcgcgtgtacctcggatccgaccatgccggctttgagctcaagaaccacctggtggactggctcaagaacaacggccacgagcccgtcgactgcgggccccacatctacgacgcggtggacgactacccgccgttctgcctgcgcgccgcggagaagaccgccgcggacgccgacagcctcggcatcgtgatcggcggctccggcaacggcgagcagatcgccgcgaacaaggtcaagggcgtccgcgccatcctcgcctggagcgtggagaccgcgaagctcggccgcgagcacaacaacgccaacgtcatctcggtcggcggccggatgcacacgcaggacgaggccgtctccttcatcgaggccttcctggcgaccccgtactccggcgaggagcgccacacccgccgcatcgagatgctctccgcctacgagcggaccggcgaactgccccccatcccggcacaccacccgcagggctga

SEQ ID NO: 3392 - DNA, 486 bp, Streptomyces sp. SPB74
gtgtatctcggctccgaccatgcgggctacgaactcaagaaccacctcgtcgaatggctcagcgagcacggccacgagccggtcgactgcggcccccacatctacgacgcccaggacgactacccgcccttctgcctccgcgccgccgagcgcgccgccgccgaccccgaggccctgggcgtcgtcatcggcggcagcgggaacggcgaacagatcgcggcgaacaaggtcgaaggcgtccgctgcgccctcgcctggagcgtcgagacggcgaaactcggccgcgagcacaacaacgccaacgtcgtctccgtcggcgcccggatgcactcgaccgacgaagccacctccttcgtcgaggtcttcctcaccaccccgtactccgaggagccgcgccacacccggcgcatcgagatgctcaccgcgtacgagaagagcggcgtcctgccgcccgtcccggcccaccacccgcaacccgaagcctga

SEQ ID NO: 3393 - DNA, 507 bp, Streptomyces sp. SPB74
gtggcagcggaccggatcgccgtggccgccgaccacaacggcctcgcgctcaaggccgcgctgagcgcgtggctgcgcggccgggggtacgcggtgcacgacctcggggcgtacgggagcgacgcggacgccgtggtcgactacccgccgctgtgctgggcgctgtgccgggaggtgacggcggggcgggccgcgcgcggcatcgtcctcggcggcagcggtctcggcgagaccgtcgtgtgcaacaaggtccccggcatccgcgcgggtctgtgccacgacgtgtggaacgcgggcgtctcgcgcggcaacaacgacgccaacgtcctcgtcctggcggcgaggaccctcccgcccgcacgggccctggaggtcgcggagacgtggctgacgacccctttccggggcggggcgcacgcgcgccggctcgcgcagatcgcggcggtggagcgcggggaggcgccgacgggggagccaccgaccggggagccaccggcgctcggctga

SEQ ID NO: 3394 - DNA, 492 bp, Streptomyces sp. SPB78
atgcgcgtgtatctcggctccgaccatgcgggctacgaactcaagaaccacctcgtcgaatggctcaccgagcacggccacgagcccgtcgactgcggcccccacctctacgacgcccaggacgactacccgccgttctgcctccgcgccgccgagcgcaccgcggccgaccccgaggccctcggcgtcgtcatcggcggcagcggcaacggcgagcagatcgcggcgaacaaggtcgagggcgtgcgctgcgccctcgcctggagcgtcgagacggccaagctcggccgcgagcacaacaacgccaacgtcgtctcggtcggcgcccggatgcactcgaccgacgaggccacctccttcgtcgaggtcttcctcagcaccccgtactccgaggagccgcgccacacccggcgcatcgagatgctcacggcgtacgagaagagcggcgtcctgccccccgtcccggcccaccacccgcagcccgaagcctga

SEQ ID NO: 3395 - DNA, 456 bp, Streptomyces sp. SPB78
gtggcggccgaccacaacgggctcgcgctcaaggccgagctgagcgcgtggctgcgcggcggcgggtacgacgtgcacgacctcggggcgtacggggacgacccggacacggtggtcgactacccgccgctgtgctgggcgctgtgccgggaggtgacggcggggcgggccgcgcgcggcatcgtcctcggcggcagcggtctcggcgagaccgtcgtgtgcaacaaggtccccggcatccgggcgggcctgtgccacgacgtgtggagcgcgggtgtctcgcgcggcaacaacgacgccaacgtcctggtcctggcggcgaggacgctcccgcccgcgcgggccctggaggtcgcggggacgtggctgacgacccacttcaggggcggggtgcacgcccgccgcctcgcgcagatcgcggccgtggagcgcggggagccgccgacgggcggctga

SEQ ID NO: 3396 - DNA, 486 bp, Streptomyces sviceus ATCC 29083
atgcgcgtgtatctcggctccgaccatgcgggcttcgaactcaagaaccacctcgtcgactggctcaaggcggccggccacgacgtggtcgactgcggcccccacatctacgacgcccaggacgactacccgccgttctgcctccgcgccgccgagcgcaccgccgccgacgccgactccctcggcatcgtgatcggtggctccggcaacggcgagcagatcgccgcgaacaaggtcaagggcgtccgggcggccctcgcctggagcgaggagaccgcgtcgctgggccgccagcacaacaacgccaacgtcgtcgcggtcggcgcccgcatgcactccgcggaggaggcgacgaagttcgtcgagaccttcctcgccaccccgttctccggcgacgagcgccaccagcgccgcatcgacatgctgtccgcctacgagacgacgggcggcctgccggcgatcccggcccaccacccgcagcagtag

SEQ ID NO: 3397 - DNA, 486 bp, Streptomyces viridochromogenes
atgcgcgtgtacctcggctcggaccatgcgggctacgaactcaagaatcacctcgtcgagtggctgaaggcggcgggtcacgaccccgtcgactgcggcccgcacatctacgacgcccaggacgactacccgccgttctgcctccgcgccgcggagcgcacggccgcggacccgggcgccctcggcgtcgtcatcggcggctccggcaacggcgagcagatcgccgcgaacaaggtcaagggcgtccgcgcggccctcgcctggagcgaggagacggctgggctcggccgccagcacaacaacgccaacgtcgtcgccgtgggcgcgcgcatgcactcgcaggacgaggcgacgaagttcgtcgaggtcttcctcagcacaccgttctccggtgacgagcgtcacatccggcgcatcgacatgctcaagagctacgagacgaccggcgacctgccccccatccccccgcaccacccccagcagtaa

SEQ ID NO: 3398 - DNA, 468 bp, Nocardiopsis dassonvillei
gtgcgtgtttaccttggatcagatcatgcgggctacgagctcaaagaacacctcgtctcctggctgagggagcagggccacgacgtcgtcgacgccgggcccgccgcctacgacgccgcggacgactacccgcccttcgtgctgcgcgcggccgagggcgccgcctccgacaagggctccctgggcgtcgtcatcggcggctccggcaacggcgagcagatcgccgcgaacaaggtcaggggcgtgcgcgcggccctggcctggagcgaggacaccgcccgcctggcgcgtgagcacaacgacgccaacgtgctcagcctcggcgccaggatgcactccgcgcaggaggccacccggttcgtggaggtcttcctcaccaccccgtacagcgacgaggaacggcacacccgccgcatcgcgatgctgacggcctacgaggagaccggcgagctgcccccgctcccctag

SEQ ID NO: 3399 - DNA, 501 bp, Thermobifida fusca YX
atgcgtgccccggggacctgcaaaactggagccgtgcgtatctacattggatccgaccacgccggctacgaactcaaacagcacctcgtctcctggctgcagaagcagggacacgatgtcatcgacgccggtccagccgtctacgacgcggctgacgactatcctccgttcgtgctgcgcgccgctgagggggtagccaaggaccctgaggcgctcggcatcgtgctcggcggctccggcaacggcgaacagatcgccgcgaacaaggtcaaaggggtgcgggccgccctcgtctggagcaacgagaccgccaaactcgcccgcgagcacaacaacgccaatgtgatcagcatcggcgcgcggatgcacacgatcgacgaagccaccggttttgtcgacacgtttctcaccaccccatacagcggtgaggaacgccacagtcgccgtattcggatgctctccgactacgagaccaccgggcagcttcccccgctcccctga

SEQ ID NO: 3400 - DNA, 510 bp, Streptosporangium roseum
gtgggggtcgagcccgccacacacacctgcgaaactgggcgggtgcgcgtctacatcggtgccgaccatgccggctatgagctcaagaaccacgtcgtctcctggctgaaggagcacggacacgaggtcacggactgcggtccgttcgtgtacgaccccgaggacgactacccgccgttcgtgctgcgcgcggccgagggcgtcgcggaggaccccgggagcctggggatcgtcatcggcggctcgggcaacggcgagcagatcgcggccaacaaggtgcgcggcatccgtgccgccctggcctggagcgaggacaccgccaagctcgcccgcgagcacaacaacgccaacgtggtcagcgtcggttcgcggatgcacacccaggaggaggccacccggctcgtcgagctcttcctgggcacggcctactcgggcgccgagcggcacaaccgccggatcgcgcagctcacctcgtacgagaccatcggccagctgccgccgctgccgtag

SEQ ID NO: 3401 - DNA, 468 bp, Thermomonospora curvata
atgcgcgtctaccttggatccgaccacgccggcttcgaactcaagcagcacctcatcggctggctggcggacaacggccatgaaccggtcgactgcgggccccaggtctacgacgccgccgacgactacccgccgttcgtgctgcgggcggccgagcgcaccgccgccgaccccggctcgttcgggatcgtgctgggcggctcgggcaacggcgaggcgatcgccgccaacaaggtcaagggcatccgcgcggccctggtgtggaacgaggagatcgcggcgctggcccgcgagcacaacgacgccaatgtgatcagcatcggcgcccgccagcacgacctggccaccgccacccggttcgtggaggtgttcctcaacacgccctactccaaggaggagcggcacacccgccggatcggcatgatcggctcttatgagaccaccggcgagctgcccccgctgccctag

SEQ ID NO: 3402 - DNA, 465 bp, Atopobium parvulum
atgcgtattgcagttggctctgatcacgctggctttatccagaaagatcctattattgagcacattaagtcgcttggtcacgaggttttggactttggtccagcaaatgatgaccgtgttgattaccctgattttgcagataaggttgctcgtgcagttgcagcgggtaaggctgatcgtggtgttctgatttgcggcaccggcattggcattgccatgaccgctgataaagttcctggtattcgcgcaactcctgttcagactgttcagtttgcagagcttgctcgtgaacataacaatgcaaacgtcattggcctttctggccgattcaccgatcttgctgttaacgaggctattgtggataccttcctaagcaccgagtttgcaggcggccgccatactggacgtgtcgagaagattatgcgtgaggatgaccctaactttaagggtgttgatgctgagtaa

SEQ ID NO: 3403 - DNA, 456 bp, Atopobium rimae
atgcgtgtagctattgcatctgatcatgcgggatttatccagaaagctcccattgccgagtatattgagtcgcttggccacgaagtaattgattttggtcccgaaaatgacgacagggttgattatcccgattatgctgacaaagtggctcgatatgtagctgcaggcggagcagatcgtggcgtattgatttgtggaaccggtcttggcattgccatgacggcggataaggttgccggtattcgcgcaacacccgttcagacgcctcaatttgcccagcttgctcgcgaacacaataatgcaaatgtcattggattgtcgggacgatttgttgatgtggaagtaaataaagaaatcgtaaaagtctttttgacacaggagttcggtggcggccgccatgcgggtcgtgtcgtcaaaatcatgagagaagacaatccggcttttgaaggagtataa

SEQ ID NO: 3404 - DNA, 462 bp, Atopobium vaginae DSM 15829
atgaaagttgccatcggttcagatcatgctggtttcgagcaaaaacctgcgcttgttgaatggcttacatcgcttggctacgaagttattgatttaggccctacaacagatgctcgttgtgattaccccgattttgctgataaagttgcacgttatgttgcagaaggaaaagcagatcgaggtattttaatatgcggcactggtattggaatggctataactgcagataaagttaaaggtgttcgcgcaagctgtattcaaacgcctcattttgcccacttgttccgcgagcacaataacggaaatgttgtttgcatatcgggtcgttttaccccgtacgaaataaatcgcgatattgttaaagagtttcttaccaccgagtttgcaggtggtcgtcatgctggccgtgttgataaaatcatgcgcgaagatgacgatgcattttgcggtgtgtgcgcgtaa

SEQ ID NO: 3405 - DNA, 468 bp, Collinsella aerofaciens ATCC 25986
atgaagattggtatcggcaacgaccacgccgccgtcgagctcaagaacatcatctccgagcacctgaaggagcgcggctgcgaggtcgtgaactttggcaccgacacctccgagagctttgactaccccatcgccggctacaaggtgggtaaggccgttgccaacggcgacgtcgacctgggcatcctcatctgtggcaccggtgtcgggattagcctggctgccaacaaggtcgagggcgtacgcgccgtcgtgtgctccgagcccttcagcgccaagctctcccgcatgcacaacaacaccaacgtgctcgcctttggtgcccgtgtcgtgggctccgagctcgctaagatgatcgtcgacgagtggctcgacgccgagtttgagggcggccgtcacgagcgtcgcgttaacctcctcaacgagatcgatcacacgcgcggcctcaaggtcgtcgacgaggcctaa

SEQ ID NO: 3406 - DNA, 462 bp, Collinsella intestinalis DSM 13280
atgtataagagaaaggacgtgcacatgcgcatcgccatcgcctccgaccacggtggatttgagcagaagcaggctctggcggcctatatcgccgatgaactgggcttcgatgtcaccgacatgggccccgacaccgacgcttctgtcgattaccccgactatgccgctcccgtggctaaggccgtctctgccggcgaggccgatcgcggtgttctcgtgtgcggcacgggtatcggtatggcggtcgctgccgacaaggtcgctggcgtgcgcgcctcctccattacgtccgttccgtttgcggagctcttccgccagcacaacaacggcaacgtggtgtgcctgtccggccgtttcgtcgacctcgaggtcaacaaggaaatcgtcaagaccttccttaccaccgaatttgagggtggccgccacgaggcgcgcgtcgccaagatcatggccctcgactaa

SEQ ID NO: 3407 - DNA, 438 bp, Collinsella stercoris DSM 13279
atgcgtgtcgctatcgcctccgaccatggtgggtttgagcagaagcaggccctggtggattacctgaccaatgagcttggctgcgaagtttccgatatgggccccgactccgacgcctccgtcgattaccccgactttgccgtaaaggtcgcgcaagcggtttctaccaacgaggccgatcgcggcgtgctggtgtgcggcacgggcatcggaatggcgcttgccgcggacaaggtggcgggcgttcgcgcgtcctccatcacgtccgttccctttgccgagctgttccgccagcacaacaacggcaacgtggtgtgcctgtccggtcgctttgtcgacctcgacctcaacaaggagatcgtgaagaccttccttaccaccgagttcgagggcggtcgccacgaggcgcgcgtcgccaaggtcatggcgctcgattag

SEQ ID NO: 3408 - DNA, 435 bp, Cryptobacterium curtum DSM 15641
atgatcatatcgatgggcagcgatcacgcaggatttgagcaaaaagagcagctcaaacaatatcttgagacagctggccataccgttattgatcgtgggtgtcccagcgaagagcgagttgattatccggattatgcatatcctgtggcatgcgatgtggctcagggaacagctgagcgtggtgtgctggtgtgcggcacgggcattggtatggctctggcagctgataaagtggctggtgtgcgcgctgccaatattattacgccgcagtttgccggcctatgtcgtgaacacaacgattgtaatgtgattacgctttcagggcgctttgttgacgtgggcgttaataaggaaattgttgatgtgtttcttgcgacgccttttggtgctggtcgtcatacggggcgtgtcgaaaagattatgcaactcgactaa

SEQ ID NO: 3409 - DNA, 441 bp, Eggerthella lenta DSM 2243
atgaagatcagcattgcaagcgaccatgcaggcttcgagcagaagcaggcgctggtcggctacctggcctccaagggccacgacgtgatcgaccgcggcccagactgcgacgaccgcgtcgactatcccgactatgcggcgcgcgtggcgcacgatgtggtcgacggcatggccgagcgcggcgtgctcgtgtgcggcacgggcatcggcatggccgtggccgccaacaagatcgacgggatccgcgccgccaacgtcaccagcccgctgttcgccgccctcgcgcgcgagcacaacgacgcgaacgtcgtagccgtctcgggtcgcttcgtcgacgagtccgtgaaccgcgagatcctcgacgctttcgtctccacctccttcggcggcggtcgtcatgcaggtcgcgtcgagaagatcgccgctctcgaaaacgaatag

SEQ ID NO: 3410 - DNA, 441 bp, Slackia heliotrinireducens DSM 20476
atgaaactgtccattgcaagcgaccatgcaggtttcgagcagaaggaactgctccgtgcatatcttgaatccgcaggacacgaggtcatagaccggggtccgaattccgatgaccgtgtcgattaccccgattacgccgttcccgtggccaacgacgtggcagatggtacggttgagcgcggggtgcttgtgtgcggcaccggtatcggcatggcgctcgcagctgacaaggttgcaggcgtccgcgccgcaaatatcatcacgccgcagttcgcagccctgtgccgcgagcacaacgatgccaacgtcatcaccctttcgggtcgtttcgtcgacgtggacaccaacaaggaaattcttgatgtgttcctcacgacggaattcggcggtggtcgccacgccgggcgtgttgagaaaatcatggcacttgacgcacgataa

SEQ ID NO: 3411 - DNA, 489 bp, unknown
  marine actinobacterium PHSC20C1
atgcgcatccatatcgccaccgatcacgccggcctcgagttcagtgcaacgctccaacagcacctcaccgatgctggccacgaggtcatcgaccacggccccgttgagtacgacgccctcgacgattaccccggcttctgtattgcggcagcgcgtggtgttgccgccgatcagacggcaggcattcaagcactcggcgtcgtcttcggtggctcgggaaacggtgaacaaatcgccgcaaacaaggtcacgggcatccgcgcagcactcgtctggaacgactccacggccgccctcgcccgtcaacacaacgacgccaacgtcatctccatcggcgctcgccagcacaccgtcgacgaagccacccgcttcatcgacctctttatcgccgagcccttctcgggagaagagcgccacgctcgccgcatcgcccagctcgccgaatatgagaccaccggcaccatcgccgcgcaccccttcgagaactaa

SEQ ID NO: 3412 - DNA, 465 bp, Aquifex aeolicus VF5
atgaagatagctatcggttcggatcacgcgggatttcctctaaaggaaaagataaaggaatttttaaagggagaagggcacaaggttatagacgtaggaactcacgctcaggagtccacccactaccctatatacgcaaaagaggtcgtaagggctataaggagcggaaaagctgaaaggggaatactcatatgcggaacaggaataggcatgtccattacagcaaacaagttcaggggcataagggcggcactttgcacgaacgagtacatggcacgcatgagcagactacacaacgatgcaaacgtcttgtgcttgggagagagagttctcggagttgaactcgccctttccatagtaaaagtttggctggaaacacctttcgaagggggaaggcacttaaagagactcgagataatatcagagatagaagatgaaatttgcggagaaaatataccccgataa

SEQ ID NO: 3413 - DNA, 447 bp, Hydrogenivirga sp. 128-5-R1-1
atgaagatcgcggtgggttctgaccatgcgggctttcccctgaaggagaggataaaggagttccttttggaggaaggtcacgaggttatagactttgggacgacctcggaagaatcaacccactaccccctatttgccagagatgtgtctcttgcagtccagagcggagaggctgacagggggatactggtgtgcgggactggcatagggatgtccataacagccaacaagttcaggggaataagggcagccctgtgtttcaacgagtacatggcacgcatgagcaggctgcacaacgatgctaacgttctctgcctcggagacagggttataggggaagacctcgccctcgcgatagttgaagtctggcttaagacgccctttgaaggtggaagacacgcgaagcgtgtggagcttatagcgaatatagaaagagagcacctttga

SEQ ID NO: 3414 - DNA, 447 bp, Hydrogenobaculum sp. Y04AAS1
atgagaatagccataggctcagatcatgctgggtttgacttaaaagaagccttaaaagaacacataatatcaaaaggccatgagctaatagattgcggtacacattccaaagaatccacagattatcctctttatgccaaagaagtggctcttcatattaaaaaccaaaaagccgacagaggcatactaatatgtggaagtgggcttggtatgtctatcagtgccaacaagataaagggcataagagctgctctttgcctaaacgaatatatggcaaggatgagcgtaaaagataacaacgcaaacgtcctatgtttaggcggtagagtaataggggttgagttggcaaaatctatagtggatgcttggtttgatgcccactttgaaggcggaagacacgaaagaagattaaggattatatcatcttttgaagaagaaggtatataa

SEQ ID NO: 3415 - DNA, 447 bp, Persephonella marina EX-H1
atgaaaatctctataggaagtgatcacgcaggttttgaacttaaagagattattaaggatcatcttcagaagaaaggatatgaggttgtagataaaggaacttactcaaaggagagcgttgattaccctttatttggtgaagctgtaggaagatccgtttctgaaggtgagacagacagggggatcgttatatgtggaacgggaataggtatatcaatctcggcaaacaagataaaaggtgtcagggctgcgctctgtacaaatgagtatatggcgagaatgtcaaggaagcataatgatgcaaatgtgcttgcattaggatcaagggttctgggaatagatctcgcattaagtatagttgataccttcctttcaacagattttgaaggcggaagacatgaaagaagagttcatctcatccagaatatagaaaaaattaatctttaa

SEQ ID NO: 3416 - DNA, 447 bp, Sulfurihydrogenibium azorense Az-Fu1
gtgaaaatagcccttggaagtgatcatggtggattcttctataaagaaaaaataaaggagtatttgaaatcaaaaaagtatgaaattatagacaaaggcacttactctcctgaacctgttgattatccatactttggtgagaatgtaggtatggcagttgcatctggggaagctgatagaggaataataatctgtggaacagggataggtatatctatagcagcaaacaaaataaaaggtgtaagagctgccttgtgtaccaatgagtttatggcaaggatggcaaggtctcataacgatgcaaacgttttagcccttggccaaagagttattggtttagaccatgcacttgcaatagttgacgtgtttttagaaactccatttgaaggtggaagacacgaaagaagagttaaacttattttagatattgaggaaggaaagatttaa

SEQ ID NO: 3417 - DNA, 447 bp, Sulfurihydrogenibium sp. YO3AOP1
ttgaaaatagcaatcggtagcgatcatggtggttttttctacaaagaaaaaataaaagaatatctaaaatcaaaaaaatatgaagttatagacaaaggaacttattctcctgaacctgttgattatccttactttggtgaagaagttggtaaaagcgttcaatctggcgaagctgatagaggaataatcatctgtggaaccggaataggaatatctattgcagctaataaaattaaaggggtaagagcggctctttgcacaaacgaatttatggcaagaatggcaaggtctcataacgatgctaacgttttagcccttggtcaaagagtaataggtttagaccatgctcttgcaatcatagatgtatttttagaaacaccttttgaaggcggaagacatgaaagaagagttaaattaattttagatattgaaaaaggaataatctaa

SEQ ID NO: 3418 - DNA, 435 bp, Bacteroides caccae
atgaaaacaatcggattagcatgcgaccacgccggttttgaactgaaagaatatgttcgcggctggctggaagcaaaaggctgggcttacaaagacttcggaacaaactctaccgcaagtgtagactatccggactatgctcatccgctggcccttgcagtagaatcgggtgaatgttatcccggtatcgctatctgcggcagtggaaacggaatcaatatgacgctgaacaaacatcagggagttcgtgctgcactctgctggaatgcagaaatagcgcacctcgcccgtcagcacaatgacgccaatatcctggtaatgccgggtcgtttcatcagtactgaagaggcggacatgattctgacagagttcttctccacacagtttgaagggggacgccaccagaaccgtataaataagattccaataaaataa

SEQ ID NO: 3419 - DNA, 435 bp, Bacteroides capillosus ATCC 29799
atgattgcacttggttccgatcacggcggctttgcgctcaagcagcacatcaagacttatctggacagcagaggcattgcctggaaggacttcggctgcgacagcaccgagagctgcgactaccccgatttcggcgccgctgccgctaaggcggtggcctccggcgagtgcgaaaagggcattgtggtgtgcaccaccggcatcggcatctccatcaccgccaacaaggtgaagggcatccgctgcgccctgtgccgggacgtgctctccgctgagctcacccgcaagcacaacaacgccaacatgctggcgctggccggcggcttcaccggtccctttgaggccgagcacatcgtctccgccttcctggacacggagtttgagggcggccgccacgagcgccgggtcaacaagatgatggccctggaggattaa

SEQ ID NO: 3420 - DNA, 435 bp, Bacteroides cellulosilyticus DSM 14838
atgaaaacaattggaatttgttccgaccacgccggatttgaattgaaacaatacatcaaggggtggttggaaactaaaggatgggaatacaaagacttcggcacctatacaacggagagctgcgactatgcagattttgctcatcccctggcattggccgttgaagccggagagtgttacccgggtattgctatctgcggaagtggtgaaggtatcagcatgacactgaacaaacatcagggtattcgtgctgcactttgctggactgcggaaattgctcatctggctcgccagcataatgatgccaacgtactcgtcatgccgggacgttttatcagcacagaagaagctgatatgattatgagagaattcttcagcacacagtttgagggtggacgccatcagaagcgtattgataaaataccggtgagataa

SEQ ID NO: 3421 - DNA, 435 bp, Bacteroides coprocola DSM 17136
atgaaagtaataggactagcttctgaccatgccggatttgaactaaaacaatatgttaagcaatggctggaagcaaaaggctgggagtacaaagatttcggaacatatagtaccgacagttgtgattatccggatttcgctcatcctctggctcttgcagtagaagctggagagtgttatccaggtatagccatttgtggaagtggagaaggcataggaatgaccttgaacaaacatcaaggtatccgcgctgcactttgctggattccagaaattgcacatctggctcgccagcacaatgatgcaaatgtactcgttatgccaggacgttttatcaacacagaaatggctgataaaatcatgtcagaattcttcactacagactttgaaggtggacgccatcaagcaagaattgacaaaattccagtaaaataa

SEQ ID NO: 3422 - DNA, 435 bp, Bacteroides coprophilus DSM 18228
atgaaaataataggattggcttccgaccatgccggattcgaactgaaagaattcgtgaaacaatggctggaacaaaaaggatgggaatataaagatttcggtacctactcaaccgccagctgcgactatcccgacttcgctcacccactggccgaagccgtagaagcaggcgaatgctatccgggcatcgccatctgcggaagtggagaaggaatcagcatgaccctcaacaaacaccagggaatacgcgccgcactctgctggatccccgaaatcgcccggcttgcccgccagcacaatgactccaatgtgctcgtaatgcccggaagatttatcgatacagcaaccgccgaccagatcatgaccgaattcttcaacaccgctttcgaaggaggacgtcatcaggcacgtatcgacaagatccccgtaaaataa

SEQ ID NO: 3423 - DNA, 435 bp, Bacteroides dorei DSM 17855
atgaaaaaagtaggactggcatccgatcatgcaggatttgaactgaaagagtttgtaaaaacatggttgactgaaaaaggttatccatgcaaagatttcggtacatacagtacagaaagctgtgactatgcagattacgcccatccgcttgcactggctatagaagccggagaatgcggacccggagtagctatttgcggaagcggtgaagggatcagcatgacattgaacaaacatcagggtatccgtgcggcactatgctggattcccgagatagcccatttgtcacgtcaacacaatgatgccaatgttctggtaatgccaggacgattcatagaccatgaaatggctgaaaaaatattagatgaattctttaacagcggctttgaaggcggacgtcaccaaaaacgcattgaaaagatacctgtaaagtaa

SEQ ID NO: 3424 - DNA, 477 bp, Bacteroides eggerthii
atgccttcagcctatcggcgcatacaaaaaataattattatgaaaacaataggaatctgctccgaccatgccggatacgcattgaaacaatacgtaaagcaatggcttgaaaccaaaggctgggaatacaaggacttcggcacttactcgcccgaaagcgtggattatcctgattttgcacacccgctggcactggcggtggaagcaggggaatgttatccgggcatcgctatctgcggtagcggaaacggcataaatatgacgctgaacaaacaccagggcatccgcgcagcattgtgctggacagccgaaatagcaggacttgcccgccagcacaacgatgccaatgtgctcgtgatgccgggacgcttcgtcaccaaccaagaggcggacgaaatcatgaccaagttcttctccaccccgttcgaaggcggacgccaccaacggagagtggaaaagataccggtaacagaataa

SEQ ID NO: 3425 - DNA, 435 bp, Bacteroides finegoldii DSM 17565
atgaaaacaatcggattagcatgcgaccacgccggttttgaactgaaagaatatgttcgcggctggctggaagtaaaaggctgggcatacaaagacttcgggaccacctctgcagcaagtgtagattatccggattatgcccacccgctggctcttgcagtggaatcgggtgaatgttatcccggtattgctatctgcggcagtggaaacggaatcaatatgacactgaacaagcatcaggggattcgtgcagctctttgctggaatgcagagattgcgcatttggcacgtcagcacaatgacgccaatatcttggtcatgccgggacgcttcatcagcacagaagaagcggacatgattttaaccgagtttttctctaccgagtttgaagggggacgtcatcagaaacgtatcgacaagattccggtgaaatga

SEQ ID NO: 3426 - DNA, 435 bp, Bacteroides fragilis
atgaagaaaattggaatttgttgcgaccatgccggttttgaattaaaagaatatgtaagaggttggctggaagcaaaaggctgggaatacaaagactttggaacatactcgacagacagctgtgactatcccgactttgcccacccgctggctctggctgtagaagccggtgaatgctatccgggaattgccatttgtggcagtggaaacggtatcagtatgacacttaacaaacatcaaggtatacgtgcggcactttgctggtcagcagaaattgcacacatggcacgcctgcacaacgatgcaaacgtactggtcatgcccggccgttatatcagtaccgaagaagcggacatgattatgacggagttcttctcgactgaatttgagggcggacgccatcaaaaacgcattgataagatcccggtaaagtaa

SEQ ID NO: 3427 - DNA, 435 bp, Bacteroides fragilis
atgaagaaaattggaatttgttgcgaccacgccggtttcgaattgaaagaatacgtaaggggctggctggaagcaaaaggttgggaatacaaagacttcggaacttactcgacagacagctgtgactatcccgattttgcccatccattggcactggctgttgaagccagcgaatgctatccgggaattgccatctgtggtagcggtaatggtatcagcatgacattaaacaaacatcagggtattcgtgccgcactctgctggacagcagaaatcgcacacatggcacgcctgcacaacgatgccaacgtattggttatgcccggccgttatatcagcacggaagaggcggatatgattatgacggaatttttctcgacagagtttgaaggcggacgccaccagaaacgcattgataaaattcctgtaaagtga

SEQ ID NO: 3428 - DNA, 435 bp, Bacteroides fragilis
atgaagaaaattggaatttgttgcgaccacgccggtttcgaattgaaagaatacgtaaggggctggctggaagcaaaaggttgggaatacaaagacttcggaacttactcgacagacagctgtgactatcccgattttgcccatccattggcactggctgttgaagccggcgaatgctatccgggaattgccatctgtggtagcggtaatggtatcagcatgacattaaacaaacatcagggtattcgtgccgcactctgctggacagcagaaatcgcacacatggcacgcctgcacaacgatgccaacgtattggttatgcccggccgttatatcagcacggaagaggcggatatgattatgacggaatttttctcgacagagtttgaaggcggacgccaccagaaacgcattgataaaattcctgtaaagtga

SEQ ID NO: 3429 - DNA, 435 bp, Bacteroides intestinalis DSM 17393
atgaaaacaattggaatttgttccgaccacgccggatttgaattgaaacaatacgtcaaggggtggttggaaactaaaggatgggaatacaaagacttcggaacctatacaacggagagctgcgactatgcagattttgctcatcccctggcattggccgttgaagccggagagtgttacccgggtattgctatctgcggaagtggtgaaggtatcagcatgacactgaacaaacatcagggcatccgtgccgcactttgctggacagcggaaatagctcatctggctcgccagcataatgatgccaacgtactcgtcatgccgggacgcttcatcagcaccgaagaagctgatatgattatgagagaattcttcagcacacagtttgaggggggacgtcatcagaaacgtattgagaagataccggttagataa

SEQ ID NO: 3430 - DNA, 435 bp, Bacteroides ovatus
atgaaaacaatcggattagcatgcgaccatgccggttttgaactgaaagaatatgttcgcggctggctggaagcaaaaggctgggcttacaaggatttcggaactaactctaccgcaagcgtagactatccggattatgctcatccgctggctcttgcagtggaatcgggagaatgttatcccggtatcgctatctgtggcagtggaaacggaatcaatatgacgctgaacaagcaccaaggggttcgtgctgctctctgctggaatgcagaaatcgcacacctggctcgtcagcacaatgacgctaatgtactggttatgccgggacgcttcatcagcactgaagaagcggacatgattttgacagagttcttctctaccaaatttgacggcggacgccatcagaaccgtattgataagattccggtaaaataa

SEQ ID NO: 3431 - DNA, 429 bp, Bacteroides pectinophilus ATCC 43243
atgatagcaataggatgtgatcacggtggatttgaattgaagaatgaggtgattgagcaccttaagagcagaggaattgagtgcgtggatgttggatgccacagcagggaatcatgtgattatcctgaatttgcaaaagcagtatgtgcgcagataacagacggccaatgccagcttggaattctcatatgcggaacaggcataggaatgtcaattgcagccaacaaagtcaggggtataagggcagcactctgcggtgactgcttcagcgcacaggcaacaaaggaacataacaatgccaatgtactctgcctcggagcaagagttacaggcccgggacttgcccttaagattgtagatactttccttgatactccattttccaatgatgagaggcacgtgagaagaatatccaagatcgaggactag

SEQ ID NO: 3432 - DNA, 435 bp, Bacteroides plebeius DSM 17135
atgaaaacaataggacttgcatccgaccatgccggatttgaattgaaacaatacgtgaaaaaatggctggaagccaaaggatgggaatacaaagatttcggaacttacacaaccgacagttgtgactatcccgactttgctcacccgctggctttggcagtagaaaacggagaatgctatccgggaattgccatctgcggaagtggtgaaggaatcggtatcaccctgaacaaacaccaaggtatccgtgccgcactttgctggattccggaaatcgctcatctggcccgtcagcacaacaatgccaacgtactggtgatgccgggacgtttcattgatgaagcaatggccgacaagatcatgacggaattcttcactaccgattttgaaggcggacgccatcaggcacgcatcgacaaaattcccgttcgataa

SEQ ID NO: 3433 - DNA, 432 bp, Bacteroides sp. 2_1_33B
atggatatagtaggtttgtgtagcgatcacgctggttttgagttaaaagaatatataaagacaatcctcgataaaaggggattgtcttataaagattttggaacttattcttctgacagttgcgattatccggatttcgcccatctgatgggcaaggccgtagaagctggcgaggtttatccgggaatagctgtctgcggtacagggaatggcattagtatgaccttgaacaaacatcggggtgtccgtgccgccttatgctggcgagaggatatcgcaaaactggcacgtgagcataacgacgcgaacgtgttatcaatgcccggtcgttttatcagcaaggaagaggctaagaaaatcgttgagatattcttggatacaccttttgagggtggtcgccaccaacgtcgtatagacaagatccctttgtag

SEQ ID NO: 3434 - DNA, 432 bp, Bacteroides sp. 2_1_7
atgggtatagtaggtttgtgtagcgatcacgctggttttgagttaaaagaatatataaagacaatcctcgataaaaggggattgtcttataaagattttggaacttattcttctgacagttgcgattatccggatttcgcccatctgatgggcaaggccgtagaagctggcgaggtttatccgggaatagctgtctgcggtacagggaatggcattagtatgaccttgaacaaacatcggggtgtccgtgccgccttatgctggcgagaggatatcgcgaaactggcacgtgagcataacgacgcgaacgtgttatcaatgcccggtcgttttatcagcaaggaagaggctaagaaaatcgttgagatattcttggatacaccttttgagggtggtcgccaccaacgtcgtatagacaagatccctttgtag

SEQ ID NO: 3435 - DNA, 438 bp, Bacteroides stercoris
atgaaaactattggactttgttccgaccacgccggctttgaactgaaagagtatgtccgcggttggctggaagccaaaggctggccttacaaagattacggaacctactccaccgaaagctgcgactatcccgactttgcccatcagctggcgcaagctgtcgaagcaggcgaatgctacccgggaattgctatctgcggcagcggaaacggcatcaacatgacgctcaacaagcatcagggcattcgtgcggctctttgctggactgccgaaattgctcatctggcacgccagcacaacgatgccaatgtccttgtcatgccgggacgcttcatcggcacggaagaagcggatatgattatgaccgaattcttcaacacttcgtttgagggcggacgccaccagcggagaatagacaagataccggtacagggataa

SEQ ID NO: 3436 - DNA, 435 bp, Bacteroides thetaiotaomicron
atgaaaacaattggattagcatgcgaccacgccggttttgaactaaaagaatatgttcgcggctggctggaagtaaaaggctgggcttacaaagatttcggaaccaactctgccgcaagcgtagattatccggactatgcccatccgctggccctagcagtagaatcgggtgaatgttatcccggtattgcgatctgcggcagcggaaacggaatcaacatgactctgaacaagcatcagggaatacgtgctgctctttgctggaatgcagagatcgcacatctggcccgtcaacataatgacgctaatattctcgtgatgccgggacgcttcatcagcactgaggaggcggacatgatattgacagagttcttctcaacacagtttgaggggggacgccatcaaaatcgtattgataagattccggtaaaataa

SEQ ID NO: 3437 - DNA, 438 bp, Bacteroides uniformis
atgaaaacaataggaatctgttccgaccatgcaggcttcgaattgaaggaatatgttcgcggctggttggaagccaaaggctgggcttacaaggacttcgggacctactcaaccgagagttgcgactatcccgactttgcacatcctttggcactggccgttgaagccggagagtgctatccgggaattgccatctgcggaagcggtgaaggtatcagcataacgctgaacaagcatcagggtatccgcgcagccctctgctggacggcagaaatagcccatttggcacgccagcacaatgatgccaatgtgcttgtcatgccagggcgattcatcagtaccgaagaagccgacatgattatgagggaattcttcagtacaccattcgaaggcggacgccaccaacgaagagtggacaagataccggtacacttgtaa

SEQ ID NO: 3438 - DNA, 435 bp, Bacteroides vulgatus
atgaaaaaagtaggactggcatccgatcatgcaggatttgaactgaaagagtttgtaaagacatggttaactgaaaaaggctatccatgcaaagatttcggtacatacagtacagaaagctgtgactatgcagattatgcccatccgcttgcactggctatagaagccggagaatgcggacccggagtggcaatttgcggaagcggtgaaggcatcagcatgacattgaacaaacatcagggtatccgtgcggcactatgctggatgcccgagatagcccatctgtcacgtcagcacaatgacgccaatgttctggtaatgccgggacgattcattgaccatgaaatggccgaaaaaatattggatgaattctttaacagcggcttcgaaggcggacgtcaccaaaagcgcattgaaaagatacctgtaaagtaa

SEQ ID NO: 3439 - DNA, 432 bp, Parabacteroides distasonis ATCC 8503
atgggtatagtaggtttgtgtagcgatcacgctggttttgagttaaaagaatatataaagacaatcctcgatgaaaggggattgtcttataaagattttggaacttattcctctgacagttgcgattatccggatttcgcccatctgatgggcaaggccgtagaagctggtgaggtttatccgggaatagctgtctgcggtacagggaatggcattagtatgaccttgaacaaacatcggggtgtccgtgccgccttatgctggcgagaggatatcgcgaaactggcacgtgagcataacgatgcgaacgtgttatcaatgcccggtcgttttatcagcaaggaagaggctaagaaaatcgttgagatattcttggatacaccttttgagggtggtcgccaccaacgtcgtatagacaagatccctttgtag

SEQ ID NO: 3440 - DNA, 432 bp, Parabacteroides johnsonii DSM 18315
atgaaaacattaggtttatgtagtgaccacgcagggtacgaactaaaagaattcgtaaaacaaatactcaactcgaaagggttaacctataaagatttcggaacctgctcgacagaaagttgtgattatcccgattacgcccatccgcttgccgaagctgtagaagcgggcgaagtatatcccggaatagcgatctgcggatctggaaacggaatagccatgacactcaataaacatcagggaatacgggccgctctatgctggcaggaagagatagcacgtctcgcacgcgagcacaacgatgccaacgtacttgtaatgcccggcagatttatcagtcaagaggaagctactcacacggtcgaagcctttctaaacacctcgttcgaaggcggtcgacatcagcgcaggattgacaaaatccctttgtga

SEQ ID NO: 3441 - DNA, 432 bp, Parabacteroides merdae ATCC 43184
atgaaaacattaggtttatgtagtgaccacgcagggtacgaactgaaagaattcgtaaaacaaatactcgactcgaaagggttggcctataaagatttcggaaccgactcgactgaaagttgtgattatcccgattacgcccatccgcttgccaaagctgtagaagccggcgaagtatatcccggaatagccatctgcggatccggaaacggaatagccatgacactcaataaacatcagggaatacgggccgctctgtgctggcaagaagagatagcacgtctcgcacgcgagcacaataatgccaacatactcgtaatgcccggcagatttatcagtcaagaggaagccactcatacggtcgaagcctttctgagcaccccgttcgaaggcggtcggcatcagcgcaggattgacaaaattcctttgtga

SEQ ID NO: 3442 - DNA, 435 bp, Porphyromonas endodontalis
atgaagagatttggattgtgttcggatcatgccggttttgctctcaaagaagaggtgaagaagatcctcacagacctgggtattgagtatcaagattttggcacttacagcgaagagcgtgccgattatcccgattttgcacacaaattgggagaggctattgatagtggcgagctagagtgggggattgccatatgtggctcgggtaatggcatatctatggctctcaataagcatccccatgtgcgtgctgcactttcttggaacgaagagattgcggcactgggtagagcacacaataatgccaatgtgctttcgctccctgctcgatttgtttcgttggatgaggctaagaagattataatggcattcctctctacagattttgaggggggacggcatgaagctcgtgtagcaaagattcctctttgttaa

SEQ ID NO: 3443 - DNA, 438 bp, Porphyromonas gingivalis
atggaaacaatcggtatttgtagcgaccacgccggatatgaattgaaagaacgcgtaaaggcatggcttgcagagcaaggcatcacgacaaaagacttcggatgccactcttccgaaagcgtcgattatcctgattttgcccacccattaggctctgccatcgaacggggggagctgaatcgtggcatatcgatctgcggttccggcaacggcatatccatggtgatgaacaaatatccccacgtacgtgccgccctttgctggactgaggagatcgctcgtttggctcgtcagcacaatgatgccaacgtcctctcgctgcctgcacgcttcatctcggacgaacaggccaaagctatcttgaaaatctatttggagacgccttttgaagggggacgccacaaggcccgaatagacaaaattcccatccggaagtag

SEQ ID NO: 3444 - DNA, 438 bp, Porphyromonas uenonis 60-3
atgaaactaggtgtttgctcagaccacgctggctatcagctcaaagaacaggtcaaggagtggcttgcagccatgcagatcgagtgtgtcgactacggtactcattcggaggagcgctgtgactatccagactatgcgcatcagcttgcttttgccatacagatgggtacggtagatcgtggtatcgctatctgcggtacgggcaatggtatggctatgacgctcaataagtacaacgtcatccgtgctggtctcgcttggaacgaggatattgctaagctcatccgtgcgcacaatgacgctaatgtgctggtcatgccagcacgcttcatagagacggcggaggctgagcgctgtctgcatgcgttccttgatactccctttgagggcggtcgtcacaaggagcggattgacaagatggtgctacccacctgctag

SEQ ID NO: 3445 - DNA, 459 bp, Prevotella bergensis DSM 17361
atggaagtcaaaacaataggattggcaagcgatcatgctggctttgccttgaaacaatttgtgaaagactatctcgacgagaaaggcataccctacaaggattttggagcttacaccgacgagagttgcgactatgctgactttgcccatccattggcgcgagccgtcgaggccaacgaagtgtatccgggtattgccatttgtggctccggcgaaggaatcagcatcacgcttaacaagcatcagggaatacgtgcggccttggcatggattccagacattgcccatctcgcacgccaacacaacaatgccaacgtgcttgttatgcccggtcgtttcatcgacaacgacacggcacgcaaagtgatggacgagttcctctccaccgattttgatggtggccgtcatcaacgccgcatcgataaaataccgatggattcttgtcagaaaaaggattga

SEQ ID NO: 3446 - DNA, 441 bp, Prevotella buccalis
atggatatcaagacagttggcctcgcatgtgatcatgctggctatgaaataaaagagtttatcaagcaataccttgaagagaaaggtatttcgtacaaagactatggcaccaacagcacatcctcttgtgattatcccgatcacgcccatgccttagccaatgccattgagcggggtgacgtctatcccggtatcggtgtgtgtggttcgggagaaggaatgagcatgacgctcaataagcatcaaggaatacgtgccggactggcttggtcgcccgagattgctcacttgactcgtctccataacgatgccaatgtgttggttctgccgggaagatttgttgacaaggagacgacaagaaagattcttgatgagttcttttctaccgatttcgaaggtggacgacattctcgcagaatagcaaagatacgtattcaatag

SEQ ID NO: 3447 - DNA, 444 bp, Prevotella copri DSM 18205
atggaagtaaagacagttggtattgcatgcgatcacgcaggttttccattgaagcaatttgtattggaatatttggaaaagaagggttatcctgtaaaggattatggtacatacagcgatgcgagtgtagactatcctgacttcggtcatgctcttgctaaaggcattgagagcggcgaagtatatccaggtatcggcatttgcggcagcggcgaaggtatcgccatgacattgaataaacatcagggtgtacgtgccggattggcatggtgcaaggagattgctcatttggttcgtcagcacaacgatgccaacgtattggtacttccaggtcgtttcgtagacaacaagaccgccgaggctattctcgacgagttctttgccacaacattcgagggtggccgtcacgagcgtcgcgtcaagaagattcctgttcagcagtaa

SEQ ID NO: 3448 - DNA, 447 bp, Prevotella melaninogenica
atggaaattaagacagtaggagttgcctgcgaccacgcgggctatccattaaagcagttcgttatccagtatttggaagagcacaagtatgcatataaggactttggctgtaatagcgatttaagttgcgactatcctgactatgctcacccattggctgaagccattgagagtggtgaagtttatcctggtatcgctatctgtggtagtggtgagggtatggcaattgcacttaacaagcaccaaggtgtacgcgcaggtttggtatggaacaaggacgttgcagagttgactcgtcaacataatgatgcaaatgttgctgtacttcctggcagatttatcgataataagacagcagaaaagattctcgatgcgttcttcaaagcaagcttcgagggtggcagacacgagcgtcgtgttaagaagattcctgttcaacagggctaa

SEQ ID NO: 3449 - DNA, 444 bp, Prevotella oris
atggaagttaaaacagtaggtcttgcctgcgatcatgcaggctttcctttgaaacagtttgtactcgagtatcttgaaaagaaagggtatcaagtaaaagactttggcacatacagtagtgagagcgttgattatcccgactttgcccatccattagcagaggcagtagagaatggcgacgtttatcccggcatcggcatatgtggcagcggcgaaggcatggccattacgctcaacaaacaccagggcgtgcgtgcaggtcttgcatgggataaagacattgctcaattgatcagacagcataacgatgccaatgtcattgttttgcccggacgcttcattgacaacaaaaccgcagaaaaaattcttgatgcattcttcacagccacgtttgaaggtggtcgccacgagcgccgagtgaagaaaataccactaaaagagtaa

SEQ ID NO: 3450 - DNA, 444 bp, Prevotella sp. oral taxon 472 str. F0295
atggaaataaagactattggtatcgcttgcgaccacgcaggcttcccgctcaagcaatacgttcttcaatacttggaagagcatggttatccgtacaaagactatggtacatacagtgaccaaagcagtgactatcccgactttgctcatgccttagctaaaggcattgaaagtggtgaggtttatcctggtattggtatctgcggaagtggtgagggcatagccatgaccctcaacaaacaccaaggcgtaagggctggattggcttggatgccagagattgcacaacttattcgccagcataatgatgccaacgtgctggttatgccgggcagatttgtagacaataacactgcaaagaagattctagatggcttcttctcagcttcgttcgaaggtgggcgtcacctcaatcgagtgaagaagatccccgttacagaataa

SEQ ID NO: 3451 - DNA, 462 bp, Prevotella tannerae ATCC 51259
atgattttaaattatataacaatgaatacaacaataggattggcttgtgatcacgcaggttttgaacttaagcagtttgtaatacaatacctcgagaaaaaaggtatatcttacaaagattatggaacttatagtacgatgagctgtgattatcctgacttcgctcatgctttagcagaaggcatagagcagggggaagttgaaaaaggaatagccatctgtggttcaggagaaggtatttctatgaccttaaataagcaccaatctattcgtgcagcccttgcatggaatgaagaggtcgcaggtctttgcagacagcataatgatgcaaatgtgctgtgtatgccggggcgttttatagacaataaaacagcagaaaaggttatggataagttctttagtacaccttttgaagggggaagacacgagcgtcgcatcaataaaataccactgaaaccctaa

SEQ ID NO: 3452 - DNA, 441 bp, Prevotella timonensis CRIS 5C-B1
atgaatattaagaaagttggactcgccagtgaccatgcgggcttcggattaaaggagattattaaagaataccttgatgagaaaggcattgcctaccaagacttcggcacccattctgaagcttcttgcgactaccccgaatatgcccatgcgttggcgtcagcagtagagaaaggcgatgtctacccagggataggagtctgtggctcgggcgaaggaatgagcatgaccctcaacaaacatcagggaatacgtgctgcattggtatggcaacccgagattgcccacatgaccagaatgcacaacgacgccaatgtattggtgttgccgggtcggtacatggacaaagaaacggcatggcaagtcttagatgaatttttcaacacagaatttgaaggtggccgccatgttcgtcgcatcgagaagatacctgttgaataa

SEQ ID NO: 3453 - DNA, 447 bp, Prevotella veroralis
atggaaataaagacagtaggagtagcttgcgatcacgcaggttttccattgaagcaatttgttatccagtatctggaacaacacaagtatgcatataaggactttggttgtaatagcgatttaagctgtgattatccagactatgctcatccattagcagaagcgatagagagtggtgaggtctatcccggcattgccatctgcggtagtggtgaaggcatggcaatgacgctaaacaagcatcaaggtgtacgtgcaggtctagtttggaataaagatgtggcagaattgacccgccaacacaacgacgcaaatgcgattgttctccctggtcgtttcattgataacaagacggcagagaagatccttgatgagttcttcaaggctagctttgaaggcggtagacatgaacgccgtgtgaagaagattcctgttcaagaaggttaa

SEQ ID NO: 3454 - DNA, 453 bp, Alistipes putredinis DSM 17216
atggaaaagaaaatcggtatcgccagcgaccacgcgggctatgaaatgaaagaatttctggtaggctatctggctgcgaagggttgggatgtcctcgacttcggccccgaatccgaggagagcgtcgattaccccgatttcgcacacccgctggccaatgccatcgaaagcggggagctggagcgcgggatcggactctgcggttcgggcgaaggcatggccattaccctcaacaagcaccagggcatccgtgcgggactcgtatgggacaagcagatcgcccacctgatccgccagcacaacaacgcgaacgtgatcgtgctgcccgcccgtttcatcaccaacgaccaggcagtggaattcgtcgaagagttcctcgccaccgatttcgaaggcggccgtcaccagcgacgcatcgagaagattcccgtcaaggcgtgcaaccgtcaataa

SEQ ID NO: 3455 - DNA, 447 bp, Candidatus Azobacteroides pseudotrichonymphae genomovar. CFP2
atggaaattccaattatcggacttgcatcagatcatgcaggctatgagttaaaagaatttatccaaatacttttgaacgatcgagatatgtcctatatcaattatgggacatatactaccgatagtgtagattacccaatctatggacataaactagcgaaagcttttgaaaaaggagaggtatcggttggaataggaatttgtggatctggtaatggaatcaatatgacgttaaataaacatcagaaggtacgctccgctttgtgctggaatgaagaaatagctcgtttggcacgagaacacaacaatgcaaatgtattggtattgcccgctcgcttcctttcacaagaagaagccaaaaagataatagatattttcctaaatacaccatttaaaaggggaaacaagcgacatcaacaaagaatcgaagctattccgttaaaatga

SEQ ID NO: 3456 - DNA, 429 bp, unknown
  unidentified eubacterium SCB49
atgaaaatagccatcggaaacgaccacgcaggaccagattataaatttgccattgtaaaatatcttgaagaccaaggtcacgaggtagtaaattttggaacagatacactagacagtgtagattatccagattttgcaaatccagtatcaaaagccgttaatgacggtgaagtaccttacggtatcttaatttgcggaagtgcaaacggtgtagccatgacagcaaataaatatcctaaagttcgcgcaggtatttgctggacaaaagaaattacaagcttaacacgccagcacaatgatgcaaatgttatttgtattccggctcgttatacatctatacctcaagcggtgggtatggtagaaacttttttaaatacagcatttgaaggaggacgtcaccaaaatagagtcgctaaaatttgcatgtag

SEQ ID NO: 3457 - DNA, 474 bp, Blattabacterium sp. (Blattella germanica) str. Bge
atgtcttttgcaaaaattattatgctaatagcaataggatctgatcatacaggagtatactataaatctttaattaacaattttttgactaaaataggatgtaaaatcaaggattttggattgtttgaatatggagaaaaagttgattatcctgattttatccatcctacagctgaatttgtagaaaaaggaaaggcagattttggtattattatatgtggaagtggaaatggggcggctatgactgcaaataaatacgaaaaaattcgtgcggctttagtatggaataaagaagttgcttttttagcaagaaaacataacaatgctaatattattagtttacctgcacgttttttagataaaaatgaaattttagaaattgtagatatatttctaaaaacaaattttgaagggggtaggcataaaattagaataaaaaaaataccaataaatagtaaatataatcctcagtag

SEQ ID NO: 3458 - DNA, 438 bp, Blattabacterium sp. (Periplaneta americana) str. BPLAN
atgaaaatagcaataggatctgatcatacaggaatagattgtaaacatttgataattaagtttttagttaaaaacggttatcatataagggattttggtttttctagctatggaaaaaaagttgattatccagatttcattcatcctacagttgaatcagtagacaaaggggagatggattttggaattattatttgtggaagcggaaatggagctgctatgactgctaataaatatcaaaaaatacgtgcggcattagtgtggaataaagaagtagcattcttagcgaggaaacacaataatgctaatgtgttaagtttgcctgcgcgttttgtaaaaaatgaaaaagaggttttggaaatagtagaaatgtttttgaaaacggactttgaaggtggaagacataaaagaaggatagaaaaaattccaataaaatga

SEQ ID NO: 3459 - DNA, 432 bp, Capnocytophaga gingivalis
atgaaaattgtaattggaaatgatcatgcaggtactgagtataagaatttgattcttcagtacttattatcaaaagattaccaagtaaccaatgtaggagcagatacttcccaaagtgtagattatcctgattttgcacaccctgtaggtgaaatgattgacaaaggagaagccgactggggaattgtcatttgtggtagcggtaatggggtcgccatgacagtcaacaagcaccctaaagtacgatgcgccttatgctggaacaaggaaatagctgccttggctcgagcacataacaatgctaatgtcttagccatccctgcccgatttacagccgctgaacaagccttggaaatggtcaagactttcttggaaacgcctttcgaagagggcagacaccagcgccgtgtagagaaaattcaactatgctaa

SEQ ID NO: 3460 - DNA, 423 bp, Capnocytophaga ochracea
atgaaaatagccataggaaatgaccacgcaggagtcgattataaaaaagctattgtagcttttctggaaagtaaaggaatagaagtactcaactgcggtaccgatacttctgaaagtgtagactaccccgattttggtcacgccgtagccaaagccttagaagaaaacaaagccgaccttggtattgtgatttgcggtagtggtaacggcattgcaatgagtgccaataagcaccctcacatccgctgtgcagtctgctggacaaaagagctctctgctcttgcccgtgcccataacaatgccaatgtgctaagcattcccgcccgctttaccgccattgagcaagccgtagatatagccaatacctttctcaacaccccttttgaaggcggtcgccacgaaagaagagtaaagaagatttaa

SEQ ID NO: 3461 - DNA, 423 bp, Capnocytophaga sputigena
atgacaatagctataggaaatgaccacgctggtgtggattacaagaacgctatcacagcctttttaaaaagcaaaaatattgaagtcctcaacttcggaacagatacccccgaaagcgtagactaccccgattttggtcacgcggtagcccaagccttagaagaaggcaaagccgacctcggtattgtgatttgcggcagtggcaacggcatcgcaatgactgccaacaagcacccacacgtacgttgcgctgtatgttggacaaaagaaatttcagcccttgctcgcgcccataacgatgccaatgtactcagcattcccgcccgcttcaccgccattgagcaagcagtagaaatcgccaatacattcttaatcaccccatttgaaggcggtcgacacgaacgccgtgtaaataaaatttaa

SEQ ID NO: 3462 - DNA, 435 bp, Chryseobacterium gleum
atgaaaagaaaaattgctgttgcagcggaccatgcaggctatgaatataaggagattgttaaaaactacctttcagaacattttgaagttcaggattttggaacgttttccacaaacagtgtggattatccggactttgtacaccctgccgcaacttctgtggaaaacggagaaaatgaactgggaattttgttctgtggaagcggaaacggagttcagatcactgccaacaaacatcagaaaattagatgtgcactttgctggatgccggagattgcaacgctggcaagacagcataatgatgccaacatgatttcgataccggcgagatttatatcaaaggaactggccattgaaattgtagataaatttctttctacagactttgaaggcggaagacaccagaacagagttgataaaattgcattttgctaa

SEQ ID NO: 3463 - DNA, 432 bp, Croceibacter atlanticus HTCC2559
atgaaaattgctattggtaatgaccacgctggtacattttacaaaaatacaattgtagagtaccttaaatctgaaaatattgaagttattaattacgggacaaactctgaggatagtgtagattatccagactttgtacatcctgttgcagcagatgtagagtctaatagtgtaaatcttggtattataatttgtggtagtggtaatggtgcatctatgacagctaataaacaccaaggcgtacgttctgctttatgctggacaaaagagattacaaaacttgccagagagcataatgatgctaatattttaagcattcctgcacgatttacatctgtacaacaagctttagagatggttaaagtgtttttaaatactgagtttgaaggtggtcgtcaccaaacacgtgtagataaaatagcgtgttcttaa

SEQ ID NO: 3464 - DNA, 432 bp, Dokdonia donghaensis MED134
atgaaaatctctataggaaacgatcacgcaggacctagttataagaatgttattgtcaagtttttaaaagaagccgggcatactgttagtaattatggtacagacacaccagatagtgtagactatccagactttggacatcctgttgcgacagatgtagaggagggtaaggcagattttggtatcgttatatgtggtagtggtaacggtattgcaatgactgttaataagcatcaaggtgtacgtgcggccctatgctggataaaagaaattgccattcttgcacgtgagcataacaatgcaaatgtgatagcgataccagcacgctacacttcagaaatgcaggcgcttgagatggtaaaagcatttattactacagagtttgaaggaggtcgccaccagagacgtgtagacaaaatagcttgtaactag

SEQ ID NO: 3465 - DNA, 432 bp, Flavobacterium johnsoniae
atgaaaatttcgataggaaacgaccacgcaggaccagaatataaaaaatcaattgtagctatgcttgaagcaagaggatatgaagtgaccaattatggaacagatacagatgcttctgttgattatcctgattttggacatccagttgctaatgatgtatctgaaggaaaagcagattttggaatcgtaatctgcggaagcggtaacggaattgcaatgacggttaataaacaccctaaagtaagagctggtttatgctggactaaagaaattgcttatttaacgcgtttacataacgatgcaaacattgtaagtattccagcgagatttacatcaattcatcaagctgttgaaatcgtcgaaactttccttgatacggcttttgaaggcggaagacatcaaaaccgagttaataagattgcttgttcgtaa

SEQ ID NO: 3466 - DNA, 429 bp, Flavobacterium psychrophilum JIP02/86
atgaaaatatcaatagggaacgaccacgcaggaccagattacaaaaaagcaattgttcagtttttagaacaaaaaggacatatcataacaaaccacggcaccgatagttttgatagtgtagattatccagattttggtcataaagtagccatagatgttactaatagaaaagcagattttggtataatcatttgcggaagcggaaacggaattgccatgtcagcaaacaaacaccaaggaattcgtgccgctttgtgttggacaaaagaaattgcgtctttagctcgccagcataatgatgctaatattataagtattcctgctcgttatacatcgattcagcaagctatagaaatggtagatacatttttaaatactacttttgaaggcggacgacacgctacaagagtaggaaaaattagttgttag

SEQ ID NO: 3467 - DNA, 441 bp, Gramella forsetii KT0803
atgaaaatatcaattggaaatgatcatgcgggtacagattataagcaaatgatccaggaaaagcttgaatctatggggcatacggtaactaattatggaactaatgctgaagacagtgtagattacccagattttgttcaccccgtagcgcaagatgtagagaataaaaaggccgatcttggaatcattatctgcggaagtggaaatggcgctaatatgacggctaataagcatcagggtgttagatcggcactatgctggaatacagagatcgcaaaactctcccgtgagcataacgatgctaatattttaagtattcctgccaggttcgtttctaaagacttagctacccaaatgatggaaacctttgtaaatactgaatttgaaggcggacgtcatcaaagaagagtagataaaattcccgcaaaaaaagcttgttaa

SEQ ID NO: 3468 - DNA, 435 bp, Kordia algicida OT-1
atgaaaaatatagctatcgggaacgaccacgccggaaccgattataaaaatgcaattactgcacatttggaagcgaaaggttacacgattcaaaattacggaaccaactcagatgatagtgtcgattatccagattttattcatccagttgctactgatgtggaaagcggaaaagttccgtttggaattattatctgcggaagcggaaatggtgctgccatgactgcaaataaacatcaaaaggtacgagctgcactttgttggaccaaagagattgtagcacttgccagacaacataatgatgcgaatattttgagtattcctgcgcgttttacgtcattgccacaagccattgcgatggttgatacgtttttggaaactgaatttgaaggcggaagacaccagcgtagagtagcgaaaattgcttgtagttaa

SEQ ID NO: 3469 - DNA, 438 bp, Polaribacter irgensii 23-P
atgagaattgctattggaaatgaccatgcgggaacaatatataaatttgaaattatcaaacacttagaaagtaaaggatatgaagttttaaattttggaacagatacagatgcttccatggattatccagatgcaattcacccaactgcaactgcagtagaaaatggtacagccgctttcggtattattttatgtggtagtggtaatggcgcacaaatgaccgcaaacaagcatcaaggaattcgtgcggcactttgttggaataacgaattagtagcgcttacaagacagcacaataatgctaacatacttactatcccagctcgatttgtttctttacaacaggccattggttttgtagatatctttcttactacagattttgaaggcggcaggcatggagatagggttgagaaaatagcatgtgcaggtttgtaa

SEQ ID NO: 3470 - DNA, 435 bp, Polaribacter sp. MED152
atgacaattgccataggtaatgatcacgcaggaactgaatataagttcgaaattataaaacatttagaggaaaaaggatatactgttctaaattttggaacggatactaacaattctatggattatcctgatgctattcacccaacagcagatgcacttgaatctggtaaagcagaattaggtattattttatgtggttctggtaatggtgcacaaatgacagccaataaacatcaaggtattagagctgctttgtgttggaataatgagttggttgctttaacaagacaacataatgatgctaatattttaactattcctgcacgttttgtgtctttacaacaagctcttggttttgtagatgtatttttaaacactgaatttgaaggtggacgtcatgcaaatagagtaaacaaaatttcttgtgctggctaa

SEQ ID NO: 3471 - DNA, 432 bp, Psychroflexus torquis ATCC 700755
atgataatttcaattggtaatgatcatgctgggacgttttacaaaaataaaattgtagattatcttaagtcccaaaatattgaggtacataatcatggtaccaattctgaggatagcgttgattatcctgatttcgttcatcctgtagctatagatgttgaagatggaacctcaagtttaggaatcattatttgtggaagcggtaatggggctaatatgaccgctaataaacaccaaggaatacgctctgcactgtgttggactagtgaattggtagctttagcaaaacagcataataatgcaaatgtactgagtattccttcaagatttgtttctttagaagaagcgctagattttgtaacagtttttttaaaaactcctttcgatggtggccgtcatcatcatagagtagataaaattgcatgtcattag

SEQ ID NO: 3472 - DNA, 420 bp, Psychroflexus torquis ATCC 700755
atgcaaaataaaaatatattcattgcctcagaccatgctggatttaaccttaaaaccaaattgttaaagaattttccaaaaattaatgatttaggtacaaagacagatgagagtgttgactatccagattttgcacacaaattaactagagaagttcttaagaataagaaaaatgttggtatattaatctgtggaactggcgttggtatgagtattgctgctaatagaaaaaaaggaattagggctggtcttgctaataattcaaaaatagcaagattgataagaaagcacaatgatgctaatgtacttgttttaccaggcaggtttataaatactagcgaggcaaaaaaaagtgttcaggcttttctttctacaaagtttgagtcaggacgacataaaagaaggattaaaaaactatga

SEQ ID NO: 3473 - DNA, 510 bp, Robiginitalea biformata HTCC2501
ttgaaacaaaccattgattttttcaaacgacagatgatttacatagcatccgaccatgcgggatttgaactgaagaatgccctgtgccgccacctggctgcctcgggacgggatgtggaagacctgggcccgtatgcatacgacccggaggacgattatccggatttcatcctgccggcggcggaagccgtggcggcaaatcccgggagcctcggggtggttctcggcggttccggacagggcgaggcattggcagccaacaaagtagagggcgttcgggctgccctgtattacggcggacccagggatattgtctccctctcccggacccataaccaggctaatattctcagcctgggcgcccggttcctggacgaggaggaggccatcgccgtactggaactctggttggagaccccttacggcagggaggaacgacatgttcgaagaattaataaggtccgcgcatacgaacaaaaacgggcaggagggccggccgaaaattcatga

SEQ ID NO: 3474 - DNA, 432 bp, Robiginitalea biformata HTCC2501
atgaaaatagccattggaaacgaccatgcgggtaccgagtacaagctggccattgtgggtttgctaaaatccatggatatcgaagtaatcaaccacggcaccgacggtacggacggagtggattatgcggattttatccatccggttgccacggatgtcgcttccggggaggcagacctggggattgtggtatgcggcagcgggaacggtgcctgtatgactgccaacaagcaccaggagatccgggcggccctctgctggaacaaggaaatcgtttccctggctcgggaacacaacaatgcgaatatactgggcctgccggcgcggttcctggccattccccaggcgcttgagatggtgcgaactttcctggatacgccttttgaaggcggccgccaccagaggcgaatcgaaaaaataccctgttactga

SEQ ID NO: 3475 - DNA, 429 bp, Flavobacteriaceae bacterium 3519-10
atgaaaaagataagcatcgccagcgaccatgcaggttacgcgtataaagaagcgattaaaaaacatttcgccgggcaataccagatcgaagattttggtaccttttcggaagactcggtagattaccccgattttgtgcacccaagtgcagaatcagtagaaaccggccgtaatgaacttggcatccttatatgtggcagcggaaacggcgtgcagatgacggcgaacaaacataaagcaattcgctgtgcactttgctggatgcccgaactcgcagaactggcaagaaagcacaacaatgcaaacatgatcgcgctgccggcccgcttcattgcggtagaattggctattgacgttgtggaaaaattccttacaactgattttgaagccggacggcatcagctgcgggtagataagatcccgtgctaa

SEQ ID NO: 3476 - DNA, 432 bp, Flavobacteria bacterium BAL38
atgaaaatttcaattggaaacgaccacgcaggtcctgactacaaaaaagcaattgttcaatttcttgaagaaaaaggacatactatttataaccacggaaccgatacttttgatagtgtagattatcctgattttggtcatccagtagcttatgatgtagaaagtaaaaaagcggattttggaattgttatttgtggttctggaaacggaatagccatgacagttaataaacatcaagatattcgtgctgctttatgttggacaaaagaaattgctgctttagcacgccaacataacgatgcgaatattttaagtattcctgctcgttatacttctattcaacaagcaattgaaatggtagatacttttttaaacacttcttttgaaggtggaagacacgctaatcgtgttaaaaaaatcgcttgtaaataa

SEQ ID NO: 3477 - DNA, 435 bp, Flavobacteriales bacterium ALC-1
atgaaaatatctataggtaacgatcacgcaggtccagattataaacaagcagttgtaaagcatttagaaactaaaggatatactataactaattatggtaccgatactttagatagcgtagattatccagattttgtacatcctgttgctaaagatgttaatgatggtaacgcagatttaggtatcttaatttgtggtagcgctaatggtgtagctatgacagcaaataaataccaaaatgttagagctggtgtgtgttggactagtgaaattacagaattgacacgtttacataataatgcgaacattatttgtattcctgcgcgttttacatcaattcctcaagctattaaaatggtggatacatttttaaatactgcgtttgaaggtggtcgtcatcaaaaccgtgtagataagattccattatcatgttag

SEQ ID NO: 3478 - DNA, 411 bp, Flavobacteriales bacterium ALC-1
atgaaaatatctataggtaacgatcacgcaggtccagattataaacaagcagttgtaaagcatttagaaactaaaggatatactataactaattatggtaccgatactttagatagcgtagattatccagattttgtacatcctgttgctaaagatgttaatgatggtaacgcagatttaggtatcttaatttgtggtagcgctaatggtgtagctatgacagcaaataaataccaaaatgttagagctggtgtgtgttggactagtgaaattacagaattgacacgtttacataataatgcgaacattatttgtattcctgcgcgttttacatcaattcctcaagctattaaaatggtggatacatttttaaatactgcgtttgaaggtggtcgtcatcaaaccgtgtag

SEQ ID NO: 3479 - DNA, 471 bp, Flavobacteriales bacterium HTCC2170
atgtatttgtacatttgtggtaaactcactcttacaaaaatgaaaatttcaataggtaatgatcatgcgggaaccgaatataaattagctataatcggccttttaaaatcaatgaatatagaagttagcaattatggtaccgatggtactgatagtgttgattatcctgattttgtacatccagtggctaaagatgtagaggaaggaaaagtgaattatggtataattatatgtggaagtggcaatggtgcttcaatgacggcgaataaacatcaaaagatacgatgtgcactttgttggaataaagaaattgttcaacttgcccgtgaacataacgatgctaatatattaagccttccagcacggtttctttcactagctcaggccttggaaatggtaaaggttttcttgaacactaaatttgaaggaggtagacatgaacgacgtatcgaaaaaatagcatgttcttga

SEQ ID NO: 3480 - DNA, 432 bp, Flavobacteria bacterium BBFL7
atgaacatctctataggaaacgatcacgcaggaccagattataaacaagctattgttgatatgcttaaaaaaagaggtcatcaagtaactaatcatggaacagatactttagatagtgttgattatccagactttgctcacaaggtagggcaggatgttgatagccacacggtagatctaggtatagttatttgtggaagtgcacaaggtgtgtctatgaccgttaataagtatcaaaatgtacgtggagcagtttgctggtctaaagaaattgcaggacttgctcgagagcataataatgcaaatatcatctgtataccagcacgtttcacttctataccacaggctattgccatggtagagactttcttagatacagaatttgctggtggacgccatgcaaatcgtgtgaataagatagcttgttcataa

SEQ ID NO: 3481 - DNA, 432 bp, Flavobacteria bacterium MS024-2A
atgcaaataagtattggtaatgatcatgcgggaccggagtataaagagaaaataatagcttttttaaaatcagaaaattacgaaacaataaactatggaaccaacacaacagacagtgtagattatccagattttatccaccctgtagcgaaagatgtttcagaggggaagtctgactttggaattattatttgtggaagcggaaatggggccaatatgacggcaaataaatatcaaaaaattcgttctgccctttgttggaacaaagaaatagttgctctagcacgagaacacaatgatgctaatattttaagtttaccggcacgttttatttctattcctcaagcaattgaaatggttaaggtttttatatccacaaaatttgaaggcgggagacaccagaaaagaatagataaaataccctgtaaataa

SEQ ID NO: 3482 - DNA, 432 bp, Flavobacteria bacterium MS024-3C
atgactatagctataggaaatgaccacgcaggaacagattacaaatttgctattatagcatttcttaaagcgttgggacatgatgttttaaactttggtacagataaatcagactctgtagattacccagaccatattcatcctgtagcagaagcagtgtcttctaaaaaagtggctttaggtattattatttgtggtagtggaaacggcgcagctatgacggctaataaacaccaagatatcagggcggctttatgttggactaaagaaattgttttattagccaaacaacataatgatgctaatatattatcacttccagcaaggtatttatcattaccacaagccttagaaatggtagaagtttatttggacacgccttttgaagggggaagacacgccaatagagtagctaaaattgggtgtagttaa

SEQ ID NO: 3483 - DNA, 462 bp, Chitinophaga pinensis DSM 2588
atggcatcacaaccactatttaatcttacgctgccggtagctattggcgctgatcatgcgggatttgaatataaggaagagattatttcttacctggagggaaaagggctgaaggtaaaggacgcaggtgctcattcaaaagacccggctgattatcctgattttgcgcatccggtagctacgctggtagagcgggagcaggctgcgtttggtatactggtatgtggtagtggtaatggcgtggctattacggctaacaaacaccagggtatacgtgctgctatctgctggggagaagagttgtcgcgcctggcacgttctcacaataacgccaatgtactgtgcatccctgcgcggtttgtagatgatgccgttgccaagcagatcgtagatgtattcattgacacgccatttgaaggcggccgtcatgaaaacagggtcagaaagatcgcctgtttatag

SEQ ID NO: 3484 - DNA, 438 bp, Algoriphagus sp. PR1
atggcaaagaaaatagcaataggaggagatcatgcaggctttgaatacaaggctaaaatgatcagcaaactggagtcacaaggctatgaggtaaaggattttggtcccttctctgatgcttcagtggattatccggattatgtgcatcctttgagcacggcaattgaagctggtgagtatgaattggggattgtgatctgtggatctggaaatggcgtagccatcacagccaataagcatcagggaatccgcgcagcactttgctggaatgaggacttggcagccttatcaagacaacataataatgcgaatgtccttgcccttcctgctcgttttatttcttatgaattggctgaaaaattggctgagaccttcctgaccacggacttcgaagggggaagacatcaaaacagagtcaataaaattgcttgtagctaa

SEQ ID NO: 3485 - DNA, 438 bp, Cytophaga hutchinsonii
atggcgtatacaatcgcattaggtggtgaccatgccggttacacctataaaaaagaaatcattgcatacttagagactcagggtcataaaacgatcgactgcggaccattctctgaagcgtctgtagattatcctgatttctctcatccggtagcagaagctgttgaaaccggaaaagcaacgtttggaatcctgatctgcggaagtggtaacggcgtttgcatgacagcaaacaaacatcagcacatacgtgcaggcttatgctggactcctgaaatagcaatgcttacacgccagcataacaacgcaaacgtattgtgccttccggcacgctttattcccattgaagaagcaattgcctgtgtaaaaatgtttgtagaaacagcatttgaaggcggcagacacgaaggccgcgtcaataaaattgcctgcgcataa

SEQ ID NO: 3486 - DNA, 432 bp, Dyadobacter fermentans DSM 18053
atgagaaaaattgctatcggctccgatcacgcaggtttcccctacaagcaaccggttatcgactggcttaccacgaatggttttgaagtaaaggactttgggacatacagcgccgactcggccgactatgcggattttgcgcatcctgtggcgagcggagtggaaagcaaggagttcgaaaaaggggtgttgctctgcggaagcggccagggcgtgtgcattacggcgaacaagcatcagggcgtgcgcgctgcgctcgtgtgggatttgcctttggccccgttggcgcgccagcataacgatgcgaatgtgatctgcttccccgtgcgtttcatcgagctggaaacggcattggctagtctggaagcatttttaagcaccgagtttgaaggcggccgtcaccagacgcgcgtcgataagatttcctgctag

SEQ ID NO: 3487 - DNA, 429 bp, Microscilla marina
atgaaaatagccattggtggcgatcacgccggatttgcctataaagaagcagtagtggcacttttgaaagacaaaggtgtggcagtagaggattttggtccctttagcgaagagtcggtagactatcctgattttgtgcacccggtagccaaaaaagtagacgctaaagaagccgacctgggtatattgatttgtggtagtggcaatggggtagcaatgactgccaacaaataccaaagtgtaagagctgccttgtgttggcaaaccgagcttgctgctttggctcgtcagcataacaacgccaatgtgttgtgtattccagcacgttttgtagaccttgcccttgccaagaatatggtagaaacgtttttaaacgaaagttttgagggagggcgtcatgagcgtcgggtaaataaaataagctgctaa

SEQ ID NO: 3488 - DNA, 432 bp, Spirosoma linguale
atgaaaattgccataggctccgaccacgctggtttccgttataaagaagccatccgacaatatctcaccaacctcgggcacgaggttattgacaaaggcacgtatgccgaaacgccatctgtcgattaccctgtttatatccggcctgtggcagaagccgtagctgccggtgatgttgaccggggcattgtgctgggaggttcgggcaacggagaagccatcatggcgaaccgaattaaaggggttcgctgcggtctttgctggaatgaagaatcggcccgcctgtgtcgccagcataacgacgctaacgtcatgtcgatcggcgaacgcatgatgagcgaagaaaccgccctcaacttagtccagatttggctcgatacgccattcgaaggcggtcgtcacctcgcccggattcagcaacttgatcaataa

SEQ ID NO: 3489 - DNA, 450 bp, Pedobacter heparinus DSM 2366
atgaagataataataggttcagatcatgcaggttttacctataaaaatatactgctgactactttaacagccgcagggtatgaggtgctggatctggggacatatacatcggctgctacggattatccggaccatgcggcagctgtagccagggccattcttgaaaaaaaaggggaaaggggcatcctggtttgcggaagtgcggtaggggtgagtattgcggccaataagtttaaagggataagggccggtgtatgccatgatacgtattctgcacaccagtcggtagaacacgatgatgtcaatatcctgtgtatgggcgaacgggtgatcgggatagagctggcaaaggacatcagctttgcttttttaaaggcaagttttacccatgaggagcgccatataaaaagactggccaaaataactgctattgagaacgaggaattgtaa

SEQ ID NO: 3490 - DNA, 441 bp, Pedobacter heparinus DSM 2366
atgtcaaccgataaaaaaattaaaatcgcaataggtgcagatcacgccggctttgaatacaaggaactcctaaaatcttatttaagtgaccatgaagttaaagattttggcacccactcggccgattctgttgattatcctgattttgcacatcctgttgcggaagctgtagaaagtgaggcttatacctttggtgtactggtttgcggcagtgccaatggggttgccataactgccaataagcatcagcagatccgcgcagcaatctgttggcaaaaggagattgccgaacttgccagaatgcacaacaatgccaacattatctgtatcccggcaagatttgtatctgaagaactggcaaaagagatggtaagcacctttctaaacactgcttttgaaggtgggagacacgctggcagagtgaataaaatgtcgtgctaa

SEQ ID NO: 3491 - DNA, 540 bp, Pedobacter sp. BAL39
atgtttgtctttaagctgatgctctgccctggcattgcgcggattttggctaaattagggaacaatttatcaataaacataaataaaaaacttatgaaagtcattctagggtcagatcatgcaggatatcgatataaacagatgtttagtgaattgctgactaccgaagggtatgaagtgctcgatctgggcgcatttaatgaagaggccagcgactatccggaccatgctgaagatgttgcagtggcgctccaggaaggaaaaggcgatcgtggcatcctggtatgcggcagtgccgtaggggtaagcatagccgcaaataaatttaaaggcatcagggcaggtgtttgtcatgatacctattctgcgcatcaggcggtcgaacatgatgatgtaaacgtgctttgtctcggcgagcgtgtcgtaggacctgccctcgcaaaggaaattgtactttccttcctcaaagccagcttcacgaatgaaacacgtcatgtgaaacgactggccaagattaccgcaatcgaagatcaatggtaa

SEQ ID NO: 3492 - DNA, 441 bp, Pedobacter sp. BAL39
atgtcaaccgaaacaaaagttaaaattgcaattggtgccgaccacgccggctttgagtacaaagaactgatcaaagaatggttcgctgagcatgaaattaaagactttggaaccttttctgcggattcggtagactatcctgattttgcacatcccgtagctgaggctgtggaaagcaaggcatttacctttggcattctcgtatgcggcagcgccaacggcgtggcaatcacagcgaacaaacaccagcacatccgggctgccatctgctggctgaaggagattgctgagttggcgcgtctgcacaacgatgccaatatcatctgtatcccggcacgttttgtttccccggaactggctaaagagatgataaatacttttttaacaacggcttttgaaggcgggagacacgcaggacgtgtcggtaagatctcctgctaa

SEQ ID NO: 3493 - DNA, 441 bp, Sphingobacterium spiritivorum
atgagttcagtaaaaaccatcgctatcggaggcgatcacgcaggatttgattacaaaaaagaactgatcccctttctgcaggagctgggttatgaagtaaaagattttggaacatattctacagattctgtagattatccggattttgcacatcctgtagcttccgctgtggagagcaaggagtttgacaaaggtatacttatctgtggtagtgccaacggtgtagcgatcacagccaataagcatcaggatattcgtgcggcaatatgctggctcgaagaaattgcagcattagcccgtcagcacaatgatgcgaatattgtatgtattcctgcacgtttcattagtccggatctggcaaaagcaatcgtcaaaacatttatgactacagattttgaaggcggccgtcacgctaaccgcgtcaataagatctcttgttaa

SEQ ID NO: 3494 - DNA, 441 bp, Sphingobacterium spiritivorum
atgagttcagtaaaaaccatcgctatcggaggcgatcatgcaggatttgattacaaaaaagaactgatcccctttctgcaggagttgggttatgaagtaaaagattttggagcacattctacagattctgtagattatccggattttgcgcatcctgtagcctctgctgtggagagcaaggagtttgacaaaggtatacttatctgtggtagtgccaacggtgtcgcgatcacagccaataagcatcaggatattcgtgctgcaatatgctggctcgaagaaattgcagcattagcccgtcagcacaatgatgcaaatattgtatgtattcctgcccgtttcattagtctggatctggcaaaagcaatcgtcaaaacatttatgagtacagattttgaaggcggccgtcacgctaaccgcgtcaataaaatctcttgttaa

SEQ ID NO: 3495 - DNA, 435 bp, Chlorobaculum parvum NCIB 8327
atgaacattgcagttggaagcgaccacgcaggcgtggaaatgaagaaaagcgtcatcgcctggctcgaaaagaacggccacaccgctgaggatatggggccatataccgaagagtcggtcgattaccccgatttcgcccataaggtgtgcagcgcagttctggaaggcaaagccgatcaggggattctgatgtgtggcaccggtatcggcatgtccatcgcggccaacaaggtgaagggcattcgcgccgggctggcgtgcggccctgaattcgcggcacttgcccgtcagcacaacaacgccaacgtgctctgctttgcggcgcgcttcaacgatgtgcccactgccgagaagattctcgaaagctggtttgcttcggagttcgagggaggccgtcaccagcgccgtgtcgataaacttgaagccggtagctga

SEQ ID NO: 3496 - DNA, 435 bp, Chlorobium tepidum
atgaagattgcagttggaagcgatcatgcaggagtggagctgaagaagttcgtcctctcatggcttgaaaagcattgctatgatttcgaggatatgggtccctattccgccgaatcagtcgattatcccgattatggccacaaggttgctgaggcggtcgcccgcggggatttcgatcaaggaattctgatgtgcggcaccggcatcggcatctccattgccgccaataaggtgaagggcgtccgcgcggccaatgtttgtaatccggagtacgcggcgctggcgcgtcagcacaatgacgccaatgtgctcgccttcggggcacgtttcaacgacgactccagtgcagcgaagattctcgaaagctggttcgcatcagaattcgaggggggacgtcaccagcgacgcgtcgataaaatcgagttttgctgctga

SEQ ID NO: 3497 - DNA, 453 bp, Chlorobium chlorochromatii CaD3
atgactatgaaaattgcagttggtagcgatcatgcaggatttgaatttaaaaaaaccgtagtggcatggcttgaagcgcatggttatgaagttgaagatatgggtccacataacgaagaatcggtggattatcccgattatgctcaccatgttggacgcgctgtagccggtgggcattgcgattcaggtgttttactgtgtggaacaggcattggggtgtcggttgccgccaacaaaattaaaggcgtgcgtgccgcattagcctgcaatcccgaatttgcaacgcttgcccgccagcacaataatgccaatattctttgtatgccagcccgctttaccaatcgtgaaaccattgaacaatgtttgcacaattggtttgaagccagctttgagggaggcagacacgaacgccgagttaacaaaattgaaccatgttgcaaagtcaattcatag

SEQ ID NO: 3498 - DNA, 435 bp, Chlorobium ferrooxidans DSM 13031
atgaaaatagcagttgcaagtgatcatgccggttttgagtcaaagaaaaccgttgtcgcatggcttgaaaagcatggttatgcgtgcagtgatatgggcccgtataatgaagagtctgtcgactatccggattttgcccgtaaagttgcacaaggggttgcagccggtgagtttgatcagggtgttctgctctgtggaacaggaatcggcgtttccatagctgccaataaagtcaagggaattcgtgccgcccttgcctgtaaccctgaatttgcaacccttgcccggcagcataacaatgccaatattatctgtttttccgcccgcttctccgataaagcgaccattgaacaaagccttcagaactggttttccgccgaatttgaggggggacgccatgaacgcagagttgaaaaaattgagccatgctgctga

SEQ ID NO: 3499 - DNA, 435 bp, Chlorobium limicola
atgaagattgcagttggtagcgatcacgctggttttgaactcaaaaactatgtcgtccagtggcttcaggaaaacggccatgagcctgttgatatgggccctttcaatgaagagtcggttgattatcctgattacgccagaaaagtaggcgaaagcatcgtggacggcacctgtcaggagggagttctcttatgcggaaccggtatcggcgtttcgatttcggcgaacaaggtgaagggcatacgagccgctctggcctgcaggcctgaattcgcaacacttgcacggcagcataataatgcaaatattatctgtttctctgcccggtttaccgacagggaaaccattgcgaaaagtcttgaaaactggtttgccgctgattttgaaggcggaagacatgaaagaagggtcaataaaatcgaaccatgctgctga

SEQ ID NO: 3500 - DNA, 429 bp, Chlorobium phaeobacteroides
atgaaaatagctatcgggagcgaccacgccgggtacgcattaaagaaaattgtttattcctggcttgacaagcacggttatgaagtcgatgatatgggaccctggtcggaggagtcggttgattatcctgattttgcccgaaaggttgccgaagctgtctcaaggggagatgctgatcagggggttttgctctgcggatccggtatcggtgtttctatcgtggcaaacaaggtaaaaggcatcagggcagcacttgcgttcaacccggaaatcgcgagccttgccagacagcacaataacgccaatgttctctgttttcctgccagatacagcgatagcggcacgatagaacaaagccttgaaaactggtttaacgcggagtttgaaggcggaagacatgagcgtcgggtgttaaaaatcgaaccatag

SEQ ID NO: 3501 - DNA, 447 bp, Chlorobium phaeobacteroides
atgaaaatagctgtcgggagcgatcatgccgggtatgagatgaaaaaccatgtcatccagtggcttcaggaaaatcgttatgaagtggtcgatatggggccgttcaacgaagagtccgttgattatcctgatttcgcaagaaaagtaggcgagagcgtcgctgaaggcagttgccagcagggcgttctgttgtgcggcacaggaataggcgtttcgatctctgcaaacaaggttaaaggcatcagagctgctcttgcctgcaacccggaattcgccacgcttgcacgacagcataataatgcaaatattatctgtttctctgcacggtttaccgatcgtgaaaccatagcaaaaagccttcaaaactggtttgccgccgagttcgaagggggacggcatgaaaggagagtaaacaaaattgaaccatgctgctcaaagagtgtatag

SEQ ID NO: 3502 - DNA, 435 bp, Chlorobium phaeovibrioides
atgaaaattgccattggaagtgaccacgcaggtgttgagttcaagaaagagatagctgcatggcttgcagcccatggccatgaatgcaccgatatggggccatacacagaagagtctgtcgactatcctgactatgcgcataaagttgcacgggctgttgcggccggtgagtacgagcaggggatattgctctgcggtaccggtttgggtgtttcaatatcggccaacaaagttccgggtattcgtgccgcccttgcatgcagacctgaatttgcaacccttgcccgccagcacaataatgccaatgtgctttgtatgtcggcccgttttaccgacagtgctgccatagtaaccacgcttgaacattggtttgccgctgagtttgagggagggaggcatcagcgcagggtagaaaagatagaacaatggtcctga

SEQ ID NO: 3503 - DNA, 435 bp, Chlorobium luteolum DSM 273
atgaacattgcagtagcaagcgaccatgccggcgtcgaattcaagaaagatatcgtagcctggctcgagagccatggccatgcctgcacggacatggggccgtacacggaggattcggtcgattaccccgactatgcccataaagtagggcactctgtggcttccggagagagcgatcaggggatcctgctctgcggtaccggcatcggtgtttcgatctcggcaaacaagattcccggcatccgtgcggcactctgctgccgccctgagttcgcaacccttgcacgtcagcacaacgatgccaatattctctgcttctcggcacgtttcacagacctggccagcattcatgaaagcctcgacaactggttttccgctgattttgaaggcggacggcaccagcgcagggttgataagatagatccatgctcctga

SEQ ID NO: 3504 - DNA, 435 bp, Pelodictyon phaeoclathratiforme
atgaaaattgcagttggaagcgatcatgccggatttacattcaaaaaaactgttaccgattggcttgaacgccatgattatgaattcgacgacatggggccatataatgaggaatcagtcgattatcccgattatgcccgcaaagttgccgaggctgtagcagctcagcagtgcgattcggggatactgttgtgcggaactggtattggtgtttcaatttcagccaataaaatcaagggcatccgggcggctcttgcctgtaacccggaattcgcgacacttgcccgacagcataataatgccaatattatctgtttttccgcgcgttttaccgataaagctacgattgaacaaagtcttcacaactggtttaccaccgattttgaagggggaaggcatcagcgaagagtgaataaaatcgaaccatgctgttaa

SEQ ID NO: 3505 - DNA, 429 bp, Chloroherpeton thalassium ATCC 35110
atgaaattagcattaggaagcgatcacgctggcgttcaaaaaaaagcatttgtaaaagattggcttattcgcaacggacatgaagcagttgacctgggcccgtattcggaagagtcttgcgactacccagactacgcgagaaaagttgcccaagcggtggcttcaggcgaagtggcgcaaggcgtgctgctctgtggcagcggcgttggcgtgtcgattgttgccaacaaaacgaaaggcgttcgcgcagctttggcctatcaaccagaaattgccagccttgcgcgccagcacaacaacgccaacgttatttgttttcctgctcgctacatgaacgaatcagagatagagcagtgtttaaaaaactggtttgaggcagattttgaagggggccgccacgagcgcagagtaagcaaaattgaagactaa

SEQ ID NO: 3506 - DNA, 429 bp, Prosthecochloris aestuarii
atgagaattgccattgggagcgatcacgcggggtatgaactgaagaaaacggtaaaatcatggcttgaggatcatggtcacgaggtcaatgatatgggcccgtattccgacgagtctgttgattatcctgattatgcccgcaaggttgcccaggccgttgccgatggagagtaccagcagggagttcttttgtgtggttcaggtatcggcgtgtcggtttcagcaaacaagatcagaggaatcagggccgcccttgcttttaatccggagatcgcgtcgctggcacgacagcacaacaatgcaaacatcatctgttttccggcacgttttaccgatgccgataccattaaaaccagtcttggcaactggttttctgccgaattcgagggcggccgtcatgaacggcgtgtgcagaaaatcgagccttga

SEQ ID NO: 3507 - DNA, 438 bp, Opitutus terrae PB90-1
atgaaaactttcacgatcgccatcggctcggatcacgccggcttcgcctacaaggaagccctcagagcggctttgaccgcggacggacacaaggtccgcgacttcggcacgtattcggatgccgcgtgcgactatccggatttcatccggcccgtcgcggaggcggtggcgcgcggcgagttcgagcgcggcatcgtgctcggcggctcgggcaacggcgaggcgatcgtcgccaaccgcgttcgcggcgtgcgctgcgggctctgctggaacgagcaggtcgcgaaatggaaccgctcgcacaacgacgggaacgtcctctccatcggccagcgcacgatcagcgaggccgaggcgattcaaatcgcccgcgtctggttggcgaccgagttcgaaggcggccgtcacgccgcgcggatcgcgaagatcgaccggtag

SEQ ID NO: 3508 - DNA, 441 bp, Opitutaceae bacterium TAV2
atgaaaaccttcagcatcgccatcggttccgaccacgccggtttcgcctacaaggagaaaatcaaggaagcccttctatccgagggacacaccgtgcgtgatttcggcacctactcgcccgcctcgtgcgattatcccgattttatccgtccgaccgccgaagccgtggcgcgtggcgaatttgagcgcggcatcgtgcttggcggctctggcaacggcgaggccatcgtggccaaccgcataaaaggcatccgttgcggcctatgctggaacgagcaggtggcggtctggaaccgctcgcacaacgacggcaacgtcctctccctcggagagcgcacggtgactctcgaagaagcgctcaaaattgtgcgcgtgtggctcgccaccgaattcgaaggcggacgccacctgccgcgcattcagaagatcgacgctgcataa

SEQ ID NO: 3509 - DNA, 447 bp, Methylacidiphilum infernorum V4
atgaaaattgcgctcggatcggaccatgccggttttaattacaaggaaaaggttaaaaattttttaaaagaatcctgcctggaagttattgactgtggaacttttgccccggatcctcctgtagattaccccgattacgtaagacccgctgccttactcgttgctcaaggtcaagctgaccgagccatagttttcggcggttccggtaacggggaagcgatggtggcgaacaaagtcaaagggatccgctgtgcttattgctttaacgaagaatccgcaaggctgggcaggctgcataacgatgctaacgctatttctattggacaaaggctgattccagaagaaatggctttaaaaatcgtgaaaattttcctagaaactccttttgaaggaggtcgccatattcccaggattaaaaaaatgatggaatatgaaaatgctccatga

SEQ ID NO: 3510 - DNA, 447 bp, Verrucomicrobiae bacterium DG1235
atgagcaaactcaccgtcgcaatcggctccgaccacgcgggctacgtttacaaacaggccatcatcgcccacctccagggccaaggctacaccgtcaaagactacggcacagattccgccgagtcctgcgactacccagacttcatccgccccgtcgcccaagccgtcgccgccggcgaattcgaccgcggcatcgtgctcggaggctcaggcaatggcgaagctatcgtagccaaccgcatacccggcatccgctgcggactctgctggaacgagcaaatcgccgtctggaaccgctcgcacaacgacggaaacgtcctctccatcggagaaagaaccgtcacccaagaagacgcgctccagattgtggatacatggctaaataccgaattcgaaggcggacgccatcagcctcgcatcgacaagatcgacaatccttccctctaa

SEQ ID NO: 3511 - DNA, 456 bp, unknown
  bacterium Ellin514
atgaaaattgccatcggaagcgatcacgcagggtttcaatataaggaacaaatcaaagattttctgaagcagctcggccacgaggtgcgcgacttcgggaccaattcggatgcgtccgtggattacccactgtttattcgccccacggccctggctgtggcggatggagaatgtgaacgtggaattgttctcggtggctcgggcaacggcgaagccatcgtcgccaaccgggtcaaaggcgtgcgttgtgcattgtgttggaatgtcgaatccgcccgtctgggccggcagcacaataatgccaatatgatctccatcggccagcgtatgatgacgatcgaaaccgcttttcagattgtgcaaacctggctggacactccctttgagggtggccgacatcagcggaggattgaagaaatcgatcaggcgacacctgaaggatgcgcccgctcatag

SEQ ID NO: 3512 - DNA, 435 bp, Verrucomicrobium spinosum
atgaagatctccattggctctgaccacgccggattcgcctacaaagagaagatcaaagctttcctccagtccctcggccacgaggtgcaggacttcggcacctacagcgcggatcctgtggactatcccacgtatgtgcgaccggccgccgaggccgtggccaagggggaggcggatcgcggcattgtgctgggcggctccgggaacggggaggccatcgtggccaacaaggtgcgcggcgtgcgctgctccctctgctggagtcacgacacggcccgctgggcccgcgaacataatgacgccaacgtcctcgccatcggtgagcggaccatctccccggaactggcgcttgagatcgtgaagatctggctggaaaccgagttcaccgctggccgacatctggcccgggtgcaggcgattgaggggaaaggctag

SEQ ID NO: 3513 - DNA, 444 bp, Chloroflexus aggregans DSM 9485
atgcgaattgccgttggcagtgacgaaaagaactatctcaccgatgccttgatcgccgatctcgaacgacgtgggcacgagttgatcttatttggcccgctcaccggtaccaacgacccgtggcccgatgtgggacgggccgtgggtgaggcggtggcatccggtcaagccgatcagggcattgtttgttgttacaccggcaccggcgtcagcattgccgccaacaaagtgcccggtattcgggccgcgctgtgccacgattcgcagacggctgccggcgcccgaaagtggaacgacgctaacgtgttggcactgagcctacgcctaaccacacccgaactggcccgtgaaatcctcgatgcgtggtttgccaccgaatgcccaccggaagagcaggcgacgatcgaccggctgcgcgcatttgaccgggttgttggggcatag

SEQ ID NO: 3514 - DNA, 435 bp, Chloroflexus aurantiacus
atgcggattgctgtagggagtgatgaacggacttacatgaccgatgcgcttatcaccgaactcaaacagcgtggtcatgacgtgatcttgtttggaccacttgccggtacatcagacccatggcccgatgttggacgggcagttggcgaagctgtggccaccgggcaggccgatcagggtattgtgtgctgctacaccggtaccggtgtaagtatcgccgccaacaaagtgcccggtatccgtgcagccctctgtcacgatgcacaaacggcagcaggagcgcgaaaatggaacgatgcgaatgtgctggcactgagtctgcgtaccacaacgcctgaactggtgcgcgaaattctcgacgcctggttcgccaccgaatgcccaccagaggaacaggtcactattgaccggttgcgcgccttcgataagctataa

SEQ ID NO: 3515 - DNA, 450 bp, Herpetosiphon aurantiacus
atgattatgaaaattgcggtcggaaccgatcatggtggtttgattttgaagcaagcagtaattgaagaagtgcaacggctgggccatgaagtgctcgattttggcaccgattcgcctgcttcggtcgattatcccgattttgctgcggctgtgggtaatgctgtagtaagtggccaagctgaacgtggcattgcgatttgcggtagtggcgttggcgtgacggtcgccgccaataaaattaaaggggtgcgagcctgtttgtgccacgacacctattcggcgcatcaaggggttgagcacgacgatctgaatgtattgtgtttgggcgggcgggtgattggcccagccttggctggcgaaattgtccaagcatttttgagcgcaacgtttcacaatgaagctcgctttactcggcgcttggataaagtgattgccttagaaaaccaataa

SEQ ID NO: 3516 - DNA, 459 bp, Dehalococcoides ethenogenes 195
atgagtaatatctctgttgccatcggggcagaccacggcggttacggcctgaaaacagacctcttaccctttttaaatcaattggggataaaggtgctggatttgggggcatgtacctatgatagtgctgatgactatcctgattttgctttagcggtggcccgaaaggttgcctgcgggcagacagaccgcggcattatcatctgcggcagcggggtgggcgcctgtatcaccgccaataaaatcaaaggcgtcagggccggcctctgccacgatgtttactccgcccaccagggggtggagcatgatgatatgaacgtgctttgtttaggggccagggtaataggcattgaagtagccaaagagattattacggcctttttaaatgcccgctttaccggcgaagaacggcacaaacgccgcctggaaaagctgcttcaggctgaaaaagagggctaa

SEQ ID NO: 3517 - DNA, 459 bp, Dehalococcoides sp. BAV1
atgagtaatatctctattgccatcggggcagaccatggcggttacgaccttaagacagatattttacccttccttaaccatttggggttaaaagttttggatctgggggcttgcacctataacagttctgatgattatcctgattttgctcagacagttgcccgaaatgttgcctgcggaaaaacagaccgcggcattatcatctgcggtagcggagtgggcgcctgtatcactgccaacaaaataaagggtatcagagccggtctctgccatgacgtttactctgcccaccagggggtggaacatgatgacatgaacgtgctgtgtttaggagcaagagtgataggcatagaagtagccaaagagattatcagtgcctttttaaatgcccgtttcaccggtgaagaaagacacaaacgccgtcttgaaaaactgcttaaggttgaaaaagaaggctaa

SEQ ID NO: 3518 - DNA, 459 bp, Dehalococcoides sp. CBDB1
atgagtaatatctctattgccatcggggcagaccatggcggttacgaccttaagacaggtattttacccttcctgaaccatttggggttaaaagttttggatctgggggcttgcacctataacagtgctgatgattatcctgattttgctcagacagttgcccgaaatgttgcctgcggaaaaacagaccgcggcattatcatctgcggtagcggagtgggcgcctgtatcactgccaacaaaataaagggtatcagagccggtctctgccatgacgtttactctgcccaccaaggtgtggaacatgatgacatgaacgtgctgtgtttaggagcaagagtgataggcatagaagtagccaaagagattatcagtgcctttttaaatgcccgtttcaccggtgaagaaagacacaaacgccgtcttgaaaaactgcttaaggttgaaaaagaaggctaa

SEQ ID NO: 3519 - DNA, 465 bp, Dehalococcoides sp. VS
atgaagatgagtaatatctctgttgccatcggggcagaccacggcggttacggcctgaaaatagaccttttaccctttttaaatcaattgggggcggatgtacttgatttgggagcatgtgcttataacagtaccgatgactatcctgattttgctttagcggttgcccggaaggttgcctgcgggcagacagaccgcggtattatcatctgcggcagcggagtaggcgcctgcatcaccgccaataaaatcaaaggcgtgcgtgccggtctctgccacgacgtttattctgcccaccagggggtagagcatgatgatatgaacgtactttgtttaggggcaagggtaataggcattgaagtagccaaagagattattactgcctttttaaatgcccgttttaccggcgaagaacggcacaaacgccgcatggaaaaactgcttcaggctgaaaaagagagctaa

SEQ ID NO: 3520 - DNA, 465 bp, Gloeobacter violaceus
atgaagcttgtgatcggcagtgaccacggcgcctacgaactcaaagaagaattgaaaacctggcttggcgagcacgagtacgctttcgaagacgtgggcacctacaacggcgagcgctgcgactacccgctggtagctcagagcgtcgccgaaaagatccagcgcggcgaagcggatcggggcatcttgctgtgcggcaccggcatcggcatctcgatcgccgccaacaaattcgacggcatccgcgccgccctcgcccacgatcactacaccgcccgcatgagccgcgaacacaacgacgccaatgtgctggccatgggcgggcgggtgctcgggccggaggtggccaaggacgtgctcgaaacctggctgagcaccgaatttggcggcgagcgccaccagcgccgcctcgatcaaatccagagtttcgaagcgcccaagaccccgcaaaccgtcggcagctaa

SEQ ID NO: 3521 - DNA, 465 bp, Nostoc punctiforme PCC 73102
atgaaaatcgctattggcagtgatgaacgcaccaaccttactgataggatactggaagaacttaagcagcgtgggcatgaagttatagtcttcggttccttagctgagaatgatttagaagttgattggcccctcagttgtagtaaagttgctttggcagtagcaacccaaaaagcagatgaggggattgtcttttgttggactggtactggtgcatctattgccgccaacaaagtcttagggatacgtgcagcattatgccatgatgctgaaactgcacgtggggcacgtatttggaatcatgcgaatgtcctagtattaagtttacgtgccactacagaagcgatcgcaaaagaaatattagatgcctggtttagcacacccttttctgaagatgagtggaacatcttgcaaatggagcggattagacagttagagaaaagtgctttatttcagcaatcttag

SEQ ID NO: 3522 - DNA, 486 bp, Acaryochloris marina MBIC11017
atgaacattgcaataggggctgattgctatggctttgacctcaaggaagccattaaagtttatttactctcccaaaaacatgagcttcaagatgttggtatctctgctggtgacagtaaaacaccttattatgaaactgcatcattggtcgccaatctcgttggaacccagcaagtggaacgcggagttctgatttgtggtacgggcatggggatggcaatagtagccaataagtttccaggcgtttatgcggcagtatgtgagaatacccacgctgccaagaagtctcgctccattaataactctaatgtgcttacgttaggagggatgttcacgacccctatacttgcacaggatattcttgaaacttggctgatgacagggttcactcaagactgggaacctgacattcaaacttggttagagcactccatgaaggatattgctgagttggagatagctcagttcaaggcacagttaaagtga

SEQ ID NO: 3523 - DNA, 453 bp, Denitrovibrio acetiphilus DSM 12809
gtgaaaaaagtagcgcttgcagctgatcacggtggcgtccagctcaaagatgaaataatcgaatatcttaaatcaaaacaatttgacattctggatcttggtactaattcaggcgaatctgttgattatcctgaatacggcgcgaaggcggctgttgctgttaccaatggcgaagctgactgtgccattataatgtgcggctcagggatagggatatccatagctgccaacaagttcaaaggggtgcgctgtgctctctgcttcgatgcgtatacagctaagatgtgcagacaacataatgacgcaaatataatggctcttggtggtagaattacaaccatagaccgtgcgaaggatatggtagacctttttcttgaaacagaatttgaaggcggaagacaccagaggcgcatagataagctcgacgctcttgcagcggaaagctggaagtaa

SEQ ID NO: 3524 - DNA, 447 bp, Dictyoglomus thermophilum
atgaaaattgcaataggagctgatcatgcggggtatatgttaaaagaagaattgaaacattggcttgatgaatggaatattccctatcatgattttgggacttattctcctgaaagagtagattaccctgattatggaatccttgtggcaagggcagttgcgaaaggtggttttgaaaaaggaattttaatatgtggtacagggataggtatgagtattgtagcaaataaagtaaaagggataagagctgcgctatgtagagatccatatgaggcaaaattaagtagagaacacaatgatgctaacatattagctttaggtggtagaattttaggctttgatcttgcaaaggagatagttagggtatggttaaacactgagtttagtgggggtagacataaggtaagaatagataaaatctcgaggattgaggaggatgagctgtga

SEQ ID NO: 3525 - DNA, 447 bp, Dictyoglomus turgidum DSM 6724
atgaagattgctataggagcagatcatgcaggctatatgttaaaagaggagttaaaacgttggcttgaggagtggaatatatcttaccatgattttggaacttattctcctgaaagggtagattatccagattatggaatcattgttgcgagagcagtagcaaaaggtggttttgaaaaggggattttgatttgtgggacaggaataggtatgagtattgtggcaaacaaagtgaaaggaataagagctgcattatgtagagatccttatgaggcaaaattaagtagagagcataatgatgccaatatactaactttaggaggtagaattcttggttttgacttggcaaaggagatagtaagagtatggttaaatactgagtttactggaggcagacataaggtaaggatagataaaatctcaatgattgaggaggatgagctgtga

SEQ ID NO: 3526 - DNA, 453 bp, Elusimicrobium minutum Pei191
atgaaaatagctttagcttccgaccatgcgggtttttctttaagagaaaccgttataaacaaaataaaagatttagggcatgaagtcattgatttcggcacttttgaatgctccagcgttgatttttcggactttgctgttaaaggggcgcaggccgttgtttcaaaacaggcggaaaaaggcgtttttatctgcggcagcggtgtcggcatgtgtatatccgcaaataaagttaaagggacaagggcttctgtagcgcatgacacatacagcgcggcgcagggtgtggaacatgaggatatgaatattctgtgcctgggcgcgcgcgttataggccccagcatagctgaggaaatagtagaaaaatttttaaatgctaaatttcagggacttgagcgccaggtaagacgtttaaacaaaataatagacatagaaaataacaattttaagtag

SEQ ID NO: 3527 - DNA, 450 bp, unknown
  uncultured termite group 1 bacterium phylotype Rs-D17
atgaagttggcttttggtacggatcatgctgccgctgaagtgagaaataaagtaaaagagtattttcaaagtgctggttatgaaatcgaagatttcggtttctgcggagatggaagttgtgattatccggattatgctgttaaagttgcggaagctgttataagcaaaaaagcggatagaggcattcttatatgcggaactggaataggtatgtctattgcggcaaataagatgaaaggtattatcgcggcagtttgctggaatgaagacactgcaaaacttgcggtgcgacataacggcgcaaatgttttatgtctgggttcaagaactgctaccttaagcgaattgtgccaaagaataaaaatatttcttggaactccgtttgaagaaaggcatttgcagagaataagaaaaattgaagaaattgaaaaacaacagtgtcagaaataa

SEQ ID NO: 3528 - DNA, 546 bp, unknown
  uncultured bacterium CBNPD1 BAC clone 2089
gtgtgcgggggtcgagtgtcatgcccgaaggttatgcgctgtgacggccctggctcctatgctcggggcgtgtcagcagcatcgccacgtcggagttttcgcatcgcaatcggtgccgaccatgcgggtttcgaactgaagcagcacctcgttgcgttcctcggcgctgcgggccacaaggtcgacgacttcggcacgcactccaccgaaagcgtcgactatccgcccatctgcgcagccgttggtcgggccgtccgcgatggcaaagcagacctgggcatcgttctcggcgggagcggacagggcgaacaactcgcggccaacaaggtgcgcggagtgcgtgcagcgctctgcaactgcctctatacggcgaagatggcgcgctcgcacaacaacgccaacgtgctgtcgatgggggcccgggtcgtcggcgtggggctcgccgaggaaatcgtgaccacgttccttgccaccgaattcgaaggtggccgccacgagcgtcgtgtcacccagttggccgaaatagaagaagaagagtcgaagtag

SEQ ID NO: 3529 - DNA, 471 bp, Acidobacterium capsulatum
atgaagcttgcgatcggtgcagaccacgctggctttcctctcaaggaagaagtgcgcgaatttgtgaagcgcctgggtcatgaagtcgatgacctgggcgcttacagcgccgaaccttctgactatcctgatttcgctgagaaagtgggcctcgcgctgatcgagggccgcgccgagcgcggcatcctgatctgcggcagcggcgttggcgtgaacgtggcggccaacaagctgcccggcgtgcgcgcctgcatgtgccatgacacctactccgcgcatcagggcgtcgagcacgacaacatgaacgtgctggtgctgggagcccgcatcattggtcccgcgctggcgtttgatctggtcaccagcttcctcaatgcggcctttcagagccaggtggagcgctacacccgccgcctgaacaaggtctatgccattgaggcgcgctacatgcccggttcaaagaaagcttag

SEQ ID NO: 3530 - DNA, 453 bp, Candidatus Solibacter usitatus Ellin6076
atgaaactcgccttagcctcagatcatgccggcgtggcgctgaaggcgcgcgtcatcgaggaactccgcaaggacggacacgagaccgcggacctgggaacgtgcaccacagaccccgtggactaccccgactacgccatggccgtgggcctggctgttctcaccgggcaggcggaacgggccattctgatttgcggcagcggcgcgggcgcctgcgtggcagccaataagttgaagggcatccgcgccgcgacctgccacgacagtttctccgcgcggcagtgcgtggaggatgacaacgtcaacgtgttctgcctgggcgcccgggtgatcgggaccgagctcgcggtggagctggtgcgaatctacctcaaggcgcaattttccggcctggagaggcacaagcgaagactggccaaaatcgcggcgctcgaagccgagttcgggaagtga

SEQ ID NO: 3531 - DNA, 438 bp, Candidatus Solibacter usitatus Ellin6076
atgaaaatcgccattggcgcggatcacgccgggttttctctcaaggaaaaactgcggcagaaactggctcaggacggtcacgaagtcgttgacttcggcaccgcatcggacgcgtcatgcgattatccggatttcgcccaacccgttgcccgcgatgtcgcgcaaggccgcagcgaccgcggaattctcgtctgctccacgggaatcggcatggccatggccgccaacaaaatcgatggcgtccgcgccgctcccgcgcagagcgatgacgaagtcaaattcacgcgcgaacacaacgacgcgaacgtgctcaccctcggcgccaagtacctagatgaagatcgcgccatcgagctcatccacatctttctgaatacggaattcgccggcggacgccatgcccgccgcgtcgccaagatcgcccagttggaaaaataa

SEQ ID NO: 3532 - DNA, 450 bp, Candidatus Koribacter versatilis Ellin345
atgaaagtcgcagtctcagccgatcatgccggcgtcccgatgaacgaggtcgtcattgccgagttgcggaaactcgggcacgaggtgctcgatcttggcacccacgacccgaactccggcgacgactaccccgaccgcgctgccgacattacagcagcagtgttgaatcaaggctgcgaaagaggcatcctgatttgtggcagtggtgtgggcgcttcggtggctgcgaacaaaattaaggggatccgggccggactctgccacgaccactactccgcccatcagggcgtggaacacgacaacatgaacgtactttgcctgggcggacgcgtgattgggacggaaacagcgctcgatctcgtccgcgctttcgtgtcggcaaagttcaccaacgaagagcgccacttgcggcgcctccacaagatcgcagtcatggaaggatcgaggtaa

SEQ ID NO: 3533 - DNA, 459 bp, Candidatus Koribacter versatilis Ellin345
atgaagatcgccctcggtgcggaccatgcgggatttgaactgaaaaatcaggtcaagcagcacctcacccagcagggaattgacgtccaggatttcggcaccaacacgccggattcggtggattatccagacttcgctcagcgggtggcggatacggtggctgtgggcggggtggagcgcggggttctcgtctgcggcaccgggattgggatggcgatgtctgcgaacaaggtccccggaattcgcgccgcgaattgccacaccatcctcgaagccgaactgagccgccagcacaatgacgcgaacatcctgacgctgggcgcgcgagtgctcgagcccgaggcggcgtttgcgatcgtggatgcctggatgaaggctcagtttgaaggtgggcgccatcagcgccgggtcgacaagatccaccagatcgagcagcaggaagttaagcgaagtacataa

SEQ ID NO: 3534 - DNA, 522 bp, Anoxybacillus flavithermus WK1
atgatgaaaagaccgtctcgacccgttaaaatgaagagagacggttttttctttataatgataaggaggggttcaaacgtgaaagtagcaatcgcatcagaccatggtggtattcgtattcgcgaagaaattaaaaaactcatggatgaaatgggaattgaatatacagactttggatgtgaatgtgaaacgtcggtcgattatccagattacgcattgccggtcgcacaaaaagtagcgaacggtgaatttgaccgcggcattttaatttgcgggacagggatcggtatgagcattgccgcgaataaagtgaaaggcattcgttgtgcgctcgttcatgacgtatttagtgcaaaagcgacgcgtgaacataatgacagcaatatattagcgatgggcgaacgcgtcatcggacctgggttggcgcgcgaaattgccaaagtatggctaacaaccccatttgaaggggggcgtcacgaaaaacgcattcaaaaaatttccgcttatgaaaacgagcaataa

SEQ ID NO: 3535 - DNA, 444 bp, Bacillus anthracis
atgaaagtagtaatagcatctgatcacggcggtatgaatatccgtaaagaacttgtaagtttattagaagagttaaatattgaatatattgatttaggttgtgaatgtgaagctggttctgttgattaccctgattttgcgtttccagcagcggaaatggtagcaaatggcgaagtagaccgtggtattttagtttgtgggacaggcatcggtatgtcaattgctgcaaacaaagtaaatggtattcgttgtgcgttagttcatgatactttcagtgcgagagcaacaagagagcataatgatacaaacatgttagcaatgggcgagcgtgtaattggtgctggtctagcacgtgacatcgcaaaaatttggttaacaactgaatttgaaggtggccgtcacgaaaaccgcgtaggaaaaattaaaacatacgaagcaaagtaa

SEQ ID NO: 3536 - DNA, 444 bp, Bacillus cereus
atgaaagtagtaatagcatctgatcacggcggtatgaatatccgcaaagaacttgtaagtttattagaagagttaaatattgaatatattgatttaggttgtgaatgtgaagctggttctgttgattaccctgactttgcgtttccagcagctgaaatggtagcgaatggtgaagtagatcgtggtattttagtttgtgggacaggcattggtatgtcaatcgcagcaaacaaagtaaatggtatccgttgtgcgttagttcatgatactttcagcgcgaaagcaacgagagagcataatgacactaacatgctagcgatgggtgagcgtgtaattggtgctggtctagcgcgtgatatcgcgaaaatctggttaacaactgactatgaaggtggtcgtcacgaaaaccgcgtaggaaaaattaaaacatacgaaacaaagtaa

SEQ ID NO: 3537 - DNA, 444 bp, Bacillus cereus
atgaaagtagtaatagcatctgatcacggcggtatgaatatccgtaaagaacttgtaagtttattagaagaattaaatattgaatatattgatttaggttgtgaatgtgaagctggttctgctgattaccctgattttgcgtttccagcagcagaaatggtcgcaaatggggaagtagatcgtggtattttagtttgcgggacaggcattggtatgtcaatcgcggcaaacaaagtaaacggtattcgttgtgcgttagttcatgatactttcagtgcgaaagcgacgagagagcataatgacactaacatgctagcgatgggcgagcgtgtaattggggctggtctagcgcgtgatatcgcaaaaatttggttaacaactgactatgaaggtggccgtcacgaaaaccgcgtagggaaaattaaaacgtacgaaacaaagtaa

SEQ ID NO: 3538 - DNA, 444 bp, Bacillus cereus
atgaaagtagtagtagcatctgatcacggcggtatgaatatccgtaaagaacttgtaagtttattagaagagttaaatattgaatatattgatttaggttgtgaatgtgaagctggttctgttgattaccctgattttgcgtttccagcagcggaaatggtagcaaatggcgaagtagatcgtggtattttagtttgtgggacaggcatcggtatgtcaattgctgcaaacaaagtaaatggtattcgttgtgcgttagttcatgatactttcagtgcgagagcaacgagagagcataacgatacaaacatgttagcaatgggcgagcgtgtaattggggctggtctagcacgtgacatcgcaaaaatttggttaacaactgaatttgaaggcggccgtcacgaaaaccgcgtaggaaaaattaaaacatacgaagcaaagtaa

SEQ ID NO: 3539 - DNA, 444 bp, Bacillus cereus
atgaaagtagtaatagcatctgatcacggcggtatgaatatccgcaaagaacttgtaaatttattagaagagttaaatattgaatatattgatttaggttgtgaatgtgaagctggttctgttgattaccctgactttgcgtttccagcagctgaaatggtagcgaatggtgaagtagatcgtggtatcttagtttgtgggacaggcattggtatgtcaatcgcagcaaacaaagtaaatggtatccgttgtgcgttagttcatgatactttcagcgcgaaagcgacgagagagcataatgacactaacatgctagcaatgggcgagcgtgtaattggtgctggtctagcgcgtgatatcgcgaaaatctggttaacaactgattatgaaggtggtcgtcacgaaaaccgcgtaggaaaaattaaaacatacgaaacaaagtaa

SEQ ID NO: 3540 - DNA, 444 bp, Bacillus cereus
atgaaagtagtaatagcatctgatcatggcggtatgaatatccgcaaagaacttgtaagtttattagaagagttaaatattcaatatattgatttaggttgtgaatgtgaagctggttctgttgattaccctgactttgcgtttccagcagctgaaatggtagcgaatggtgaagtagatcgtggtattttagtttgtgggacaggcattggtatgtcaatcgcagcaaacaaagtaaatggtatccgttgtgcgttagttcatgatactttcagcgcgaaagcgacgagagagcataatgacactaacatgctagcaatgggcgagcgtgtaattggtgctggtctagcgcgtgatatcgcgaaaatctggttaacaactgattatgaaggtggtcgtcacgaaaaccgcgtaggaaaaattaaaacatacgaaacaaagtaa

SEQ ID NO: 3541 - DNA, 444 bp, Bacillus cereus
atgaaagtagtagtagcatctgatcacggcggtatgaatatccgtaaagaacttgtaagtttattagaagagttaaatattgaatatattgatttaggttgtgaatgtaaagctggttctgttgattaccctgattttgcgtttccagcagcggaaatggtagcgaatggcgaggtagatcgtggtattttagtttgtgggacaggcatcggtatgtcaattgcagcaaacaaagtaaatggtattcgttgtgcattagttcatgatactttcagtgcgaaagcaacgagagagcataatgatacgaacatgttagcaatgggcgagcgtgtaattggtgcaggtctagcacgtgacatcgcaaaaatttggttaacaactgactatgaaggtggtcgtcacgaaaaccgcgtagggaaaattaaaacatacgaaacaaagtaa

SEQ ID NO: 3542 - DNA, 444 bp, Bacillus cereus
atgaaagtagtagtagcatctgatcacggcggtatgaatatccgtaaagaacttgtaagtttattagaagaattaaatattgaatatattgatttaggttgtgaatgtgaagctggttctgttgattaccctgattttgcatttcctgcagcagaaatggtagcgaatggtgaagtagatcgtggtattttagtttgtgggacaggcattggtatgtcaattgcagcaaacaaagtaaacggtatccgttgtgcgttagttcatgatactttcagtgcgaaagcaacgagagagcataatgatacaaacatgttagcaatgggcgagcgtgtaattggtgctggtttagcacgtgacatcgcaaaaatttggttaacaactgaatttgaaggtggtcgtcacgaaaaccgcgtaggaaaaattaaaacatacgaaacaaagtaa

SEQ ID NO: 3543 - DNA, 444 bp, Bacillus cereus
atgaaagtagtagtagcatctgatcacggtggaatgaatattcgtaaagaaatcgtaagtttattagaagaactaaatattgaatatattgatttaggatgtgaatgtgaagcgggttctgttgattaccctgattttgcattcccagctgcagaaatggttgcaaacggtgaagtagaccgtggtattttaatttgtgggacaggtattgggatgtcaattgctgcaaataaagtacacggaattcgttgtgcgctagttcacgatacatttagtgcaaaagcaacaagagaacataatgatacaaacatgttagcaatgggtgagcgtgtaattggtgctggtttagcgcgtgatattgcaaagatttggttaacaactgactatgaaggtggacgtcacgaaaaccgcgtaggaaaaattaaaacatacgaagcgaagtaa

SEQ ID NO: 3544 - DNA, 444 bp, Bacillus cereus
atgaaagtagtaatagcatctgatcacggcggtatgaatatccgtaaagaacttgtaagtttattagaagaattaaatattgaatatattgatttaggttgtgaatgtgaagctggttcagttgattaccctgattttgcatttccagcagcggaaatggtagcaaatggtgaagtggatcgtggtattttagtttgtgggacaggcatcggtatgtcaatcgcggcaaacaaagtaaacggtattcgttgtgcgttagttcatgatactttcagtgcgaaagcaacgagagagcataatgacactaacatgctagcaatgggcgagcgtgtaattggtgctggtctagcgcgtgatatcgcaaaaatttggttaaaaactgactatgaaggtggccgtcacgaaaaccgcgtaggaaaaattaaaacatacgaaacaaagtaa

SEQ ID NO: 3545 - DNA, 444 bp, Bacillus cytotoxicus NVH 391-98
atgaaagtagtagtagcatctgatcacggcggtatcaatatccgcaaagaaattgtaaatctattagaagagctaaacattgagtatattgatttaggatgtgagtgtgaggcaggatctgttgattaccctgattttgcatttccagcagcagaaatggttgcaaaaggtgaagtagatcgtggtattttaatttgtggtacaggcattggtatgtcaattgcggcaaataaagttcacggcattcgttgcgcattagttcatgatacatttagtgcaagagcaactagagaacacaatgatagcaacatgttagcgatgggtgagcgtgttattggcgctggcttagcacgtgatatcgcaaaaatttggttaacaactgattatgagggtggccgtcacgaaaatcgtgtaggaaaaattaaaacatacgaagaaaaataa

SEQ ID NO: 3546 - DNA, 444 bp, Bacillus mycoides
atgaaagtagtagtagcatctgatcacggcggtatgaatatccgtaaagaacttgtaagtttattagaagagctaaatattgaatatattgatttaggttgtgaatgtgaagctggttctgttgattaccctgattttgcgtttccagcagcagaaatggtcgcgaatggtgaagtggatcgtggtattttagtttgcgggacaggcattggtatgtcaatcgcagcaaacaaagtaaatggtattcgttgtgcattagttcatgatactttcagtgcgaaagcgacgagagagcataatgacactaacatgttagcgatgggcgagcgtgtaattggagctggtctagcgcgtgatatcgcgaaaatttggctaacaactgactatgaaggtggccgtcacgaaaaccgcgtaggaaaaattaaaacgtacgaaacaaagtaa

SEQ ID NO: 3547 - DNA, 444 bp, Bacillus thuringiensis
atgaaagtagtaatagcatctgatcacggcggtatgaatatccgcaaagaacttgtaagtttattagaagagttaaatattgaatatattgatttaggttgcgaatgtgaagctggttctgttgattaccctgactttgcgtttccagcagctgaaatggtagcgaatggtcaagtagatcgtggtattttagtttgtgggacaggcattggtatgtcaatcgcagcaaacaaagtgaatggtatccgttgtgcgttagttcatgatactttcagcgcgaaagcaacgagagagcataatgacactaacatgctagcaatgggcgagcgtgtaattggtgctggtctagcgcgtgatattgcgaaaatctggttaacaactgactatgaaggtggtcgtcacgaaaaccgcgtaggaaaaattaaaacatacgaaacaaagtaa

SEQ ID NO: 3548 - DNA, 444 bp, Bacillus thuringiensis
atgaaagtagtaatagcatctgatcacggcggtatgaatatccgtaaagaacttgtaagtttattagaagagttaaatgttgaatatattgatttaggttgtgaatgtgaagctggttctgttgattaccctgattttgcgtttccagcagcggaaatggtagcaaatggcgaagtagaccgtggtattttagtttgtgggacaggcatcggtatgtcaattgctgcaaacaaagtaaatggtattcgttgtgcgttagttcatgatactttcagtgcgagagcaacaagagagcataatgatacaaacatgttagcaatgggcgagcgtgtaattggtgctggtctagcacgtgacatcgcaaaaatttggttaacaactgaatttgaaggtggccgtcacgaaaaccgcgtaggaaaaattaaaacatacgaagcaaagtaa

SEQ ID NO: 3549 - DNA, 444 bp, Bacillus thuringiensis
atgaaagtagtaatagcatctgatcacggcggtatgaatatccgcaaagaacttgtaagtttattagaagagttaaatattgaatatgttgatttaggttgtgaatgtgaagctggttctgttgattaccctgactttgcgtttccagcagctgaaatggtagcgaatggtgaagtagatcgtggtattttagtttgtgggacaggcattggtatgtcaatcgcagcaaacaaagtaaatggtatccgttgtgcgttagttcatgatactttcagcgcgaaagcaacgagagagcataatgacactaacatgctagcgatgggcgagcgtgtaattggtgctggtctagcgcgtgatatcgcgaaaatctggttaacaactgactatgaaggtggtcgtcacgaaaaccgcgtaggaaaaattaaaacatacgaaacaaagtaa

SEQ ID NO: 3550 - DNA, 444 bp, Bacillus weihenstephanensis KBAB4
atgaaagtagtagtagcatctgatcacggcggtatgaatatccgtaaagaacttgtaagtttattagaagagttaaatattgaatatattgatttaggttgtgaatgtgaagctggttctgttgattaccctgattttgcgtttccagcagcagaaatggtcgcgaatggtgaagtggatcgtggtattttagtttgcgggacaggcattggtatgtcaatcgcagcaaacaaagtaaatggtattcgttgtgcattagttcatgatactttcagtgcgaaagcgacgagagagcataatgacactaacatgttagcgatgggcgagcgtgtaattggagctggtctagcgcgtgatatcgcgaaaatttggctaataactgactatgaaggtggccgtcacgaaaaccgagtaggaaaaattaaaacgtacgaaacaaagtaa

SEQ ID NO: 3551 - DNA, 462 bp, Bacillus clausii KSM-K16
gtgaaaattgcgattggttctgaccataatgcgtttgaactgaaagaagaattaaagacgtacatgatagatgagggctatgatgtcgttgattacggttgccactcttgtgaagcagtcgactacccagatgtttccttccgcgtcggcaacgacatcatgaaaggcgagattgaccgtggcatcttaatttgcgggacaggaattggcgtcgcgattgcagcaggcaaagtgccaggcatccgtgccgccctttgccacgatacttattcagctgaacgggcgcaattgagcaacaatgcccaaatcttgacgatgggcgcgaaagtcattggcccagaagcagctaaaaaagtgttaaacgcttatttaggcgcttcatttgcaggcggtccctcggcgaggaaaatccaacaaatcgctgagcaagagcaggcataccttgagcaggaaagcaggtaa

SEQ ID NO: 3552 - DNA, 450 bp, Bacillus clausii KSM-K16
atgaaaattgcgattgcttcagaccacggtggaacaaggcttcgtgcagagattacagcgatgttagaggaaatggggctttcctataaagattttggctgtgattgtgaaggttctgtcgattacccggattatgcccttcctgtcgcagaaaaagtggcgcaaggagagtttgaccgcggcattttaatttgtgggacgggcatcggcatgtcaattgctgccaataaagtaaaaggcatacgttgtgcccttgttcatgatacgtttagcgcaaaagcgacaagacagcataacgatacaaatatgattgcattaggggagcgtgtcatcggccctggacttgctgttgaaattgttcaaacatggctcggggaagcgtttgaaggcggacgccaccagacgagaatcggcaaaattgctgcttatgaagagaaggcaggcttatga

SEQ ID NO: 3553 - DNA, 441 bp, Bacillus coagulans
atgaaagtggcattggcttcagaccacggcggtaagcatcttaaacaggaaattgcgggtttgcttcaggatctgggtgttgcctacgaagatttcggatgcgattgtgaaggatcggttgattatccggattacgcgcttccggttgcggaaaaggtggcaaaaggggaatttgaccgtgcgatccttatttgcggcaccggaatcgggatgtgtatttccgccaataaagtaaagggtatccgttgcgcgcttgtgcatgatgtcttcagcgcgaaggctacaagggcccataatgacagcaatgtcctcgccatgggagagcgggtcatcgggccggggctggcctgtgaaattgtaaaagaatggctcggaacgccgtttgaaggcggccgccatgcgcgcaggattgagaaaatcgcgcagtatgaacaaaaataa

SEQ ID NO: 3554 - DNA, 441 bp, Bacillus coahuilensis m4-4
ttgaaagttgcattagcgtctgatcatggtggggtgaacctactgaaggaaatgaagaatttattagaagaattgaacatagaatacgaagatttcggttgtaactgtgaggggtctgtggattatccggattatgctgttccggtggcagagaaggtggcaaacggtgagtttgataaggggatcttaatttgtggaactggaattggaatgagcattgctgcgaataaagtcaaaggcattcgttgtgcgcttgtacatgatgtgtttacggcgaaagtaacgcgtcagcataatgatacaaatgttttagcgatgggtgagcgtgtgattggtcctggtcttgctcgtgaaattgcaatggcttggttacaaggggagtttgaaggtggccgtcatgctcgtcgtgtggagaagatttcagaatacgaaaacaaataa

SEQ ID NO: 3555 - DNA, 438 bp, Bacillus halodurans C-125
atgaaagtagcgattggctccgatcatgggggcgtcaacattaaaaacgaaatcattcaattgatggaagagctcggcatgcaatatgaggatttcggttgtgattgcacaacttctgttgattattcggattatgcgatccctgttgcagagaaagtggcagccggtgaattcgaccgggggatcttaatttgtggcacagggattggtatgtccattgctgccaacaaagtaaaaggcattcgctgcgccctatgtcatgatgtgttcagtgcaaaggcgactcgcgaacataatgacagcaacgtgcttgcgatgggggagcgagtcattgggcctggacttgctcgtgaaattgcacaaacgtggctaacgacggaatttgaaggtggccggcatgctcggcgcatcggaaaaattgcagagtacgaaggctaa

SEQ ID NO: 3556 - DNA, 444 bp, Bacillus pseudomycoides DSM 12442
atgaaagtagtagtagcatctgatcacggtggaatgaatatccgtaaagaaatcgtaagtttattagaagaattgaatattgaatatgttgatttaggatgtgaatgtgaagcaggttctgttgattatcctgattttgcatttccagcggcagaaatggttgcaaatggtgaagtagaccgtggtattttaatttgtggaacaggtattggtatgtcaattgcagcaaataaagtacacggtattcgctgtgcgttagtacatgatacatttagtgcaagagcaacaagagaacataatgatacgaatatgttagcgatgggtgagcgtgtaattggtgcgggtttagcgcgtgatatcgcaaaaatttggctaacaactgattatgaaggcggacgtcacgaaaatcgcgtagggaaaattaaaacatacgaagcgaagtaa

SEQ ID NO: 3557 - DNA, 450 bp, Bacillus pumilus
atgaaagtagctattgcatccgatcacggcggaacgaatattcgtgaagaaatcaaacaactgatggatgaattgaagattgaatacattgatatgggttgtgaatgtggatcaggttctgtagactacccagattatgcttttcctgtagctaacatggtggcaaacggagaagtggaccgcggcattttaatttgcgggacaggcatcggtatgagtatctcagcaaacaaagtaaaaggaattcgctgcgcgctggcacatgatacatttagtgcgaaagcgactagagaacataatgatacaaacgtccttgcaatgggagaacgagtcattggacctggattagcacgtgagattgcacacatttggctgacaacagaatttacggcaggacgacatgctgtacggattggtaagatcgctgattacgaagaaaagcacctataa

SEQ ID NO: 3558 - DNA, 450 bp, Bacillus pumilus
atgaaagtagctattgcatccgatcacggcggaacgaatattcgtgaagaaatcaaacaactgatggatgaattgaagattgaatacattgatatgggttgtgaatgtggatcaggttctgtagactacccagattatgcttttcctgtagccaacatggtggtaaacggagaagtggaccgcggcattttaatttgcgggacaggcatcggtatgagtatctcagcaaacaaagtaaaaggaattcgctgtgcgctggcgcatgatacatttagtgcgaaagcgactagagaacataatgacacaaacgtccttgcaatgggagaacgagtcattggacctggattagcacgtgaaattgcgcatatttggctgacaacagagtttactgcaggacgtcatgctgtacggattggtaagatcgctgagtacgaagaaaagcacctataa

SEQ ID NO: 3559 - DNA, 453 bp, Bacillus selenitireducens MLS10
atgaaaattgtaatcggttcagaccatgcaggataccatttgaaaggtgcaattattgacgtcgttaaggagctcggtcatgagatcgttgatgtggggacagacagtccggattctgtcgattatgctgattttggccttcaggctgccgaaatggtggctaataaggaagcagaccgcggcattgtcatttgcggaacaggaatcggcatgtccatttctgcgaataaagtaaagggcattcgctgcgcactggtgcatgacctctttacagcaaaagcaaccagggaacacaacgataccaacgtgctggcgatgggagagcgcgttattggcccgggactcgcgcaggagattgcgaaaacgtggctgacgactgaatttgaaggcggacgccacgagcgtcggattatgaaagtgatgaactatgaagatgggacgtatcacgtataa

SEQ ID NO: 3560 - DNA, 438 bp, Bacillus sp. B14905
gtgagaatagcaatttcttctgatcacggaggcaacaacctacgtcgtgagatcatgcagctactagatgagcttcatattagctacgaagattttggtccacaatctgcggattcagtagactatccggattacgcaaagccagtttctgatggtgtagcaaacggaaaatttgataaaggcattttaatttgtggcacgggaattggtatgtcgattgctgcaaataaggtgaacggtattcgttgtgcgctagtacatgatgtatttagtgcgaaggcaacgcgatgccataatgactctaatgttttagctatgggggaacgtgttattggcccaggtcttgcacgtgaaattgtccaaacgtggctagaaactgagtttgaaggtggtcgtcatacacgacgcatcgaaaaaattactgaacttgagcaataa

SEQ ID NO: 3561 - DNA, 468 bp, Bacillus sp. NRRL B-14911
atgcatattgcaattggaagcgatcattgtggttttgaaatgaaaaatgcattattgcctttttttaaaaccattggttgtgatgttgtggattatggctgttattccggcgaaacagtggattttccggacatttcaagagaggtctgtgatgctgtccgttctggaaaatcagaaagaggtatcttattttgtggtacaggtgtgggggcagcaatagcatctaataagataaatggtatacgggccgcggtttgccatgatattcattcagcccaccagtctgttgaacatgacaatgtaaatgtcatgtgtataggagcacaaatcatcggcccgtggcttgctgaggatttgataaagtcttttgtgaatgctattttcagcccggaagaacatttattgcgaagagtagagaaactggaacaacttgagctgagatccagccgtgaattcaatgcagattaa

SEQ ID NO: 3562 - DNA, 441 bp, Bacillus sp. NRRL B-14911
atgaaggttgcaattgcttcagatcatggcggagtgaatatccgcgaagaaatgaaacatttgatggaagaaatgggcattgaatatgaagatttcggctgcgagtgcggcgtctcctttgattatccggactatgcgcttcctgtagcggagaaggtggcatcaggcgaatttgataaaggaatcctgatctgcgggacagggattggaatgagcatttccgccaacaaggtgaagggcatccgctgtgcactggtccatgatgtattcagtgccaaagcgacccgccagcataatgacagcaatatccttgccatgggcgagcgtgtgatcggaccgggacttgcccgggaaatagcgaaaacctggctagaaaccgagtttgaaggcggacgccatgcgaaccggatcggaaaaatcaaaacctacgaagatctataa

SEQ ID NO: 3563 - DNA, 450 bp, Bacillus amyloliquefaciens
atgaaagtagctattgcgtcagatcacggcggcgtccatatccgcgaagaaataaaaagtcttttggatgaattgcagattgaatacattgatatgggctgtgaatgcggcgccggctctgtcgattattcagactacgcttttccggtagcggaaaaagtggtgaacggcgaagctgacaggggaattttaatttgcggcacaggcatcggcatgagcatctccgcaaataaggtaaagggaatacgctgtgcgcttgcccatgacaccttcagcgcaaaagcgacgcgtgaacacaatgacacgaatgttcttgcgatgggcgaacgcgtcatcggcccggggctggcgcgcgaaatcgcaaaagtctggctgacgactgaatttacgggcggccgccacgaacggcggatcggcaaaatcgcagattacgaagaaaaaaatctgtaa

SEQ ID NO: 3564 - DNA, 450 bp, Bacillus licheniformis
atgaaagtaatcattgcatcagatcacggcggaatcaatatcagaaaagaaattatggcattgatggacgaattgaacatcgaatacgaagattacggctgcgaatgcggttcaggatctgtggactacccggattatgcgtttccggtcgcgcaaaaagtggcgaacggggaagccgacagaggcattttaatatgcggaacaggaatcggcatgagcatttccgccaataaagtaaaaggcatccgctgcgcccttgtccacgacgttttcagcgccaaaatgacaagagagcacaatgacacgaatgttcttgcgatgggtgaacgggtcatcggccctggtttagcgagagagattgcaaaggtttggcttacgactgagttttcagccgggcggcacgccgtccgcatcggaaaaatcgccgattatgaagacaagcatgaataa

SEQ ID NO: 3565 - DNA, 450 bp, Bacillus subtilis
atgaaagtagccattgcatcggatcatggcggcgttcacattcgaaatgaaatcaaagagttaatggacgaattgcaaattgaatatattgatatgggctgtgactgcggcagcggctctgtcgattatccggattatgcttttccggtggccgaaaaagtggttagcggcgaagttgacagaggcattttaatttgcgggacaggcatcggcatgagcatttccgctaataaagtaaaagggattcgctgcgcgctggcgcacgataccttcagcgcgaaggcgacgagggagcataatgacacaaacatccttgcgatgggtgaacgggtgatcggacctggtttggctcgggaaatcgcaaaaatctggctgactactgagtttaccgggggaagacaccaaacgcgtattggaaaaatctccgattatgaagagaaaaacctgtag

SEQ ID NO: 3566 - DNA, 447 bp, Geobacillus kaustophilus HTA426
atgaaagtcgctattgcttctgaccatggtggaattcgcattcgtgaggaaattaaagcactgttggatgaaatgggaatcgagtacaccgattttggctgcgattgtgaaacatcggtcgattacccggattacgcgcttcccgtcgctgaaaaagtggcgcgcggcgaatttgatcgcggcattttgatctgcggcaccggcatcggcatgacgatcgccgccaacaaagtgaaaggggtgcgctgcgccctttgccacgacgtctacagcgccaagctgacgcgcatgcataacgacagcaacattctcgcgatgggggagcgcgtcatcggccccggcctggcgcgcgaaatcgccaaggcatggcttgagaccgaatttgaaggcggacgccatgcgcggcgaatcggcaaaatcgccgagtatgaaaataagcatttgtag

SEQ ID NO: 3567 - DNA, 447 bp, Geobacillus sp. G11MC16
ttgaaagtagcaattgcttccgaccacggtggaattcgcattcgtgaagaaattaaagcacttcttgatgaaatgggcatcgaatatacagactttggctgcgactgtgaaacgtcggtcgattacccggattacgcgctcccggtcgctgaaaaagtggcgcgcggcgagtttgatcgcggtattttaatttgtggcaccggcattggcatgacgatcgcagcgaataaagtaaaaggggtgcgctgcgccctttgtcatgatgtttacagcgcgaaactgacacgcatgcataacgacagcaacatcctcgcgatgggcgagcgtgtgatcggccctggcttggcgcgtgaaatcgcgaaagcgtggttggagacggaattcgaaggtggccgccatgcgcggcggatcggcaaaattgccgattacgaaaacgaacatttgtaa

SEQ ID NO: 3568 - DNA, 447 bp, Geobacillus sp. WCH70
atgaaagtagcgattgcatctgatcacggcggaattcatattcgtgaagaaattaaaaaattaatggacgaaatggggatcgagtacatcgacttaggatgtgaatgcgaaacatcggtcgattatcctgattatgcgattccagttgcggaaaaagtcgcaaacggggaagtggatcgcggcattttaatttgcggcaccggaattggcatgacgattgccgctaataaagtaaaaggcattcgttgcgcgctctgtcacgacgtatatagcgccaaattaacgcgccagcataatgatagcaacatattagcgatgggagaacgcgtcattggaccaggattagcgcgtgaaatcgcgaaagtgtggttgacgacggaatttgaaggcggacgtcacgcacgacgcgtggaaaaaattacacaatatgaaaacaaacatttataa

SEQ ID NO: 3569 - DNA, 477 bp, Geobacillus sp. Y4.1MC1
gtggcgattaaagtcgcgcttggttgtgatcataacgctttcaatatgaaagagattattaaagagtttcttaaagagcgaggatacgatgttgtggattatggatgctactcatgcgaggcagtagactatcctgatgttgcatttcaagtcgcgaaagatattgccgctaataagatggatagaggaatcttaatatgtggtacaggtattggggtggcgattgctgctgggaaagtaccaggtatcagagctgcgttatgccatgatacgtattctgcggaaagagcacgaaaaagtaacaatgcacaaattttgacgatgggtgcacaaataattgggccggagttggcaaaaaagatagtagaggtatggatgaattctgagtttgatggtggaaattcagcgagaaaggttcaaaaaatcattgatcaagaaaaagagttgttgaaatcctggggcaatacaataatgtag

SEQ ID NO: 3570 - DNA, 444 bp, Geobacillus sp. Y4.1MC1
atgaaagtggcgattgcgtctgatcacgcaggaattcatattcgtgaagaaataaaaaaattaatggacgaattgggaatcgaatatatcgatttagggtgtgactgcgaaacatcggttgattatcccgattacgcgattccggtcgcggaaaaagtggcaaacggagaagtggatcgcggcattttaatttgcgggacgggaatcggcatggcgatcgcggccaataaagttaaaggcgtccgttgcgcgctttgccatgacgtatatagcgccagattaacgcgccagcataacgacagcaacgtgctggcgatgggagagcgcgttatcggaccggggctggcgcgcgaaatcgcggaagtgtggctgacaacggcgtttgaaggcggacgccacgccaaacgtgtggaaaaaattacgcaatacgaaaccgaacattaa

SEQ ID NO: 3571 - DNA, 465 bp, Geobacillus sp. Y412MC10
atgaaaattgcattgggtaccgatcatgccggcattcgtctgaaagaggagatcgtggaggtcattcggggtcttggacacgaggtggaggatcttggctgcggctgttccgattccgtggattatcccgattacgcgcttccggtgtgcgagaaggtggtctcgggtgaagcggatcggggcatcctgatctgcggaacgggaatcggcatgagcattgccgccaacaaggtgccgggcatccgctgcgcgctgacgcatgatgtattttcggccaaagccacgcgtgagcataatgacagcaacgtgattgcgctgggcgagcgcgtcgtcggccccgggcttgctgccgagatcgtcagcgcatggctgacaacggatttcagccagggcgaacgtcatgtcggccgcgtaaacaagatcaaggccatcgaggagcgttacctgaagagcgaatcgcgatag

SEQ ID NO: 3572 - DNA, 450 bp, Geobacillus sp. Y412MC52
atgatgaaagtcgctattgcttctgaccatggtggaattcgcattcgtgaggaaattaaagcactgttggatgaaatgggaatcgagtacaccgattttggctgcgattgtgaaacatcggtcgattacccggattacgcgcttcccgtcgctgaaaaagtggcgcgcggcgaatttgatcgcggcattttgatctgcggcaccggcatcggcatgacgattgccgccaacaaagtgaaaggggtgcgctgcgccctttgccacgacgtctacagcgccaagctgacgcgcatgcataatgacagcaacattctcgcgatgggggagcgcgtcatcggccccggcctggcgcgcgaaatcgccaaggcatggcttgagaccgaatttgaaggcggacgccatgcgcggcgaatcggcaaaatcgccgactatgaaaacaagcatttgtag

SEQ ID NO: 3573 - DNA, 441 bp, Exiguobacterium sibiricum 255-15
atgaaagtagcaattggagcagaccatggtggttttaagttaaaagcagaactgaatgaactcttacaggagctcggaattgattatacggacttcggcacgtattcatccgaatcaattgattatccggacgtcgcgattccggtcgcagaagcagttgcgaacggtgaattcgaccgcgggattttaatttgcggaaccggaatcggaatcggaatcgcggcgaacaaagtcaaaggtatccgcgcggcgcttgtccatgacacgttcagcgcaaaagcgacacgtcagcataacaactcgaatatcctgacgatgggcgaacgtgtcatcggaccgggccttgcgcgtgacatcgcgaaaatctggctcgagacggaattcgaaggcggacgtcatgaaaaccgtgtctgcaaaatctcagattatgaggtgaagtaa

SEQ ID NO: 3574 - DNA, 441 bp, Exiguobacterium sp. AT1b
atgaaaattgcaattggcgctgatcatggcggcttcaacttgaagaaagaaatcgtagccttgcttgaggaactcggacatgagtataaagatttcgggacgcactcagcggactcgattgactacccggatgtggccatcccggtcgcggaagcggtagcggcaggtgaattcgatcgtgggattttgatttgcggtacgggaatcggaatcgggattgcggcgaacaaagtcaaagggattcgtgcggcactcgtccatgattcattcagtgcaaaagcgacacgtcagcataacgattcgaacatcatgacgatgggcgagcgtgtcatcggacctggtcttgcactcgacttggtgacgacgtggctcgatacggactttgaaggcggtcgccattcaaaccgtgtcgacaagatgagtgcttacgaatcgaagtga

SEQ ID NO: 3575 - DNA, 447 bp, Listeria innocua
atgaaaatcgcaattggttgtgacgaaatgggttacgaactaaaacaaaccctcatcacacgtttaaaggagaaaaatattgagtttactgatttcggcagttttgaaaatgaaaaagtactttatccaagtatcgccgaaaaagtagcactagaagtaaaaaacaacgattatgaccgggggatccttatttgcggtacaggtattggaatggccattacagcaaacaaaattcacggcattcgcgcagcacaaattcatgattcgtattcagcagaacgtgcaagaaaaagtaacgacgcacatattatgaccatgggcgccctagttatcgggccatccctcgccgtttcgctacttgatacatggcttgatagcgacttttcaggtggacgttcccaagcaaaagtagatttaatggaagaaatcgaccaaaaaaatagataa

SEQ ID NO: 3576 - DNA, 441 bp, Listeria innocua
atgaaattaacaattggttgcgaccacggcggacgtagactaaaagatgccattgtgaaacatttacgtgaaaaagatattgaagttgttgatattggaacatatacagacgaaagtgtcgattttccgtcttatgcggaagaggtcgcgaatcaagtagtaagcggacaagctgatcttgggattttgtgctgtggaactggaattggtatgagtattgctgcgaataaagtcgatggaatccgtgcagcagttgtttctgatactttttcagcgcgtgccacccgtgaacataataatagcaatgttctctgcctaggcgaacgcgtcatcggcgaaggattagcacttttacttgtcgatacttggcttgaggggtcttttgcaggtgatcgccataaacgccgcttggataaaattactgaacttgaaagaaagtga

SEQ ID NO: 3577 - DNA, 450 bp, Listeria innocua
atggaaattgcaatcgcagctgaccatggtgggtttcagttaaaggaaaaagttcgcgcacatttaattgaaagcggctacaaggtgaaagattttggttgttattcattagagagcgtggattttccagagtacgccgctaaagtagggcacttcgttgcaaccgaaaatagtttaggtgtactttgttgcggaacaggaattgggatgtccatcgcagccaacaaaataaaaggcgtgcgtgctgctgtcgtttcagacacattttcagcaatgatgacgaggcgacataataacagtaatgttctttgtcttggtgaacgtgttcttggcgatagtctggcgttactcttacttgatacctggcttgcggcggaatttgaaggtggaagacatatgacaaggctcgcaaaattggcagagcttgaggaacaggaggaagtagaatga

SEQ ID NO: 3578 - DNA, 456 bp, Listeria innocua
atgacagttagtaaagttgccattgcttcagaccatggcggaattgagttacgcaaaagtattatttcttatcttgaaagcgttggaattagttatgaagaattcggacccgaagcaccagaatcagtggattacccggggctcgcaattacggtcagtgaaaaagtcgtgaataatgaagtcgaccgcgggattttagtttgtggcacaggtattggtatgagtatcgcagccaataaagtaaaaggcattcgttgcgcacttgttggcgatacatttagcgcccatgcaacgcgcgaacataatgatacaaatgtccttgcacttggagcgagagtcataggtccgggactagcagaagatattgtcaaaatttggttagaaacagcgtatgaaggcggcagacacgcaaatcgtgttgggcaaatcacagcatacgaagatagccacgcttaa

SEQ ID NO: 3579 - DNA, 456 bp, Listeria monocytogenes
atgacagttagtaaagttgccattgcttcagaccatggcggaattgaattacgaaaaagtattatttcttatcttgaaagtgttggtattagttatgaggaatttggccccgaaacaccagaatcagtggactacccgggactcgctattaccgttagtgaaaaagttgttaaccaagaagttgaccgcggcattttagtttgtggtacaggcattggtatgagtattgcagctaataaagtaaaaggtattcgttgcgcgcttgttggtgatacatttagcgctcatgcaacgcgtgaacataatgatacaaatgtccttgcgcttggagcgagagtcataggtccagggctagcagaagacattgtcaaaatttggctaaacaccgattacgaaggtggccgacatgcaaaccgtgttggacaaattacagcgtacgaagatagccacgcttaa

SEQ ID NO: 3580 - DNA, 447 bp, Listeria monocytogenes
atgaaaatcgcaattggttgtgacgaaatgggttacgaactaaaacaaaccctgatcacacgtttaaaggagaaaaatatcgagtttactgatttcggcagttttgaagatgaaaaagtactttatccaagcattgccgaaaaagtagcgctagaagtgaaaaataatgattacgaccgggggattctcatttgcggtacaggtattggaatggccattacagcaaacaaaattcacggcattcgcgcagcacaaattcatgattcgtattcagcagaacgtgcaagaaaaagtaacgacgcacatattatgaccatgggcgccctagtaattgggccatccctcgccgtatctctacttgatacatggcttgatagtgacttttcgggcggacgctcccaagcaaaagtagatttaatggaagaaatcgaccaaaaaaatagataa

SEQ ID NO: 3581 - DNA, 447 bp, Listeria monocytogenes
atgaaaattgctattggaaatgatcatgttggaatcgagcttaagccagttattgttgcgtatttacaggatttaggtcatgaagtagatgattttggtgctttctcaaatgaacgaactgattatcctgaatatggtaaaaaagttgcagaaagtgtagcggcgggaaaatcggacttaggaattttaatttgtggttcaggagtgggtatttcaattgctgctaataaagtaaacggaattcgcgctgttgtttgtagcgaaccatactctgcaaaactatcacgcgagcacaataatactaatattttagcttttggttcaagagttgttggtgcagaacttgcgaaaatgatagttcaaaactggttggatgcagaatttgaaggtggaagacatgcgaaacgcgtcgaaatgattgctagaattgaagatgaaaatgattaa

SEQ ID NO: 3582 - DNA, 441 bp, Listeria monocytogenes
atgaaattaacaattggttgtgaccacggcggacgtcgactaaaagatgccattgtgaaacatttacgtgaaaaagatatcgaggtcgttgatattggaacatatacggacgaaagtgttgattttccgtcgtatgcagaagaagttgccaatcaagtagtaagtgggcaatctgaactcggaatcttatgctgtggaactggaattggtatgagtatcgctgcgaataaagtcgatggaatccgtgctgcggttgtttcggatactttctcagcgcgtgctactagggaacataataatagcaatattctctgtcttggtgaacgcgtcatcggtgaaggactagcgcttttacttgttgatacgtggcttgaggcatcttttgcaggtgatcgccataaacgccgcttggataaaattactgaactcgaaagaaagtga

SEQ ID NO: 3583 - DNA, 450 bp, Listeria monocytogenes
atggaaattgcaattgcagctgaccatggcggatttcagttgaaagaaaaaatccgcgcgcatttaattgaaagcggctacacagtaaaagattttggttgttattcgttagaaagcgtggattttccagagtatgccgctaaagtaggacactttgttgcaactgaaaacagtttaggtgtgctctgttgcggaacagggattggaatgtctatggcagccaacaaaataaaaggtgtgcgtgctgctgtcgtttcagatgctttttcagcaatgatgacgaggcgacataataacagtaatgtactttgtcttggtgaacgtgttcttggcgatagcctggcgttgcttctattggatacatggctcgtggcagaatttgaaggcggtagacataatacaaggctccaaaaattggcggagcttgaggaacgggaggaagataaatga

SEQ ID NO: 3584 - DNA, 456 bp, Listeria monocytogenes
atgacagttagtaaagttgccattgcttcagaccatggcggaattgaattacgaaaaagtattatttcttatcttgaaagtgttggtattagttatgaggaatttggccccgaaacaccagaatcagtggactacccgagactcgctattaccgttagtgaaaaagttgttaaccaagaagttgaccgcggcattttagtttgtggtacaggcattggtatgagtattgcagctaataaagtaaaaggtattcgttgcgcgcttgttggtgatacatttagcgctcatgcaacgcgtgaacataatgatacaaatgtccttgcgcttggagcgagagtcataggtccagggctagcagaagacattgtcaaaatttggttagaaacagagtatgaaggtggccgtcacgcaaatcgcgtaggacaaatcactgcttacgaagatagccacgcttaa

SEQ ID NO: 3585 - DNA, 441 bp, Listeria monocytogenes
atgaaattaacaattggttgtgaccacggcggacgtcgactaaaagatgccattgtgaaacatttacgtgaaaaagatatcgaggtcgttgatattggaacatatacggacgaaagtgttgattttccgtcgtatgcagaagaagttgcgagccaagtggtgagtgggcaatccgaactcggaatcttatgctgtggaactggaattggtatgagtatcgctgcgaataaagtcgatggaatccgtgctgcggttgtttcggatactttctcagcgcgtgctactagggaacataataatagcaatattctctgtcttggtgaacgcgtcatcggtgaaggactagcgcttttacttgttgatacgtggcttgaggcatcttttgcaggtgatcgccataaacgccgcttggataaaattactgaactcgaaagaaagtga

SEQ ID NO: 3586 - DNA, 450 bp, Listeria monocytogenes
atggaaattgcaattgcagctgatcatggcggatttcagttaaaagaaaaaatccgtgcgcatttaattgaaagcggctacacagtaaaagattttggttgttattcgttagagggcgtcgattttccagagtatgctgctaaagtaggacactttgttgcaactgaaaacagtttaggtgtgctctgttgcggaacagggattggaatgtctatggcagccaacaaaataaaaggtgtgcgtgctgctgtcgtttcagatgctttttcagcaatgatgactagaagacataacaacagtaatgtactttgtcttggtgaacgtgttctaggtgatagcctggcgttgcttctattggatacatggctcgtggcagaatttgaaggcggtagacataatacaaggctccaaaaattggcggagcttgaggaacgggaggaagataaatga

SEQ ID NO: 3587 - DNA, 456 bp, Listeria monocytogenes
atgacagttagtaaagttgccattgcttcagaccatggcggaattgaattacgaaaaagtattatttcttatcttgaaagtgttggtattagttatgaggaatttggcccagaagcaccggaatcagtggattatccgggacttgctattaccgttagtgaaaaagttgttaaccaagaagttgaccgcggcattttagtttgtggtacaggcattggtatgagtattgcagctaataaagtaaaaggtattcgttgcgcgcttgttggtgatacatttagcgctcatgcaacgcgtgaacataatgatacaaatgtccttgcgcttggagcgagagtcataggtccagggctagcagaagacattgtcaaaatttggttagaaacagagtatgaaggtggccgtcacgcaaatcgcgtaggacaaatcactgcttacgaagatagccacgcttaa

SEQ ID NO: 3588 - DNA, 456 bp, Listeria monocytogenes
atgacagttagtaaagttgccattgcttcagaccatggcggaattgaattacgaaaaagtattatttcttatcttgaaagtgttggtattagttatgaggaatttggccccgaaacaccagaatcagtggattatcctggactcgctattaccgttagtgaaaaagtcgtaaaccgagaagtcgatcgcggtattttagtgtgtggtacgggtattggtatgagtattgcagctaataaagtaaaaggcattcgttgcgcgcttgttggcgatacatttagcgctcacgcaactcgcgaacataatgatacaaatgtccttgcgcttggagcgagagtcataggtccaggactagcagaagacattgtcaaaatttggttagaaacagcgtatgaaggtggccgacatgcaaatcgtgtaggacaaatcgccgcttacgaagatagccacgcttaa

SEQ ID NO: 3589 - DNA, 447 bp, Listeria monocytogenes
atgaaaatcgcaattggttgtgacgaaatgggttacgaactaaaacaaaccctgatcacacgtttaaaggagaaaaatatcgagtttactgatttcggcagttttgaagatgaaaaagtactttatccaagcattgccgaaaaagtagcgctagaagtaaaaaataacgatttcgaccgggggattctcatttgcggtacaggtattggaatggccattacagcaaacaaaattcacggcattcgcgcagcacaaattcatgattcgtattcagcagaacgcgcaagaaaaagtaacgatgcacatattatgactatgggcgccctagtaatcgggccatccctcgccgtatctctacttgatacatggctggatagcgacttttcgggtggacgctcccaagcaaaagtagatttaatggaagaaatcgaccaaaaaaatagataa

SEQ ID NO: 3590 - DNA, 450 bp, Listeria monocytogenes
atggaaattgcaattgcagctgatcatggcggatttcagttgaaagaaaaaatccgtacgcatttaattgaaagcggctacaaggtgaaagattttggttgttattcattagagagcgtggattttccagagtatgccgctaaagtaggacactttgttgcaactgaaaacaggctaggtgtgctctgttgcggaacagggattggaatgtccatggcagccaacaaaatcaaaggtgtgcgtgctgctgtcgtttcagatgctttttcagcaatgatgactaggcgacataataacagtaatgttctttgtcttggtgaacgtgttctgggcgatagtctggcgttactcttacttgatacatggcttgcggcggaatttgaaggcggtaggcatatgacaaggctcggaaaattggcagcgcttgaggaacaggagggtgttgaatga

SEQ ID NO: 3591 - DNA, 444 bp, Listeria monocytogenes
atgaaaatcgcaattggttgtgacgaaatgggttacgaactaaaacaaaccctgatcacacgtttaaaggagaaaaatatcgagtttactgatttcggcagttttgaagatgaaaaagtactttatccaagcattgccgaaaaagtagcgctagaagtgaaaaataatgattacgaccgggggattctcatttgcggtacaggtattggaatggccattacagcaaacaaaattcacgggattcgagcagcacaaattcatgattcttattcagcagaacgcgcaagaaaaagtaacgacgcacatattatgaccatgggcgccctagtaattgggccatccctcgccgtatctctacttgatacatggcttgatagtgacttttcgggcggacgctcccaagcaaaagtagatttaatggaagaaatcgaccaaaaaaaatag

SEQ ID NO: 3592 - DNA, 450 bp, Listeria monocytogenes
atggaaattgcaattgcagctgatcatggcggatttcagttaaaagaaaaaatccgtgcgcatttaattgaaagcggctacacagtaaaagattttggttgttattcgttagagagcgtcgattttccagagtatgctgctaaagtaggacactttgttgcaactgaaaacagtttaggtgtgctctgttgcggaacagggattggaatgtctatggcagccaacaaaataaaaggtgtgcgtgctgctgtcgtttcagatgctttttcagcaatgatgactagaagacataacaacagtaatgtactttgtcttggtgaacgtgttctaggtgatagcctggcgttgcttctattggatacatggctcgtggcggaatttgaaggcggtagacataatacaaggctccaaaaattggcgaagcttgaggaacgggaggaagataaatga

SEQ ID NO: 3593 - DNA, 450 bp, Listeria monocytogenes
atggaaattgcaattgcagctgaccatggcggatttcagttgaaagaaaaaatccgcgcgcatttaattgaaagcggctacacagtaaaagattttggttgttattcattagaaagcgtggattttccagagtatgccgctaaagtaggacactttgttgcaaccgaaaacagtttaggtgtgctctgttgcggaacagggattggaatgtctatggcagccaacaaaataaaaggtgtgcgtgctgctgtcgtttcagatgctttttcagcaatgatgacgaggcgacaaaataatagtaatgttctttgtcttggtgaacgtgttctgggcgatagtctggcgttactcttacttgatacgtggcttgcggcagaatttgaaggtggaagacataatacaaggctcgcgaaattggcggagcttgaggaaccggaggaagataaatga

SEQ ID NO: 3594 - DNA, 450 bp, Listeria monocytogenes
atggaaattgcaattgcagctgatcatggaggatttcagttgaaagaaaaaatccgtgcgcatttaattgaaagcggctacaaggtgaaagattttggttgttattcagtcgaaagcgtggattttccagagtatgccgctaaagtaggacactttgttgcaactgaaaacagtctaggtgtgctctgttgtggaacagggattggaatgtccatggcagccaacaaaatcaaaggtgtgcgtgctgctgtcgtttcagatgctttttcagcaatgatgactaggcgacataataacagtaatgttctttgtcttggtgaacgtgttctgggcgatagtctggcgttactcttacttgatacgtggcttgcggcggaatttgaaggcggtaggcatatgacaaggctcggaaaattggcagagcttgaagaacgggagggtgttgaatga

SEQ ID NO: 3595 - DNA, 456 bp, Listeria monocytogenes
atgacagttagtaaagttgccattgcttcagaccatggcggaattgaattacgaaaaagtattatttcttatcttgaaagtgttggaattagttacgaagaatttggccccgaagcaccagaatcagtggattacccgggactagcgattacagttagtgaaaaagttgttaaccaagaagtcgaccgcggcattttagtttgtggtacaggtattggtatgagtatcgcagctaataaagtaaaaggcattcgttgcgcacttgttggtgatacatttagcgctcacgcaacgcgcgaacataatgatacaaatgtccttgcgcttggagcgagagtcataggtccggggctagcagaagacattgtcaaaatttggttagaaacagcgtatgaaggtggccgacacgcaaatcgtgtaggacaaatcaccgcttacgaagatagccacgcttaa

SEQ ID NO: 3596 - DNA, 447 bp, Listeria monocytogenes
atgaaaatcgcaattggttgtgacgaaatgggttacgaattaaaacaaaccctgatcgcacgtttaaaggagaaaaatatcgagtttactgatttcggcagttttgaagatgaaaaagtactttatccaagcattgccgaaaaagtagcgctagaagtaaaaaataacgatttcgaccgggggattctcatttgcggtacaggtattggaatggccattacagcaaacaaaattcacggcattcgcgcagcacaaattcatgattcgtattcagcagaacgtgcaagaaaaagtaacgacgcacatattatgaccatgggcgccctagttatcgggccatcccttgccgtatctctacttgatacatggctggatagcgacttttcgggcggacgctcccaagcaaaagtagatttaatggaagaaatcgaccaaaaaaatagataa

SEQ ID NO: 3597 - DNA, 456 bp, Listeria monocytogenes
atgacagttagtaaagttgccattgcttcagaccatggcggaattgaattacgaaaaagtattatttcttatcttgaaagtgttggtattagttatgaggaatttggccccgaaacaccagaatcagtggactacccgggactcgctattaccgttagtgaaaaagttgttaaccaagaagttgaccgcggcattttagtttgtggtacaggcattggtatgagtattgcagctaataaagtaaaaggtattcgttgcgcgcttgttggtgatacatttagcgctcatgcaacgcgtgaacataatgatacaaatgtccttgcgcttggagcgagagtcataggtccagggctagcagaagacattgtcaaaatttggttagaaacagagtatgaaggtggccgtcacgcaaatcgcgtaggacaaatcactgcttacgaagatagccacgcttaa

SEQ ID NO: 3598 - DNA, 441 bp, Listeria monocytogenes
atgaaattaacaattggttgcgaccacggcggacgtagactaaaagatgccattgtgaaacatttacgtgaaaaagatattgaagttgttgatattggaacatatacagatgaaagtgtcgattttccatcttatgcagaagaagttgccaatcaagtagtaagcgggcaatctgaactcggtattttgtgctgtggaactggaataggtatgagtattgctgctaacaaagtggacggaatccgtgctgcggttgtttcggatactttctcagcgcgtgccacccgtgaacataacaatagcaatgttctctgtctaggcgaacgcgttatcggtgaaggattagcgcttttacttgttgatacttggcttgaggcatcatttgcaggagatcgccataaacgccgcttggataaaattactgaactcgaaagaaagtga

SEQ ID NO: 3599 - DNA, 450 bp, Listeria monocytogenes
atggaaattgcaattgcagctgaccatggcggatttcagttgaaagaaaaaatccgcgcgcatttaattgaaagcggctacacagtaaaagattttggttgttattcattagaaagcgtggattttccagagtatgccgctaaagtaggacactttgttgcaaccgaaaacagtttaggtgtgctctgttgcggaacagggattggaatgtctatggcagccaacaaaataaaaggtgttcgtgctgctgttgtttcagatgctttttcagcaatgatgacgaggcgacataataatagtaatgttctttgtcttggtgaacgtgttctgggcgatagtctggcgttactcttacttgatacgtggcttgcggcagaatttgaaggtggaagacataatacaaggctcgcgaaattggcggagcttgaggaaccggaggaagataaatga

SEQ ID NO: 3600 - DNA, 456 bp, Listeria monocytogenes
atgacagttagtaaagttgccattgcttcagaccatggcggaattgaattacgaaaaagtattatttcttatcttgaaagtgttggaattagttatgaagaatttggccccgaagcaccagaatcagtggattatccgggactagcgattaccgttagtgaaaaagttgttaaccaagaagttgaccgcggcattttagtttgtggtacgggtattggtatgagtattgcagctaataaagtaaaaggcattcgttgcgcgcttgttggcgatacatttagcgctcacgccacgcgcgaacataatgatacaaatgtccttgcgcttggagcgagagtcataggcccagggctagcagaagacattgtcaaaatttggctagaaacagcgtatgaaggtggccgacacgcaaatcgtgtaggacaaatcaccgcttacgaagatagccaggcttaa

SEQ ID NO: 3601 - DNA, 441 bp, Listeria monocytogenes
atgaaattaacaattggttgcgaccacggcggacgtagactaaaagatgccattgtgaaacatttacgtgaaaaagatattgaagttgttgatattggaacatatacagatgaaagtgtcgattttccatcttatgcagaagaagttgccaatcaagtagtaagcgggcaatctgaactcggtattttgtgctgtggaactggaataggtatgagtattgctgctaacaaagtggacggaatccgtgctgcggttgtttcggatactttctcagcgcgtgccacccgcgaacataacaatagcaatgttctctgtctaggcgaacgtgttatcggtgaaggattagcgcttttaattgttgatacttggcttgaggcatcatttgcaggagatcgccataaacgccgattggataaaattactgaactcgaaagaaagtga

SEQ ID NO: 3602 - DNA, 447 bp, Listeria welshimeri
atgaaaatcgcaattggttgtgacgaaatgggttacgaactaaaacaaacccttatcacacgtttaaaggagaaaaatatcgcgtttactgatttcggtagttttgaagatgaaaaagtactttatccgagcattgccgaaaaagtagcgttagaagttaaaaataacgattacgaccggggaattctcatttgcggtacagggattggaatggccattacagcaaacaaaattcacggcattcgcgcagcacaaattcatgattcttattcagcagaacgcgcaagaaaaagtaacgatgcgcatattatgaccatgggcgcacttgtaatcggtccatcccttgcagtttcgctacttgacacttggcttgatagtgacttttcaggtggacgttcccaagcaaaagtagatttaatggaagaaatagaccaaaaaaatagataa

SEQ ID NO: 3603 - DNA, 441 bp, Listeria welshimeri
atgaaaattgcgattggaaatgatcatgttggtatagaacttaagcctattattatccgatttttaaaggaattaggtcatgaagtagaagattttggtgcttttacaaatgaaagaacagactatccagaatatggcaaaaaagttgctgagaatgttgcagcggggaaagctgatttaggtatcttgatttgtggaacaggggtggggatttccattgctgctaataaagttaaaggtatccgcgcagtcgtttgtagtgaaccatactcagcaaaattatcacgtgaacacaacaataccaatattttagctttcggttcaagagtgattggctcagaaatggcaaaaatgattgtccaaaattggttagaagctgaattcgaaggtgggagacatcaaaaccgtgtaacaatgattgcaggaatagaaaatgagtaa

SEQ ID NO: 3604 - DNA, 441 bp, Listeria welshimeri
atgaaattaacaattggttgtgatcacggcggacgtaggctaaaagatgccattgtgaaacatttacgtgaaaaaaatattgatgtcgttgatatagggacatatacagacgaaagtgttgattttccttcttatgcagaagaagttgcgaatcaagtagtaagtggccagtctgaactcggtatcttatgctgtgggactggaattggtatgagtattgctgcaaacaaagtggatggaatccgtgctgcagtagtttctgatactttttcagcacgtgctacaagagaacataataatagcaatattctttgcctaggcgaacgtgttatcggcgaaggattagcgcttttgctcgtggatacttggcttgaggcatcatttgcaggtgaccgccataaacgccgcttggataaaattactgaacttgaaagaaagtga

SEQ ID NO: 3605 - DNA, 456 bp, Brevibacillus brevis
atgaaagtagcacttgctgctgatcacggtggatacaagctaaaagaggagatcaagactctgctggcctccatgaacatccagacggaagatttcggctgcacctgcgaggaatcggttgattatcccgattatgctttgccagtggcggaaaaggtagcagcgggggagtttgatcgaggcattctcgtttgcggaacaggtattggcatgtcgatcgcggccaacaaggttccgggcatccgttgtgcacttgtgcatgatacgttttccgcgcgcgctactcgtgagcataacaacacgaatgtgttggcgatgggtgagcgggtcattggaccgggtcttgcgcttgatatcgtgaaaatttggttggaaacagagtttcaaggtggtcgtcacgagcgtcgcgtggaaaagatttcccaaatcgaagcgaagcatgcgggagtgaagtaa

SEQ ID NO: 3606 - DNA, 462 bp, Paenibacillus larvae
atgttgaaattagccttaggagccgaccatgccggttaccggctaaaagatgtgctgattccgtttattgaatctttgggacacgaagtggtggatctggggtgcagctgtgatagttcggttgactatccggattatgcattggaagtatgtgatcatgtcatttcagggatagcggacaaagggatcctgatatgcgggaccggtattggtatgagcatagctgccaataaagtgcccggtatacgctgtgcacttgttcacgaccttttttccgcacaggcaacccgtgaacataatgattccaatgtactcgctatgggggaacgtgtagtggggccgggcgtggctcaggaaattgtacggatctggctggaaacggaattttccggtggagaacgccatgccaaccgtgtaggaaaagtgaaagcaattgaagaaaagtatgccatacatccgtaa

SEQ ID NO: 3607 - DNA, 459 bp, Paenibacillus sp. JDR-2
ttgaaaattgcaattggtgcagatcatgcgggttaccgtctgaaagatgaaattgttccgtttcttttatcgcttggtcatgaaattgaagacttgggctgcgactgcagccagtcggtggattatcccgattatgcgctgcccgtagcagacagagtggccagcggccaggctgaccgcggcattctgatctgcggcacgggtatcggcatgtcaatcgcggcgaacaaagttccgggtatccgctgcgcgctggtgcatgatatgttttcggcacaagcaacccgcgagcataacgatacaaacgtgcttgcgatgggagagcgtattatcggccctggtcttgcacaggaaattgtccgcatctggatggaaacaccgttctcaagcggcgagcgccatgttgggcgtgtccggaaagtgaaggaaatcgagcagcagtatacggttcatccttag

SEQ ID NO: 3608 - DNA, 453 bp, Paenibacillus sp. oral taxon 786 str. D14
atgaaggttgtgatagccaatgaccacggcggattgatgctgaaaagggagcttgcgtccctgctgcgggaaatgaacgcggaagtcgtcgacctcggctgcgatacccaagatgcggtggattaccccgactatgcgattcgggcggcggcgatggtcgccaacggagaagcggagcggggaattctgatttgcggaacgggaatcggcatgtcgatcgcggccaacaaggtgcccggcattcgctgcgcgctcgcgcatgacgtgttcagcgcgaaggcgacgcggctccataacgacagcaacatgctggctttgggcgagcgggttatcgggcccggattggcaagagaaatcgtgaagacctggatagagacggagtttgaaggcggacgccatcaacggcggattgacaaggtgtcaaattacgagcgttccgcccgatccgaataa

SEQ ID NO: 3609 - DNA, 447 bp, Macrococcus caseolyticus JCSC5402
ttgaagattgcaatcgcaagtgatcatggtggatttcagtataaagagaaaatcattgaactattacagtcccaaaatattgaatatattgattttggcccactggatgaaacatctgtagattatcctgattatgctaagccagttgctgagagtgttgtgaatggagcgtgtgaccgtggaatcttgatttgcggcacaggtattggaatgagtattgcagcgaataaagtgccaggtgttcgctgtgccttagtgcacgatgtatttacagcacaagtgacgcgtgaacataacaactctaatatattagcaatgggacagcgtgtgataggcgaagggttaatgttgttaattgttaagacatggttagaagctgaatttgaaggtggtcgtcaccagaagagaattgataaagtatcagccctggagtcttgcaatggatag

SEQ ID NO: 3610 - DNA, 444 bp, Staphylococcus carnosus
atggaaatcgcaattggtgcagatcacaatggttatgaattaaaagaagaaattaaatcgtatgtagaagaattaggacacactgtgacagattatggttgtcatcaatgtgctgaaacagattatcctgatgttgcgcaagaagtcggtaaaaatattcaaaaaggcgagcacgatcgtggtattttaatttgtggaacaggtatcggagttgctatcacagcatgtaaattaaaaggaatcagagctgcattagcacatgatgtttattcagctgagcgtgctcaacttagtaataatgcacaaattatgacaatgggtgctcaaattataggagttgaagcggctaagaaaaatgttaaagcttatttagacgcagaatggcaaggaggatctcaacgtaaagtagacaagatagatcaagttgaaaaagacgaggagtga

SEQ ID NO: 3611 - DNA, 447 bp, Staphylococcus saprophyticus
atgaaaatagcaattggtgcagaccataatggatatgatttaaaagaagcggtcaaagcgcatgttgagcatttaggacatgtagttgaagattttggttgtcatcaatgtgctgaaacggactaccctgatgtagcggctgaagttggaaaaagcattcaacaaggtgaaaacgaacgcggtattttgatttgtggtacgggtattggtgtagcaattactgcaaacaaaataaaaggcatacgtgcagcattagcacacgattattattctgcagaacgtgcacaattaagcaataatgcacagattttaactatgggggcacaaattataggtgttgaagttgctaaaaaaaatgttgaagcttatcttaatgtgagttgggaaggtggttcacagcgcaaagttgataagatcgataaagtggaagaaagtgaaaataagtaa

SEQ ID NO: 3612 - DNA, 456 bp, Abiotrophia defectiva
atgaaacttgtaataggaagcgatcatgtcgggtatgattataaagagataatcaagctgtatttaaaagaaaaaggaatagacgtaacagatgtgggtaccgacagtacggaaaggtttgactatccaataagcggatataaggcggcaaaaataattgtggctggggaagcggacggaggtgtattaatatgcggtacgggggttggtatatctctggctgcaaacaaagttaagggcataagagcttgtgtatgcagtgaaccttattccgcgggactttccaagtgtcataataacacaaatataatagcctttgggtcaagagtagtaggcatagagcttgcgaagatgatagtggatgcctggcttgaagcaaaatatgagggcggcagacatggaaaaagggttgaaatgattgctgagatagaaaacaccggagaacttatggtatga

SEQ ID NO: 3613 - DNA, 441 bp, Abiotrophia defectiva
atggaaaacaaaattattgctatcggaagtgaccatggcggctttgagcttaagcaggagattattaagtatttaacagaaaaaaatatagagtataaagattttggctgctatgatgagacctcctgtgattacacggagtatggaaaagcagttgcggaagcagtggctgcgggaaaatatgaaaaaggaattttaatctgcggtacaggcataggtatatccattacagcaaataaagtgaagggtatcagatgtgccctttgcagcgattgtttttcggcagaggctaccagagagcataatgatgccaacattcttgccttgggtggcagagtagttggcaccggagttgcactgaaaattgttgataccttcttaaatacaccgttttcaaatgaagaaaggcatataagaagaatcagccggattgagagctaa

SEQ ID NO: 3614 - DNA, 474 bp, Abiotrophia defectiva
atggtagaaactatgaaattagcaatgggatgtgatccggcagcatatttgttttaccgtaagctattagagagaatgagaggtgagggatatgacattgtagatgttggctgtgaatcagaaaatgaggctgatggcggtaagtatgctgagattgctgaaatcgtatctaataaggtaattaaaaaagaatgtgattatggaatactgctttgtggaacaggacagggaatggcaatggcagccaacaagataccgggtatacgagcagtactttgttatgatgtacttccggctgtgcttagtaaaaatgataataatgggaatgtattgtgcactggagcatggtttatggaaaagaaaggaattgattttacattggcaatgattcacgcatggttattctctgactatacgggaactcatgaggatggcatgcgtgctcttagtcatcttgactgtaaaaggtactag

SEQ ID NO: 3615 - DNA, 441 bp, Enterococcus casseliflavus
atgaaactagcaatcgattgtgatcatgttgggtttgaattaaaaactgatatcatcacctatttggagttgttagggcacacggtacaagattttgggacacaaagtgctaaacgcgttgactatcccaattatgcggcggctgttgcagaagcggtcgtaacccaaaagtgtgatttgggaatcttgatttgtggcacaggggttggtatctcaattgctgccaacaaaatcaagggcatccgagccgtggtgtgcagcgaaccctatagtgctaagctctcaagagagcataacaataccaacgtactggcgtttggttcgcgcgtcgtgggcatcgaactagcgaaaatgattactaaggaatggctggctgctgagtttgaaggtggtcgtcaccaaaaacgggtagcaatgattggtcagttagaagtagaatga

SEQ ID NO: 3616 - DNA, 519 bp, Enterococcus faecalis
atgaaaaccaaaattgcaattgcatgtgatgacttaggttttgaaacaaaggaggcgataaagaaatacttgattgaagagaaaaatgctgatgttgtctatgatccagtacaggtaccagaggatggagtcaatacttttgctaagttagcagatgaaatgtctgtattgatccaaaaagatgtttgtcgtttaggaatatacatttgtggaactggaattggttttacttgtcaagccaataaacattggggaattcgagcaacagctgttacaaatccttattctgcaaaaagagcaagattaagtaataatgtacaaatcataggtttaggtttgcgtgtaaatggattagaatacatgaagcagattattgatgcatggtatgatgaaccttttgaattttcaactgcaagagaaaattcaaaaaacaatttattagaagcagaaaaaaatgataatttacttctaaaaaaaccagatcatgtagcttggaatatgggatttagaccggattaa

SEQ ID NO: 3617 - DNA, 519 bp, Mitsuokella multacida DSM 20544
atgaaagtaaaaatcggcatcgcttgtgacgatattggttttgaacgcaaggaagaagtccgccactatctcgaagaagtgaagggtatggaagtcgtttacgatcctgtcaaagttcctgctgatgggcagaatacctttgctgtactggctgacgatatggcgacacgtatccaaaaggatgaattccgcctgggcatctatatctgtggcacaggcatcggctttacttgtcaggccaacaagcattggggcatccgtgcggtggctgtcagcaatccttatacggcgcagcgagcaagactcagcaataatgcgcagatcatcggccttggctgccgtgtgctcggcatggagtacacgaaaatggtcctggatgcctggctcgacaatccctttgactttgccacggcgcgcgagaattccaagaagaatctgctcgaggcgaagaagaacgatgacctgctcttgaaaaagccggattacattgcttggaatatgggctttgaggcagaatga

SEQ ID NO: 3618 - DNA, 450 bp, Lactococcus lactis
atgaaattagcaattggtagcgaccatgtaggatttgaattgaaaccccttattattgactatcgtgaggagttggggcacgaagtgacagattttggccccttttcaactgaacgaacggactatcctatttacggaaaaaaagtggcagaggaagtagcggcaggtcattttgacggtggagtattgatttgtggaacaggagtgggaatttccatttcagcgaataaagtaagaggaattcgtgcagtcgtctgtagtgaaccttattcggcaaaattatccaaagaacacaataatacaaatattatggcattcggttcacgtgttgtcggaagtgaattggcaaaaatgattgtcaaggaatggttggaagcaatttatgagggtgggcgtcacgccaaacgtattgaaatgattaccgagcttgaaacagaacaaaagagataa

SEQ ID NO: 3619 - DNA, 450 bp, Lactococcus lactis
atgaaattagcaattggtagcgaccatgtaggatttgaattgaaaccccttattattgactatcttgaggagttggggcacgaagtgacagattttggccccttttcaactgaacgaacggactatcctatttacggaaaaaaagtagcagaggaagtagcggcaggtcattttgacggtggagtattgatttgtggaacaggagtgggaatttccatttcagcgaataaagtaagaggaattcgtgcagtcgtctgtagtgaaccttattcggcaaaattatccaaagaacacaataatacaaatattgtggcattcggttcacgtgttgtcggaagtgaattggcaaaaatgattgtcaaggaatggttggaagcaatttatgagggtgggcgtcacgccaaacgtattgaaatgattactgagcttgaaacagaacaaaagagataa

SEQ ID NO: 3620 - DNA, 450 bp, Alkaliphilus metalliredigens QYMF
atgaaaattgcaattggcagtgatcatggtgggtatgaactaaagaacttgattaaggaacacctattgaataagaagctggaagtggtggattttggtactgaatccacggattcctgtgattatgctgattatgcccaaggggtggcggaggcagttgccaagggagactatgcaaggggaattttaatttgtggtacagggattgggatttccattgcagccaataaggtgccgggaattcgttgtgcccttgtgggagattgtttttcagcaaaagcaacaactgaacacaatgacagcaatgtattggcccttgggggacgggttgttggaccgggcctcgcattagaaattgtagatatttggttatctgctacatttcaagggggaagacaccaaaagcgaatcgataaaatcactgatattgaaagtaaatattataaataa

SEQ ID NO: 3621 - DNA, 450 bp, Alkaliphilus oremlandii OhILAs
gtgaagattgcaataggaagtgaccacggaggctatggactaaaggaactgataagaaaacacctacaggaaaaaggctttgacataaaagatttcggaacggattcaacagcatctgtagattaccctgactttgcaaaggcagttggtgaagctgtagtagctggagaatttcaacgaggaatattgatttgcggaactggaatcggaatatccattgcggcaaataagattccaggtgtgcgatgtgcgctggttggagattgtttctcggcgaaggcgactcgtcagcataatgatgccaatatcctagctttaggagagcgggttgtaggcccaggtcttgctttagagattgtagatatatggctttcggctgaatttgaaggtggaagacaccaaggcagagtggataaaattgcggatatcgagaaaaagtacacgttgtaa

SEQ ID NO: 3622 - DNA, 459 bp, Clostridium acetobutylicum
atgaagatagcaataggtagtgatcatgcaggattttcattgaaaaaggaagttataaaacatttagagagtaaaaatattgaggttaaagattttggcactctaactgatgaatcatgtgattatccagattatgcattaaaagtagcagaggaagttgctcaaaaaaactttgagtttggaatactcatttgtggaacaggtataggaataagcatatcagcaaataaggtgccaggaataagagcagctgtatgtacagatacattctgtgctcatgcatcaagagaacataacaatgcaaatatacttgcaatgggagaaagagttgtaggacctggattagcaattgatatagtagatacatttttaaattcaaaatttcagggagataggcatcaaagaagaatagacaagattacacaaatagaaaaaaaatacaatggaggaatgaaataa

SEQ ID NO: 3623 - DNA, 510 bp, Clostridium asparagiforme DSM 15981
atgggtttaacaacaccgtatcgcaaggaggatttgcagatgaacaaaaccatagtcatcggctgtgacaacgcggccgtcagcatgaagaatcagcttaaagcgtacatggaagcagcggggtacacggtggaggatatgggctgcgacagcccggacgacccgatctactacccctatgtggccgctaaggcctgccaggccatcattgacagcaattatactaaggaaggagtcctgatctgcggcaccgggttgggcatggccatgaccgccaacaagttccccggcatccgcgcgggcgtctgccacgacagtttttccggagagcgcttaaagctcagcaacaacggcaatgtgatctgcttcggcgaacgcgtgatcggagtggagctggcaaagaaaattctgggcgaatggctgaccctggagttcaaggacggctcctccacccccaaggtggcggcgattaacgagctggaacatcacaatatgaaggccgggagctga

SEQ ID NO: 3624 - DNA, 474 bp, Clostridium asparagiforme DSM 15981
atgaaagtggcagtgggggcggatttctccgcaatcgcaaggaaaaacgaggttaaggcgtacttgattgagaacggttacgaggtgctggacttaggccaaaacgagggggaggatcaactgatctacccggaagcggccaagcgcatcgcactggcggtccagagcggcgaggccgagcggggaatcatcttctgcggaaccggcgggggcgtaagcatcatggcgaataaattccggggcgtttactgcgtggcctccgagagcatgtacacggccttcaagatgcgccagctcaacggagccaacgtgctggccatgggaaaaaatgtggcgggcgagcagaacacctatgagatcgtaaacctgtttctgaccacggatttctgccaggacttcgccccggagcgggaagcctttgtaaacggcctgcgccggcggatgctggagatcgaggcggaaaatctgaaataa

SEQ ID NO: 3625 - DNA, 441 bp, Clostridium asparagiforme DSM 15981
atgaagattgcgatgggcaatgatcacacaggaattgaactgaaaaatatcatcaaagagtttgtggaaggcaagggttacgaggtgattgacctgggaaccaacgcgccggagagctgcgattatccggtttacggtgagaaggtgggccgggccgtggcggacggggaagcggatctgggcatcgccatctgcggaaccggagtgggaatttccctggcctgcaacaaggtaaagggcatccgcgcctgcgtttgcagcgagccctacaccgccaagctttccaggcagcacaacaattccaacgttcttgccttcggctcccgcgtggtgggcagcgagcttgccaagatgatcaccgaggcctggctggacgccgcgttcgagggcggacgccatcagcgccgcgtggatatggtgatggagattgaaaagcgctga

SEQ ID NO: 3626 - DNA, 453 bp, Clostridium bartlettii DSM 16795
atgaaaataggtttaggatgtgaccatggcggttataatttgaaattagaaattaaaaagtatttagggacaaaaggaattgaatgtgtagattttggaacaaataatgatacagaatcagttgattatccaatctacgggcaaaaagtagctgaagctgtagtggcaaaggaagttgattacgggatagtatgctgtggaacaggtataggtatatcgctggcagcaaataaagtacctggtataagatgcgcagttgtatcagatacattctcagctaaaatgtcaaaggctcacaacaatgctaatatgttatctttaggggaaagagtattaggtaaaggcttagcattagagatagttgaagcttggctaaatacagaatttgaaggtgacagacacttaagaagagtaaacttacttagtgaaatagagaagaaatataataaatag

SEQ ID NO: 3627 - DNA, 495 bp, Clostridium beijerinckii
atgcatgttgaaaaatcacaaaataaattaggagatgatttaattatgaaaattgcaattggatgcgatcatggtggacttgaacttaaaaatgaaatcataaagtttttagaaagtgaaaagcatgagattaaggattttggtacatattcaacaggttcttgcgattatccggatattgcattaccagtagcagaagcggttgctgcaaaggaatatgagtttggtatattaatatgtggtacaggaataggaattggtattgcggccaataaggtaccaggaattagagcagcactatgttcagatacatttagtgcccatgcaacaagagaacacaataatgctaatatattaactatgggccaaagagttgttggagcaggtcttgctttagatatagtaaaaacatttatatcagctaaatttgaaggagataggcaccaaaaaagaatagataagatttcagatattgaaaaaaagtatacacattag

SEQ ID NO: 3628 - DNA, 444 bp, Clostridium beijerinckii
atgatagcaataggggcagaccatggaggatataaattaaaagaatttatcaagggatatttagataaaaactcagtagaatatatcgatgttggcacattttcagaagacagtatagattatcctcagatagctatggatgtagcaaatagggtatctataggagattgtgaaaagggaatactttgttgtggaactggtattggaatgtctattgtagcaaacaaaataaaaggtgtaagagcagcattagttggagattgttttactgcgaaagctaccagagagcataatgattctaatgtactttgtttaggtggaagagtaattggcgaagaattagctttaatgatagtagatatttggttatccacagagtttataggtaagcatcatgttaatagactcaatcaaataaaagaaatagaagaaaaatttaaataa

SEQ ID NO: 3629 - DNA, 450 bp, Clostridium beijerinckii
atgaagcgaatgaaaattgcattaggttgcgatcatggtggcattaatttaaaaggagctataaaaaagcatcttatatctaaaaatatagaggttgaggattttggaactaatagcagtgaaagtgtaaattatcctgaatatgcaattaaggtttctaaagcagtgatatctaaagaatgcgatttgggaatattatgttgtgggacaggaattggaatgtcaattgcagctaataaacataaaggaataagagcagccgtcgttggagattgcttctcagctaaaatgacaagagagcataataatacaaatgttttatgtttaggtgaaagagtaacaggagaaggattagcacttacaattgtagacacttggataaattcaaaatttcaaggtggacgtcattcagaaagacttgctttagtggaagaaattgaaaataagtaa

SEQ ID NO: 3630 - DNA, 459 bp, Clostridium bolteae ATCC BAA-613
atgagaacaattgtaattgggtgcgacaatgctgctgtacatttgaaaaatgaactcatgggattcatggagaaaaagggatatactgtggagaatatgggatgcgacagcactgaggattctacctattatccctatgtggcagagaaggtgtgccaggaaatcataaacagcggttatcagaagcacggtgtgctgatctgcggcacaggcctgggcatggccatgactgccaacaaattcaaaggcatccgcgccggcgtatgccatgatgttttctcagcggaacgtttaaaactgagcaatgacggcaatgtgatctgtatgggcgagcgggtgattggagccgagctggcaaagcggattctggaaaaatggctggaactggaattcgtagactgtgcatccacatccaaggtagaggccatcaaagaaattgaaggcgaaaatctcaaatag

SEQ ID NO: 3631 - DNA, 450 bp, Clostridium bolteae ATCC BAA-613
atggtaatttcggtgggaagtgatcatgccggttatggactgaaggtaaagatgattccgtatctggaatcactgggacatacaatcatcgacaacgggaacaatggagcggaggatgtagtcttttttccggaggtggcaagggctgtgtgccggccggttcttgaagggacggcggaacgcggtattatgttttgcggaaccggagtgggtgcttcggttgcgtgcaacaaaatacccggaatcagggcgtccattgtccatgattaccagtgtgcccatcaatgtgtggagcacgatcatgtaaatgtgatgtgcattggcgaaaaggtggtgggagagtggctggcgaaggatcttctgaaggcattcttggaggcggcaggcgatacagacgaaaggacagcccatgtaattcagctattggcacagatggaccagagacagtaa

SEQ ID NO: 3632 - DNA, 441 bp, Clostridium bolteae ATCC BAA-613
atgaaaattgcaattggtaacgaccatacagccattgagcttaagaacataattaaggagtttgtggaagaaaagggctacgaggtcattgacctgggaaccaattccaccgagagctgcgactaccccatatacggcgaaaaggtaggacgggccgtggctgacggtcaggctgacctgggaatcgccatctgcggcaccggcgtgggcatctccctggcagccaataaggtaaagggaatccgggcctgtgtgtgcagcgagccttataccgcaaagctgtccagagtgcacaacaactccaacgtacttgcatttggcgccagggtagtgggcagcgagcttgccaagatgattacagaggcatggctggacgctgagtttgagggcggccggcatgagcgcagggtgaatatgattatggagattgagaaccggtag

SEQ ID NO: 3633 - DNA, 438 bp, Clostridium botulinum
atgaaaatagctttaggaagcgatcatgcaggattacctttgaaaaatgaaataataaaacatttagaaggtaaaggaatagagataaaagattttggtacatatacagaagaatcctgtgattatccagactatgcacaaaaagttgcagaaaaagttgtagctaaagaatttgattttggaatattagtatgtggaacaggtataggtataagtatagctgctaataaagtcaaaggagttagagcggctttatgtagtgatacttttagtgcgcatgcatgtagagaacataataatgctaatatactagccctaggacaaagagttgtaggagtgggattagcactagatatagtggataatttcttaaatgctgaattccaaggtggaagacatgaaaacagaatcaataaaatgatgagaatagaaaaataa

SEQ ID NO: 3634 - DNA, 450 bp, Clostridium botulinum
atgaaattagcaattggatgcgatcacggtggatttgaattaaaacaagaaattataaaatttctagaaagtgaaggacataaagttaaagattttggtacacattcaacagaatcttgcgattatccagatatatcattaccagtagcagaagctgttgtagctaaggaattcgaacttggaatattagtttgtggtacaggaataggtataggaattgcagctaataaggttccaggaataagagctgcattatgttcagatacatttagtgcacatgcaacaagacaacataataatgcaaatatattaacaatgggtcaaagagttgttggaactggccttgctttagatatagtaaaaacttttatatcatctgagtttgaaggtgatagacatcaaaaaagaatagataaaattagtgcaatagaaactaaatacagtaaataa

SEQ ID NO: 3635 - DNA, 438 bp, Clostridium botulinum
atgaaaatagctttaggaagcgatcatgcaggattacctttgaaaaatgaaataataaaacatttagaaggtaaaggaatagaaataaaagattttggtacatatacagaagaatcttgtgattatccagactatgcacaaaaagttgcagaaaaagttgtagctaaagaatttgattttggaatattagtatgtggaacaggtataggtataagtatagctgctaataaagtcaaaggagttagagcagctttatgtagcgatacttttagtgctcatgcatgtagagaacataacaatgctaatatattagctctaggacaaagggttgtaggagtgggattagcgctagatatagtggataattttttaaatgctaaattccagggtggaagacatgaaaacagaatcaataaaatgatggaaatagaaaaataa

SEQ ID NO: 3636 - DNA, 450 bp, Clostridium botulinum
atgaaaatagctataggatgcgatcacggtggagtggatctaaagagaactgtaattgaacacttacaagaaaaaggaatagaagttaaagattttggaacttatactgaagaatcttgcgattatccagaatacggacaaaaagtagcagaagaagttgtagcaaaaaattatgactttggtatagttatatgtggaacaggtattggtataagtatttctgcaaataaagttccaggagcaagagctgcattatgtcatgatacatttagtgctcatgcaactagagaacataataatgcaaacatacttgcattaggagctagagtaacaggtccaggacttgctttagacatagttgatagtttcttagggtcaacttttgaaggtggaagacatgagagaagaatagaaaagatatctgacattgaaaagaaatactcaaaatag

SEQ ID NO: 3637 - DNA, 450 bp, Clostridium botulinum
atgaaaatagctataggctctgatcatggtggagtaaacttaaagaaggatattattaaacatttacaagaaaaaggtatagaagtaaaggattttggtacttatacagaggaatcttgtgattatccacagtatggacaaaaagtagcagaagaagtagtagcaaagaaatatgactttggtatagttatatgtggtacaggaataggtataagtatatcagcaaataaagtgccaggagcaagagcggcattatgtcatgatacttttagtgcacatgcaactcgtgaacataataatgcaaatatacttgcattaggtgctagagttactggaccaggacttgctttagatatagtcgatactttcttagaatctaaatttgaaggtggaagacatgaaagaagaatagataaaataactgaaattgaaaagaagtatcaaaaatag

SEQ ID NO: 3638 - DNA, 450 bp, Clostridium botulinum
atgaaattagcaatcggatgcgatcatggtggatttgaattaaaacaagaaattataaaatttctagaaagtgaaggacatgaagttaaagattttggtacacatacaacagaatcttgcgattatccagatatatcattaccggtagctgaagctattgtagctaaggaatttgagcttggaatattaatttgtggtacagggataggtataggaattgcagctaataaggttccaggaataagagctgcattatgttcagatacttttagtgcgcatgcaacaagacaacataataatgcaaatatattaacaatgggtcaaagggttgttggaactggccttgctttagatatagtaaaaacttttatatcatctgagtttgaaggtgatagacatcaaaaaagaatagataagattagtgcaatagaaactaaatacagtaaataa

SEQ ID NO: 3639 - DNA, 450 bp, Clostridium botulinum
atgaaattagcaatcggatgcgatcacggtggatttgaattaaaacaagaaattataaagtttctagaaagcgaaggacatgaagttaaagattttggtacacattcaacagaatcttgcgattatccagatatatcattaccagtagcagaagctattgtagctaaagaatttgagcttggaatattagtttgtggtacaggaataggtatcggaattgcagctaataaggttccaggaataagagctgcattatgttcagatacttttagtgcacatgcaacaagacaacataataatgcaaatatattaacaatgggtcaaagagttgttggaactggccttgctttagatatagtaaaaacttttatatcatctgaatttgaaggtgatagacatcaaaaaagaatagataagattagtgcaatagaaactaaatacagtaaataa

SEQ ID NO: 3640 - DNA, 438 bp, Clostridium botulinum
atgaaaatagctttaggaagcgatcatgcaggattacctttgaaaaatgaaataataaaacatttagaaggtaaaggaatagagataaaagattttggtacatatacagaagaatcctgtgattatccagactatgcacaaaaagttgcagaaaaagttgtagctaaagaatttgattttggaatattagtatgtggaacaggtataggtataagtatagctgctaataaagtcaaaggagttagagcagctttatgtagtgatacttttagtgcacatgcatgtagagaacataataatgctaatatactagccctaggacaaagagttgtaggagtgggattagcactagatatagtggataattttttaaatgctgaattccaaggtggaagacatgaaaacagaatcaataaaatgatgggaatagaaaaataa

SEQ ID NO: 3641 - DNA, 438 bp, Clostridium botulinum
atgaaaatagctttaggaagcgatcatgcaggattacctttgaaaaatgaaataataaaacatttagaaggtaaaggaatagaaataaaagattttggtacatatacagaagaatcttgtgattatccagactatgcacaaaaagttgcagagaaggttgtagctaaagaatttgattttggaatattaatatgtggaacaggtataggtataagtatagctgctaataaagtcaaaggagttagagcagctttatgtagcgatacttttagtgctcatgcatgtagagaacataacaatgctaatatattagctctaggccaaagagttgtaggtgtagggttagcactagatatagtggataatttcttaaatgctgaattccaaggtggaaggcatgaaaacagaattaacaaaatgatgggaatagaaaaataa

SEQ ID NO: 3642 - DNA, 450 bp, Clostridium butyricum
atgaaaattgcagtaggttgcgatcatggtggatttgaattaaaaaatgaaattatcaaatatttagaaagtgaaaagtatgaaataaaagattttggtacttattcaactgattcttgtgactatcctgatatagcacaaccagtagcagaagcagtagcagcaaaagagtttgattttgggattttaatttgtggaacaggtattggaatcggaatagctgcgaataaggtgccaggtataagagcagcgctatgctcagatacttttagtgctcatgcaacaagacaacacaataatgcaaatatattaactatgggtcaaagagtagttggtacaggattggcattagatatagtaaagacatttttatcatctgaatttgaaggtgatagacatagtaagagaataaataaaatcacagctattgaagaaaaatatggaaaatag

SEQ ID NO: 3643 - DNA, 450 bp, Clostridium carboxidivorans P7
atgaaaattgctttaggaagtgatcatgctggattgcctttaaaaaaggaaattataacccatttagaaggtaaaggtattcaaattgaagattttggtacttatacagaatcatcatgtgattatcctgaatttgcactaaaggttgcagaagaagtagctgctaaaaattttgattttggtatattggtttgtggcacaggtataggaataagtatagctgctaataaagtacctggaataagagctgcagtatgtggtgatacatttagtgctcatgcctgcagagaacataatgatgccaatatattaacattaggtcaaagagtagttggtttaggattagcattagatatagtagacattttcctagatacaaaatttgaaggtggtagacaccagaaaagaatagataaaatttcagatattgaaaaaaagtattctaaataa

SEQ ID NO: 3644 - DNA, 459 bp, Clostridium cellulolyticum
atgtctatagctataggttgtgatgaagcaggatttcaattcaaggaagtaataaagaatcttttattagaaaaagggttggatgttgaagattttggagtatataatacagaccctgtgctatatcctgatattgctgttgccgttgcaaagtcaatatctgaaggaaaacatgaaagagggatattgatttgcggaacaggtataggaatggccattgctgccaataaagttccgggtataagagcggccgtttgtcatgactctttctcaactgaacgttccagaaaaagcaacaatgcacagattatggcccttggggcacgtgtaatcggaatagagctggcaaagcttctggtggatttatggctggagtgtgaatttggtggcggtggttcagaggcgaaagtcaataaaatcatggagtacgaaaatgaatttttaaaaagttgtagataa

SEQ ID NO: 3645 - DNA, 450 bp, Clostridium cellulolyticum
atgattgcaataggaagcgaccatgcgggatatctgctaaaagctgatattataaagtttttggaaagcaaggggcttgaggtaaaggactttggtacaaactgtccggactcagttgattaccctgattatggacgggctgtagcggaggctgtggcaagtaaggaatgtgaaaagggtattttaatatgcggtaccgggattggaatatcaatagctgccaacaaggttcccggtgtaagagcagcgttgtgtaccgatagctatatggcaaaaatgtgcagacagcataacgatgccaacataatcgctataggcgaaagagttgtaggaccgggacttgctttcgatataattgaaacgtggctggaaacagagtttcttggtggaaggcaccaaaacaggctggacaaaatttcagacattgaaaaaaaatatttgacaaagtga

SEQ ID NO: 3646 - DNA, 450 bp, Clostridium cellulovorans
atgaaaatagcattaggatcagaccatgctggatttcaactaaaaaatgcaatacaaaaacatcttatagaaaaaggaatagaagttaaggactttggaacagagtcagaagcttcttgtgattattcagattttgctttaaaggttgcagaagaagttaaagataagaattttgattttggaattcttgtttgtggaacaggaataggaataagtattgcagcaaataaagttccaggaataagagctgctttatgccatgatacttttagtgctcattctacaagacaacataataatgctaatatattggctatgggtgcaagagtagtaggtgaaggtttagctttagatatagtagatatatttttaaacacagaatttgaaggtgaaagacatcaaagaagaatcgataaaataagtttaatagaacaaaaatataacaaatag

SEQ ID NO: 3647 - DNA, 453 bp, Clostridium difficile
atgaagataggattaggctgtgaccatggaggatataatttaaaaaaagaaataataagctatttagaaagtaaaggtatagaatgtgtagattatggaactaataatgctacagattctgttgattatcctgtttatggagaaatagttgcaaattcagttataaataaagaagtagattatggaatattatgttgtggtacagggataggaatatctttagctgctaataaggttcctgggataagatgtgcagttgtatcagatgtattttctgcaaaaatgtcaaaagcacataatgatgcaaatatgttatcattaggcgaaagagttttaggaaaaggtctagcacttgagatagttgaagcatggattaatacggattttgaaggtgatagacatgctagaagagtaaacatgattaaatcaatagaagaaaaacataataaataa

SEQ ID NO: 3648 - DNA, 447 bp, Clostridium difficile
atgaaaatatctattggatgtgaccatggtggttatgaattaaaggaatatataaaggaaaatttaataaataaaggtatagaagttgaagatgtgggtacaaattcaaaagaaagtgtagattttccaatatatgcaaaaaaggtaagtcaaaatgttcaaagtaaaaaatctgatttaggcatactttgttgtggaacaggaataggtatgtctattgcagcaaataagtttaaaggaatcagagcagctgttgtttctgactgtttttcagctaaggcaactagagaacacaataatacaaatgtactttgtttaggagaaagagttattgggaaaggattagcaatgagaattgttgaagaatggttaaattcaagttataatggagaaagacatgcaagaagattacaaatgattgatgatatagaaaaagaaaatttataa

SEQ ID NO: 3649 - DNA, 453 bp, Clostridium difficile
atgaagataggattaggctgtgaccatggaggatataatttaaaaaaagaaataataagctatttagaaggtaaaggtatagaatgtgtagattatggaactaataatgcgacagattctgttgattatcctgtttatggagaagtagttgcaaattcggttataaataaagacgtagattatggaatattatgttgtggtacaggaataggaatatctttagctgctaataaggttcctgggataagatgtgcagttgtatcagatgtattttctgcaaaaatgtcaaaagcacataataatgcaaatatgttatcattaggagaaagagttttaggaaaaggtctagcacttgagatagttgaagcatggattaatacagattttgaaggtgatagacatgctagaagagtaaatatgattaaatcaatagaagaaaaacataacaaataa

SEQ ID NO: 3650 - DNA, 447 bp, Clostridium difficile
atgaaaatatctattggatgtgaccatggtggttatgaattaaaggaatatataaaggaaaacttaataaataaaggtatagaaattgaagatgtgggtacaaattcaaaagaaagcgtagatttcccaatatatgcaaaaaaggtaagtcaaaatgttcaaagtaaaaaatctgatttaggtatactttgttgtggaacaggaataggtatgtctattgcagcaaataagtttaaaggaatcagagcagctgttgtttctgactgtttttcagctaaggccactagagaacacaataatacaaatgtactttgtttaggggaaagagttattggaaaaggattagcaatgagaattgttgaagaatggttaaattcaagttataatggagaaagacatgcaagaagattacaaatgattgatgatatagaaaaagaaaatttataa

SEQ ID NO: 3651 - DNA, 456 bp, Clostridium hathewayi DSM 13479
atgaaagaggagtttatctatattggcagtgatcacggcggattctcattaaaacaggtgatcaaagactgcctcgacaggaaagggattctgtataaggacgtcggatcggattctgctgaaattgtaaggtatcccacatatgcggaggaagttgcactggctgtatcagaacatcgtgccacaagaggaatactgatctgttctactggtattggaatgagtattgtggctaaccgtttcaagggagtgagggcgtcactctgtactgacagttatatgggaaaaataaccagggcacataacgactctaatatattatgcttaggagggaaaataaccggagaattggaagctgttgatatcctggagaactggcttaccactgagtttgaaggaggacgccatacgatttctctggggctgattgaagaacttgactgtaacgggaaatga

SEQ ID NO: 3652 - DNA, 438 bp, Clostridium hathewayi DSM 13479
atgagaataggaatcggatgcgaccacggcggttatgagatgaaggaagaactgaaaaaaagactgaccggcggcggacatgcagttacagataaaggaatttacagtgtcagcgaggtggactatcctgacgtggccgcagaagtggcagagggagttgtcgccggagagtacgactgcgcgattctggtatgcggaacggggatcggtatgagcattgcggccaacaaggtggatggaatccgtgctgcgctggtgacggacacgttttcagccagaatggcaaaggagcataacaatgccaacatcatcacgctgggagccagaacggtgggaatcgaactggcgtgggaactggtgaacgcgtatctgggagcggaattcctgggagggaagcatctggtacgggttgagaagattatggggatggaaaagtaa

SEQ ID NO: 3653 - DNA, 456 bp, Clostridium hathewayi DSM 13479
atgaaaatcgcaataggaaatgatcatacagcactggaaatgaagaatgagatgaagaaatttctggaggaaaagggatacgaagtaatcgattacggcacaaattccacggagagctgcgactacccggtttacggtgaaaaagtggggaacgcggtggccggcggagaggcggacttagggctcgccatctgcggaaccggagtaggcatctctctggcctgcaacaaggtaaaggggatccgctgctgcgtctgcagtgagccgtatacggcaaagctttccagaatgcacaacgactccaacgtcctcgcctttggcgccagagtcatcggcgtggagatggcaaaaatgattacggaagaatggctgaatgccaaatacgaaggcggaaggcaccagagacgcgtggatcaggtgatggatatcgagagacgtaaccagaacgcgcggtag

SEQ ID NO: 3654 - DNA, 468 bp, Clostridium hiranonis DSM 13275
atggaggattttaaaatgaaaatagcattagcttgtgaccacggtggatacgatttaaaaatggctataatagctcaccttgaaaaaagagggatagaagtaatggatcttggaactaacaatgcaacagattcagtaaactacccagaatatggagaagctgcagctcttaaagttgctaacggagaagctgactgcggaatattagtatgcggaacaggaataggtatatctttagcagctaacaaagttcctggaataagatgtgctgttgtaagtgatactttctcagctagaatgactaaagctcataacaatgcaaacatgcttgcaatgggtggaagagtagttggaccaggactagcacttgacatagtagatgcataccttgatacagaattcgaaggtggaagacatcagactagagtagatatgttaatggatatagaaaaaaaatacacaaaataa

SEQ ID NO: 3655 - DNA, 441 bp, Clostridium hylemonae DSM 15053
atgaagattgcaatcggctgtgacccaaatgcacaggaggcaaaagaagaattgatcaaattcatggaagaaaagggctatggagaaattacagattttggaagcgaagatccgatatatgccaacacagcagtaaaagtagcagaggctgtggcttcaaaagagtatgacagaggcattctgatctgcgggacaggcatcggtgtgtccattgcggctaataaagtcaaaggcgcgtatgcagccctgctttctgacgtatattccgctaaaagagcacgcttgagcaacgatgccaacatcgcctgcatgggcgcgttcaccatcggcaataagctgagagaagaattgacagatgcgttccttacaaacgactttgtgcctggctgttcctcacagccaaaagttgacgcatttgtagaatatgataatgcgcggtag

SEQ ID NO: 3656 - DNA, 474 bp, Clostridium hylemonae DSM 15053
atggaagagaggagaacgaacagaatgatgaaaattggaattggcaacgaccatgcggcagtcgatatgaagaatgaagtggtggaatttctcaaagaaaaaggttatgaagtagtaaatttcggcacggataagaaagagagcagcaattatccggaatacggcaggaaggtggcggaggcggtcgccgcaggggaggttgatctgggaattctcatctgcggaaccggagtcgggatatcccttgcagccaacaaagtgaaaggaattcgcgcagtcgtttgttcggagccatattctgcgaaactgtccagacagcataacaatacgaatgtgctggcgttcggagcgcgtgtcatcggcattgaactggcaaagatgataatagaagaatggctgaatgcagagtttatgggaggcagacatcaggaccgtatcgatatgataacggaaattgaaaatgaaaacgaataa

SEQ ID NO: 3657 - DNA, 450 bp, Clostridium kluyveri
atgaaaattgctttaggtagtgaccatgcgggtttccctttgaagaaagaaataatagaacatttaaaaaataaaggcttagagcttgaagattttgggactttctcagaagaatcctgtgattatccagattatgcattaaaagttggagagcaggttgtaagtaaaaattatgattttggaatattggtgtgtgggaccggcataggaataagtatagctgcaaataagataccaggagtgagagctgcactttgtggggacactttcagtgcccacgcctgtagagagcataataatgctaacatactagctataggtcaaagagtagtaggtgtaggacttgcccttgatatagtagataattttttatttactgagtttcaaggaggtagacatcagaaaagaatagataaaataggagaaatagagaaaaaatacagcagataa

SEQ ID NO: 3658 - DNA, 465 bp, Clostridium kluyveri
ttggaggtattttttatgaaaattgctttaggtagtgaccatgcgggtttccctttgaagaaagaaataatagaacatttaaaaaataaaggcttagagcttgaagattttgggactttctcagaagaatcctgtgattatccagattatgcattaaaagttggagagcaggttgtaagtaaaaattatgattttggaatattggtgtgtgggaccggcataggaataagtatagctgcaaataagataccaggagtgagagctgcactttgtggggacactttcagtgcccacgcctgtagagagcataataatgctaacatactagctataggtcaaagagtagtaggtgtaggacttgcccttgatatagtagataattttttatttactgagtttcaaggaggtagacatcagaaaagaatagataaaataggagaaatagagaaaaaatacagcagataa

SEQ ID NO: 3659 - DNA, 450 bp, Clostridium leptum
gtgaaaattgccattggttgtgacgaagcgggctgtggtttaaagcatattatcattgatctgcttcaaaaggaaggaatcgaagtgacagacgagggatgtcgggatgacgaagtggtgctctatcccaacattgccgaaagggtggctaacatcgtggcggacggcgaggcggaccgcggtattttaatctgcggcaccggcatcggcatggcgatggccgccaataaggtgaaaggaatccgggcagctgtttgtcatgatcccttttctacggaacgctcccgcaaaagcaatgacgcccagattatgtgcatgggcgccagagtcattggcccggagctggcgaaaatgctggtgaagctatggctgacctgtgattttgccggcggcggctctgctcccaaggtggaagccatcaatcagatggaagaaaaatatttcaaataa

SEQ ID NO: 3660 - DNA, 492 bp, Clostridium leptum
atggataaaagaatcattatcggcgcggatgacagcggctttactctaaaagaggccgtaaaggaacacttattaaaaaacggctacgatgtaaccgatgtcggcacactgtcattagatgagcctgtggtatactatgaggttgggcgccgtgtcgccaaagaagtagccgataaaaaattcgagcgcggcctgctgttttgcggcaccggcatgggtgttaacctagtcgccaataaatttcctggagtttactgcggactctgcgagagtgttttcgccgctaaaaagtgccggattatcaataactgcaatgttcttgccatgggcggatttattgtcgggcctaaaatgggtatcgaaatggccgaagccttcttaaataccgatttttcctatgggttcgatcttgccaccccagaatttctgcaaaacgccgttaaggagatagatcagatctcggcggatgtgcttaaggagtacagcaaataa

SEQ ID NO: 3661 - DNA, 447 bp, Clostridium leptum
atgatcgcgttaggagcggaccatggcggttaccgtttgaaagaagcggtaaaggcttatttagaagaaaagggaatcccatataaggatttcggaaccgacagcgaggaatcggtgaattacggaccttacgcttaccgggtggcccagtctattgtatcaggggaatgtgaaaagggcgtgctttgctgcggcacggggatcggaatctccatcgcggccaataaggtgaaaggtattcgcgcggcagtgtgtaccaatgaattctgcgcggaaatgaccaggcgccataacgatgcaaatattctggcgatgggcggccgtgtgatcgacgagaaaaccgcggtgaagcttgcggatatctttttaaatactccctttgagggcggcaggcatttagagcggattcagcagatcgccgccattgagaacggagaaaaattgtag

SEQ ID NO: 3662 - DNA, 438 bp, Clostridium methylpentosum DSM 5476
atgatagcgttaggcagcgatcacggcggtttcgagctcaagcgggaaatcgccaattatttgactgaacggggcatcccgtttgaagactttggaacccactcccccgactcgtgtgactaccccgacatggcggttgagccctgcgaggcggtggcgaacggcaggtgcgaccaggcgattctcatctgcggcaccggcatcggcatttcgatggccgccaacaaaatccacggtatccgcgccgccgtctgttccgattacttttcagccaaatacacccgtctgcacaacgacgcgaatgtgctctgcttgggcgggcgcgtcgtcggcccagggcttgcctgcgagctcgtcgaggtgtttttgaacaccccgtttgaggggggccgccattccggccgaatcgaaaagctcatgaaacttgaggagaaataa

SEQ ID NO: 3663 - DNA, 426 bp, Clostridium nexile
atgatagcaattggatgtgatcatggtggatatgatttgaaattggagatcataaaatatttagaacgagaagggcttgcatataaagacttcggctgcaatggagaatcggtagattatccaatttatgcgagaaaagtgggacaggctgttttggatggcgagtgtgaaaaaggaattttgatttgcggaaccggaattggtatttccatcgctgcgaataagatgaaaggaatccgttgtgcactttgttctgactgcttttctgcggaagctacaagacttcacaatgacgcaaacatcattgcattggggggacgtgtattaggtccggaacttgcagtgaagattgtggatacctttttgaagactccgttttccggagatgagcgtcatgtacgacgcatttcgatgattgaagaataa

SEQ ID NO: 3664 - DNA, 450 bp, Clostridium novyi
atgaaaatagctataggatgcgatcacggtggagtggagctaaagaaaactgtaattgaacatttacaagaaaaaggaatagaagttaaggattttggaacttacactgaagaatcttgtgattatccagaatacggacaaaaggtagcagaagaagttgtagcgaaaaattatgattttggtatagttatatgtggaactggtattggtataagcatatctgcaaacaaagttccaggagcaagagctgcattatgtcacgatacatttagtgcacatgcaactagagaacacaataatgctaacatacttgcattaggagctagagtaacaggaccaggacttgctttagatatagttgatgctttcttaggagcaacttttgaaggtggaagacacgaaagaagaatagataaaatatctgaaattgaaaagaagtattcaaaatag

SEQ ID NO: 3665 - DNA, 459 bp, Clostridium papyrosolvens
atgtcaattgctataggctgtgatgaagcaggatttcaatttaaggaagtaataaagaagcttttaatagaaaaagggttagaggttgaagattttggagtatatagtaccgaccctgttctataccctgatattgccgttgccgttgcaaagtcaatagctgagggaaaacatgaaagaggaattttgatttgcggaacgggtataggaatggccattgctgccaataaagttcccggtatcagagctgccgtctgccatgattccttctcaactgagcgttcaagaagaagcaataatgcgcagataatgacgctcggtgcacgagtaatcggaatagagcttgcaaagcaactggtgaatttatggttgggatgtgaatttgacggtggaggttcagaagcaaaagtaaataaaatttcagaatacgaaaatgaattttataaaagctgcagataa

SEQ ID NO: 3666 - DNA, 477 bp, Clostridium papyrosolvens
atgaaaaaaataattattggttccgacaaatcaggttttccattaaaggaagctataaaagcacatttgacacagttgggttatgaagttactgacggtggcacactcaacgaagaggaacccaaaccatattttgaagtagcttcggcagttgcaaagagagtatcagacggggaatttgaaagagctgtattaatctgcggtaccggtatgggagtatcaattgttgctaataagcacaagggagtgtatgcagcagtttgtgaaaatacatatgctgctgaaaaagccagagctataaacgatgctaacattttatgccttggcggctggcttactgccgaaattgtgggctgtgccatggtagacaccttccttaatacggaatttacacagaaccttgaagaatggcgagcaaagaatttaagaaatgcaagaatacaagttaaaaatattgaagatgagatttataaataa

SEQ ID NO: 3667 - DNA, 450 bp, Clostridium papyrosolvens
atgattgcaattggaagtgaccatgcgggatatctgttaaaagcagatattataaagtttttggagagcaagggacttgaggtaaaggactttggtacaaactcaccggattcagttgattatcctgattatggacgagctgtggcagaggctgtagccggtaaagaatgtgaaaaaggtattttaatatgcggtaccgggattggcatttcaatagctgccaataaggttccgggtgcaagagctgcattgtgtaccgacagctatatggcaaaaatgtgcaagcagcacaatgatgccaatataatcgctataggcgaaagagttgtaggaccgggactagctctcgatataattgaaacatggctggaaacagaatttcttggtggaagacaccagaacaggcttgaaaaaatttcagacattgaaaaaaaatatttgacaaagtga

SEQ ID NO: 3668 - DNA, 465 bp, Clostridium perfringens
atggaggttaatgaaatgaaaatagcaattggttgtgatcatggtggatttaatttaaaaaacacagtgataaaacatttagaagaaaaaggtattgaggtaaaagattttggtacatacagcacagattcttgtgattaccctgatatatctatacaggttgcagaagctgtagctaaaaaagaatttgaatatggtatattaatctgcggaactggtataggaatatctatagcagcaaataaagtgccaggaataagagcagcattatgttctgatacatttagtgctcatgcaacaagacaacataacaatgcaaatattctagctattggtgagagagttgtaggaccaggattagcgttagatatagttgatactttcttaaattcagaatttgaaggtggaagacaccaaaatagaatagataaaataacagctattgaagaaaagtattcaaaataa

SEQ ID NO: 3669 - DNA, 450 bp, Clostridium perfringens
atgaaaatagcaattggttgtgatcatggtggatttaatttaaaaaacacagtgataaaacatttagaagaaaaaggtattgaggtaaaagattttggtacatacagcacagattcttgtgattaccctgatatatctatacaggttgcagaagctgtagctaaaaaagaatttgaatatggtatattaatctgcggaactggtataggaatatctatagcagcaaataaagtgccaggaataagagcagcattatcttctgatacatttagtgctcatgcaacaagacaacataacaatgcaaatattctagctatgggtgagagagttgtaggaccaggattagcgttagatatagttgatactttcttaaattcagaatttgaaggtggaagacaccaaaatagaatagataaaataacagctattgaagaaaagtattcaaaataa

SEQ ID NO: 3670 - DNA, 450 bp, Clostridium perfringens
atgaaaatagcaattggttgtgatcatggtggatttaatttaaaaaacacagtgataaaacatttagaagaaaaaggtattgaggtaaaagattttggtacatacagcacagattcttgtgattaccctgatatatctatacaggttgcagaagctgtagctaaaaaagaatttgaatatggtatattaatctgcggaactggtataggaatatctatagcagcaaataaagttccaggaataagagcagcattatgttctgatacatttagtgctcatgcaacaagacaacataacaatgcaaatattctagctatgggtgagagagttgtaggatcaggattagcgttagatatagttgatactttcttaaattcagaatttgaaggtggaagacaccaaaatagaatagataaaataacatctattgaagaaaagtattcaaaataa

SEQ ID NO: 3671 - DNA, 450 bp, Clostridium perfringens
atgaaaatagcaattggttgtgatcatggtggatttaatttaaaaaacacagtgataaaacatttagaagaaaaaggtattgaggtaaaagattttggtacatacagcacagattcttgtgattaccctgatatatctatacaggttgcagaagctgtagctaaaaaagaatttgaatatggtatattaatctgcggaactggtataggaatatctatagcagcaaataaagtgccaggaataagagcagcattatgttctgatacatttagtgctcatgcaacaagacaacataacaatgcaaatattctagctatgggtgagagagttgtaggaccaggattagcgttagatatagttgatactttcttaaattcagaatttgaaggtggaagacaccaaaatagaatagataaaataacagctattgaagaaaagtattcaaaataa

SEQ ID NO: 3672 - DNA, 429 bp, Clostridium phytofermentans ISDg
atgatagcactaggttgtgatcatggtggatatgatttaatgcaggaagtaattgcatacttagaggagaagaaggttccatataagaattttggaactgattctaaagcatcttgtgattacccggtttttgggaaaaatgttgctatggcagttgcaaataaggaatgtgaattcgggatcttgatttgcggaactggtattggtatctccatggcagcaaataaggtagcaggagttcgagcggcattatgtcatgactgttttagcgcagaagcaacaagacaacacaataatgcaaatgtactatgcatggggggaagagtggttggacctggtcttgcattaaagatcgtcgaaatctttttaaacacagaattttccaatgatgatagacatataagaagaatctctatgttggagaactaa

SEQ ID NO: 3673 - DNA, 462 bp, Clostridium scindens
atgaaaatagcaattggatgtgatccgaatgcacagacggtaaaagaagagttaattaagtatattgagaagaagggatatggagaggtcactgattttggcagtgaagatcccatatatgcacatacggctataaaagttgcggaaagtgttgctgcaaaggaatatgacagaggaatcttaatctgtggtacgggtattggtgtatctctggcagcaaataaagtaaaaggagcttatgcggcactgatttcagatatatattctgctacaagagcaaggctcagcaataatgcgaatatagcatgcatgggggcctttactacggggagcaaggtgagagaaggaatggtggatgcctttctgacgaatgaatttgtttcggggtgtgcatcccagccgaaggtagatgcgttcgttgcttatgataatagtcgtgaaaatggtaatggacaaaagtaa

SEQ ID NO: 3674 - DNA, 441 bp, Clostridium scindens
atgaaaattgcaattgggtgcgatccaaatgcacaggccgccaaagaagttttaatcaagtatattgaagcgaagggatacggcgaggtgaaggatttcggaagcgaggatcctatttatgggcatactgcttttgcagtagcggaggctgtggcagcgaaagaatacgacagggggattcttctctgtgggactggaattggtgtttctatcgcggcaaacaaagtcaagggcgcttatgcggcgctggtttccgacgtatactctgcccagcgcgcaagattgagcaatgatgcgaatattgcatgtatgggcgcttttacgaccggggataaggtgagggaacttctggtggatgcgttccttggaaatgagtttgagacgggctgtgcctctcagccaaaggtagatgcgtacgtgaagtacgatcaggaaagataa

SEQ ID NO: 3675 - DNA, 441 bp, Clostridium scindens
atgaagataggaatcggtaatgaccatgccgcggtggacatgaagtttgagatagcagattatctgaaggaactgggctatgaagttgtaaattacggtacggataagaaggaaagctgcaactatccggaatacggtgaggcggttgccagggcagtggcgtcgaaggaagtagatctgggcatcctgatctgcggaaccggagtggggatctctctggcggccaacaaggtgaagggcatccgtgcggctgtatgttccgagccggcaacggcaaggctctccagacagcacaataatacgaatatcctggcgtttggagcccgcatcgtagggatggaactggcgaaggatattgtgaaggcatggctggatgcagagtttgagggcggacgccatcagacgagggtagacatgattatggagattgaagataagtaa

SEQ ID NO: 3676 - DNA, 450 bp, Clostridium sp. 7_2_43FAA
atgaagatagcaataggttcagatcatggtggagttgaattgaagaaagaaataaaaaaatatctagtaacagaaggacatgaagtaaaagattttggtactaactctactgaatcatgtgattatcctgattatgcactaccggtagcagaagcggtagttgcaaaagagtttgattttggaattttaatatgtggaacaggtataggtataggtattgcagcaaataaggtacctggagttagggctgcattatgttctgatacttttagtgcgcatgcaacaagagaacataatgatgctaatatattgactcttggtcaaagggtagttggaccagggctagcattagatatagtaaaaacatttttaaataccgagttccaaggtgaaagacatcaaaatagaattgataaaataacagagatagagaaaaaatattataaataa

SEQ ID NO: 3677 - DNA, 513 bp, Clostridium sp. L2-50
atgaaaaaagttaacatagaaaaaacgggttgggtgacaaccacccgaaaagattttgaaaacaagaaaggcaggacaaagaatatgatagcacttggatgtgaccatggtggatacggattaatgcaggatgtgatcaagcatctggaagaaagaggactggaatacaagaattacggatgctacagcgaggaatccgttgattatccggtatatgcaaagaaagttgcacatgcagtagcagacggagaatgtgagcgaggaatcctgatctgcggaacaggaatcggaatctctattacagcaaataaagtaccgggaatccgtgcggcactttgtggcgattgcttcagtgcacaggcgacaagagagcataacgatgccaatatccttgcaatgggtgcccgtgtaaccggaccgggactggcactcaagattgttgacaccttccttgatacaccattctcaaatgacgaacgtcatatcagaagaatcaagatgattgaagagtaa

SEQ ID NO: 3678 - DNA, 453 bp, Clostridium sp. SS2/1
atgaaaatagcgatcggatgtgatgaagccgcttattctttaaaaaagatcatcattgatcatttatcaaaccgtgatgatgttgaactaaaagattttggtgccgaagcaggtgaggttgttttataccctgatgttgcaaaagtcgtagcggaagcagttgcttctggcgaatttgaacgcggaatccttgtatgtggaactggtatcggaatgtgcatcactgcaaataagattcctggaatccgtgcagctgtctgccatgatcctttctctacagaaagatcaagaaaaagcaacaatgcacagatcatgtgtatgggtgaaagagttatcggccctgaacttgcaaaatatcttgttgatatctggctcaaatgtgattttgccggcggcggatcaactccaaaagtaaaccgtatcaatgaaattgatgctgaatataaaaaatag

SEQ ID NO: 3679 - DNA, 453 bp, Clostridium sp. SS2/1
atgaaaatatcattgggatgtgacgaagcagcttatcagttaaaagaaacaatcaaacaacatcttcaggaagcaggacatgaagtcattgataatggagtaggagaaggggaagttgaattatacccggatgttgcagtaagaacctgtaagaaagtaacagacggtacttgtgatcgaggaattcttgtatgtggaacaggaatcggaatggcaatgacagccaataaagtgccgggaatccgagcagcagtttgccatgatccattttcaacagaacgttcgattttgagtaatgatgcaaatgtcatgtgtatgggagcaagagtcattgcaccacagttggcactttatttattagatatctggatgggacttacattcaaaaatggaccatccacaccaaaagtagaaagaatcatggaatatcagaaagaattttgtggaaaatag

SEQ ID NO: 3680 - DNA, 438 bp, Clostridium sporogenes
atgaaaatagctttaggaagtgatcatgcaggattacctttgaaaaatgaaataataaaacatttagaaggtaaaggaatagaaataaaagactttggtacatatacagaagaatcctgtgattatccagattatgcacaaaacgttgcagaaaaggttgtagctaaagaatttgattttggaatattagtatgtggaacaggtataggtataagtatagctgctaataaagtcaaaggagttagagcagctttgtgtagtgacacttttagtgctcatgcatgcagagaacataacaatgctaatatattagctctaggccaaagagttgtaggtgtagggttagcattagatatagtagataatttcttaaatgctaaattccaaggtggaagacatgaaaatagagttaacaaaatgatgggaatagaaaaataa

SEQ ID NO: 3681 - DNA, 450 bp, Clostridium tetani
ttgaaaattgcattaggaagtgaccatgcagggttaaagcttaaaaaagaaataataaaacacttagaaggaaaagacatagaacttaaagattttggtactgacgcagaagaatcttgtgactatccagattatgctaaagaagtagcaaatcaggtagctgataaaaattatgatttaggtatattaatttgtggaacaggcataggaattagtattgcagctaacaaagtaccaggtataagagcagctctttgttctgatacttttagtgcccattcttgtagagaacataataatgcaaatatattagcattaggagaaagagtagtaggtttaggattggcattagatatagtagatacttttctatcctctgaatttcaaggaggaagacaccaaaaaagactagataaaataagtggtatagaaaatagttttcataaataa

SEQ ID NO: 3682 - DNA, 471 bp, Anaerococcus hydrogenalis DSM 7454
ttgataaataaaaaggagaataaaatgagagaatacattattggatgtgactgcgcagcagtagaattaaaaaatacaattaaagaattattagaaaatgaaggtatcaaagttgaagatgttggagtaaaaacagttgaagatggaacctactatccaaatgttgcaaaaactctttgcgaaaaaatccaagaatctgactatgaaaaaagaggaatccttgtttgtggtacaggtataggaatggcaatatctgctaataaatgtaagggaattagagcagctgtttgccatgaccaatattcaggagaaagagctgtattatcaaataacgcaaatgtattttgttttggccaaagagtaataggaccagaacttgctaaaaaaattgtaaaagaaattattagcctagaatttaaagatggttcttcaacacctaaggttgaagctataaatgcattagaaaagtaa

SEQ ID NO: 3683 - DNA, 444 bp, Anaerococcus hydrogenalis DSM 7454
atgaaatatataataggtaatgatcatggtggaattgatcttgttgatagcgttgaagaaaagcttttagagcttgggcacgaagtagaaaaaattggaacatacacaaaggattcttgtgattatccagattttgccaaagaagcttgtgaaaaagttttatccaatcaagcggattttgctattttaatttgtggtacagggattggaatgagccttgctgcaaataaatttaagggaataagagcagcttgtgtatctgatgtattttcagcaaaaatgtctagagcccacaataattgtaatgttttatgttttggatctagggttataggatctgaagtagctaaaatgattgtggaagtttttgcaaatacaaagtttgaaggcggaagacacagcaatagagtagaaaaaattacagaaatagaggagaaaaattaa

SEQ ID NO: 3684 - DNA, 444 bp, Anaerococcus lactolyticus ATCC 51172
atgaaatttgttatagctaatgatcatggtggtattgatttacagcctgctgtttgcgaaaaacttcaagagcttggacatgaagttgtccatgtaggtacatatgataaagaatcttgtgactatagtgattttgctgtcaaagcttgtgaaaaagttatcaataacgaagctgattttgctattctaatttgtggtacaggcttaggcatgtctatttctgcaaacaagatcaaaggaattagagctgcttgtgtttctgaaccattttcagcaaagatgagtagggcacataacaatgctaatgtattatgtattggagctagagttattggaagcgagctatgtaaaatgatagtagaagagtttgcaaaaactccatttgagggtggacgccatcaaagacgcgtagataaaatttgtaaaatagaagaggaaaattga

SEQ ID NO: 3685 - DNA, 450 bp, Anaerococcus prevotii DSM 20548
atgaaatatgtaataggaaatgaccatggaggtcttgatttagaagaagtagtaaaggatgaattagaaaagcttgggcatgaggtttatcatgtaggagcttatgatagtgagtctgtagattatagcgattatgcaaaaaaggcttgtaccgaggtgattgaaggaagagctgattttgctatcttaatttgtggtactggacttggtatgagtatctcagcaaataagattcagggtattagggcagcgtgcgtttctgaagcttactcagcaaggatgagtagggctcataataatgctaataccctatgtatgggagctcgcgtcataggctctgaaacatgtagaatgattgtagatgaatttgtcaatactaaatttgaaggcggaagacatcaacgaagagtagataaaattatggatatagaaaaatccaataaagcttag

SEQ ID NO: 3686 - DNA, 441 bp, Anaerococcus tetradius ATCC 35098
atgagatatgtaattggtaatgatcacggcggacttgatttagtagaagttgttaaagatgaacttgaaaaattaggtcatgaagtcgatcatgtaggagcttttgataataaatcagtagactatagtgattttgcaaaaaaagcttgtgataaaataatagaggaaaaagctgactttgctatcttgatttgtggtactggtcttggtatgagcctatcatctaataaaatcaaggggattagggctgcttgtgtttccgaaagctattctgcaagaatgagcagggcccataacgacgctaatgtattatgcataggagcaagggttataggaagtgaaacttgtagaatgattatagatgaatttgtaaaaacaaagtttgaaggtggtaggcaccaaagaagagtagataagattatggagcttgaaagaatataa

SEQ ID NO: 3687 - DNA, 444 bp, Anaerococcus vaginalis ATCC 51170
atgaaatatataataggaaatgatcatggtggtattgatctagttgatagcgtagaagaaaaacttttagagcttggacacgaagttgaaaaagttggaacatttacaaaagaatcttgtgattattcagattttgcaaaaattgcatgcgaaaaagttttaaacaaagaagcagattttgctgttttaatttgtggtacaggaataggaatgagccttgctgccaataaatttaaaggcataagagcagcttgcgtgtctgagacatattctgcaaaaatgtctagagcgcacaataatagtaatgttttgtgcataggttcaagagtaattggctcagaagttgcaaaaatgattgttgagatttttgctacaacagaatttgaaggcggacgtcatcttaaaagagtaaataaaatcaaagaaattgaggagaataattaa

SEQ ID NO: 3688 - DNA, 453 bp, Finegoldia magna ATCC 29328
atgaaaatagcaatagcagccgatcacggtggatttgaattaaaagattcaatggttgaatatataaaaagtttgggaaatgaagttgtggatttgggaacaaattcagctgattcagtagattatccagattatgcaaagaaagtttgcgaagaaatccaaaaaggaaattctgatttgggaattttgatttgtggaacaggtattggcatgagcttggctgcgaacaaattcgaaggaataagagcggcttgtgtgtctgatgtgtacagtgcgaaaatgagcagaaatcacaataatgcaaatgtgctttgcattggagcgcgtgtaattggagatgaggttgctaaacttatcatcaaaactttcttggaaaatgaattcgaagctggtcgtcaccaaagaagagttgacaagataatggctttcgaaaaagaaaacaagggattataa

SEQ ID NO: 3689 - DNA, 453 bp, Finegoldia magna ATCC 53516
atgaaaatagcaatagcagccgatcacggtggatttgaattaaaagattcaatggttgaatatataaaaagtttggaaaatgaagttatggatttgggaacaaattctgctgattctgttgattatccagattatgcgaagaaagtttgcgaagaaatccaacaaggaaattctgatttaggaattttgatttgtggaacaggaattggtatgagcttggcagcaaacaaatttgaaggaataagagcagcatgtgtgtctgatgtatacagcgcgaaaatgagcagaaaccacaacaacgcgaacgtactttgcatcggagcacgtgttattggagatgaggttgccaaactaatcatcaaaactttcttggaaaatgaattcgaagctggtcgtcaccaaagaagagttgacaaaataatggctttcgaaaaagaaaacaagggattataa

SEQ ID NO: 3690 - DNA, 432 bp, Parvimonas micra ATCC 33270
atgaaaataataataggtaatgatcactctgcagttgaaatgaaaaatgaattagtaaaatttttagaagaaatgggacatgaagttataaatgtaggaacagatggaactgaaagtgtggattatccactttttggacaagctgtttgtaaaaaagttttagaaaataaaaattctttaggaattgcaatttgtggaacaggaattgggatttcaatagcttgtaataaagtaaaaggaattcgtgcaggtctttgcagtgaaagtttttcagctagaatgactagaaaacataataatgcaaatgttctttgcttgggtgcgagagttaccggaattgaacttgcaaaagatattgtaaaaacttttattgaagaggacttcgagggtggtcgtcatcaaaagagaattgatatgttggaagaaaattag

SEQ ID NO: 3691 - DNA, 435 bp, Peptoniphilus lacrimalis 315-B
atgaaaatagcattaggtagcgaccatgcaggatttcatctcaaagaagacattaaaaaatatttgcaagaaaaacaaatagaaacagttgattgtggaagtttttctgatcaaagatgtgattatcctgattttggacataaagtcgcaaagacagttcaaaatggaagtgttgattacggaatagttatttgcggttcaggcataggaatttcaatatctgccaataaggtaaaaggaataagatgtgccctttgctcagaaccattgagcgcaaagctttctagaaatcataataactgcaatatgcttgctatgggagcaagactaatagggcttgatatggcaaaagaaattgtagatacttttgttcaaagcaaatttgaaggcggtagacatataagaagagtagaaaaaatagaggaggatttatga

SEQ ID NO: 3692 - DNA, 441 bp, Symbiobacterium thermophilum
gtgaaagtggccgtggcaagcgatcatggtggcattgatctgaaggcgacggtgatctcggtcctgaagtcgctgggctgcgaggtggccgacctgggcacccacgaccggagctcgtgcgactacccggattatgcgcagaaggtggcggagggcgtcgcggccggcgagtaccagcgcggcgtcctgatctgtggcactggcatcggcatgtccatcgccgccaacaaggtagccggcgtgcgggcggccctgtgcaacgagatctactcggcccggatggcccgtgcccacaacgatgccaacgtgctctgcctgggcgcacgggtggtcggctcaggggtggcggaggagatcgtccgggcgttcttcaccacggagcatgaaggcgggcgccacgcccgtcgggtggagaagatccgcctgctggagcaggggtag

SEQ ID NO: 3693 - DNA, 465 bp, Symbiobacterium thermophilum
atgaggattgccatcggcaatgatcacgtgggtacggagatgaagcgggccatcgcggcccacctggaaagcctgggccacgaggtggtcaacttcggcacggacagcaccgaacggacggactatccgatctacggggaaagggtggcccgcgcggtggccgcaggggaggtcgactgcgggattctcatctgcggcaccggggtgggcatctcgctggctgcgaataaggtcaggggcatccgggccgtggtgtgcagcgagccgtacacggcccgcctgtcgaagcagcacaacaacaccaacatcctggccttcggcgcccgggtggtgggcgtggacctggccaagatgattgtcgacgagtggctgaacgcctcgttcgaagggggccgccaccagcgccgggtcgacatgatcgccgacatcgagcgccgggaggagtgcgggccggaggggtgctga

SEQ ID NO: 3694 - DNA, 459 bp, Anaerofustis stercorihominis DSM 17244
atgaaaaaaatagcagtcggtgccgacgctgtcggtttacttttgaaagatgaaatagtatcttatttgaaagatgaaggatacggagttacggaccttggtgtaaaagaagaaagcgacaagactttctatgctaacgttgctgaaaaggttgctttggctgtaagggacgaagattacgacagaggacttctgttctgcggtactggtattggtatgagtattgccgcaaataaagttcccggagtattcgctactgtttgccatgacccgtattctgctgaaagagcaagcttaagcaacaatgcaaaaatcattactatgggatacagggtaatagggaaagaaacagcaaaggttgttttgaaacactggttggataatgattttgtagagggatgcaagagtcaaagcaatgtggatgaagtaacaaagcttgacgaaaaatataaaggctaa

SEQ ID NO: 3695 - DNA, 453 bp, Anaerofustis stercorihominis DSM 17244
atgaaaatagtaattgctagtgaccacggtggttatgaattaaaacaatttttaatcgaaacatttaaaaaagaaggatatgatttcgtagactacggtacgaattccgaagaaagtgttgattatccggattatgctataaaaacatgtgaagatgttgcggcaggtaaatttgacagaggtattttgatttgcggtacaggtatcggtataagtatcgcggcaaataaggttaaaggtatcagagctgctcactgtactgactgcttctctgcaaagatgtgtaaacagcacaataatgccaatgttatcgtacttggcggtaggataacaggtcccgaacttgctgccgaaattcttagaacgtacttaaacgaaaaagaatttttaggtggaagacatgaaaacagagtaaataaaataaaagcatacgaagaaaaagtatataaatag

SEQ ID NO: 3696 - DNA, 429 bp, Eubacterium eligens
atgatagcaatcggttgtgatcacggagcattagaattaaaggaacagcttatagagcatcttaagaagagaggcattgagtgcaaggattatggaacatatactaaggattcatgtgattatcctgtatatgcaaagaaagtggctgaggctgttctttctggtgagtgtgaggaaggaattcttctttgtggaacaggaattggaatgagcatggcagctaataagattaagggaatcagagcggcattatgcagcgactgcttctcagcacaggctactaaggaacataacaatgccaatgtattgtgtatgggtgcaagggttatcggaccagagcttgctttcagaatagcagatacatttttagattccaagttttctaatgatgagagacatataagaagaatcagtatgttagaggattaa

SEQ ID NO: 3697 - DNA, 438 bp, Eubacterium hallii
atgaaaatagtatttggatgtgaccctaacgcaacagaatttaaattacagttaatggagtatgtaaaaggtcttggacatgaagtagcagatttaggaagcgatgatcctatctatgctaatacagcaatcgaagtagcaaaagctgtagcagcaaaagaatacgatagaggaattattgtttgtggaacaggtattggtgtttctattgcagcaaacaaagtaaaaggagcttatgctgcatgtattcatgatgtataccaggctcagagagcacagctttctaatcatgcaaacattattactatgggttcacaggttatcggaatcgaacttgcaaaacagcttgttaaagaatatctttctgtagaatgggatcctaactgcagatctgttgcaaaagtacagagaatcattgactttgaaaatgaagaataa

SEQ ID NO: 3698 - DNA, 465 bp, Eubacterium hallii
atgtcagaagtaaaagtaattggtatcggtaatgatcacgcagcagtagacctgaaaaatgaaatcaaagcatatcttgaagaaaaaggctacaaagtagtgaactacggaacagattcttccgaaagctgcgattacccagtctacggggcaaaagtaggtaatgctgttgcaagcggtgaagtagatgcaggtgttttaatctgtggaacaggaatcggtatctccatcgcagccaacaaagtaaatggagttcgtgcagcagttgtaagtgagccggtatctgcaagactcacaaaagaacacaacaatgcaaacatcattgcattcggtgcaagaatcgttggaagcgaaatggcaaaagcaatcgtagatgcatggcttgatgcagaatatatcggaagcggccgtcatgagagacgagtgaatatgattgaggaagaagcagcaaagtataataaatag

SEQ ID NO: 3699 - DNA, 444 bp, Eubacterium rectale
atgaagattgcaatcggaaacgatcacgcagcagttgagcttaaaaagacaataatggagtacgttgagagcatgggtcacgaggttaccaacttcggcacagattcaagtgagagctgcaattacccggagtatggtgagaaggtggctaatgcagtggcatcgggcgagtttgactgcggaatactgatatgcggtaccggtgtgggtatctcaatagcagccaataaggtcaacggaatccgtgcggcagtttgctcagacacagccacagcacgccttgtaaaacagcacaacaatgccaatatcatagcctttggtgagaggattgtaggtgttgagcttgcaaaggatatcgtaaaggcttatctgacagccgagtttgagggcggcagacacgcaaagagaatagctatgatatcggatatcgaggctagaaactaa

SEQ ID NO: 3700 - DNA, 435 bp, Eubacterium saphenum
atgatagttgtactggcggcggatcatggaggagcaaaccttaaaaatgagttggctgcggttcttagagataagggctacaagattcttgatctcggcacgaatgatgctgaagtctccgttgactatcctgtatatgcgaaggaagcggcgttacttgtagcagaaggcaaagctgatagaggcatagtgtgctgcgggtcgggtattggcgtgagcatcgcatccaacagagtgcgaggtgtgaggtgtgcgctctgcatggatgaaaacatggcagagttgtcaaggaggcataatgatgcaaacatgctggcacttggaggacgattgttagatgtcgaaaaagccaaaagaatcatggaaagctggcttgaaacgaaattcgaaggcggcaggcataaaaggcgaatagatatgatagatggtatttaa

SEQ ID NO: 3701 - DNA, 435 bp, Eubacterium siraeum
atgctggcaataggtagcgaccacgcaggatatgagctgaagtgcgaggttaagaagttccttgacgggctgggagtcgaatatatcgactgcggctgtaacggagagagagcggattatcccgacattgcagaaaagacctgcgagaaaatcaaaagcggagagtgcgacaagggcattctgatatgcggtacgggtataggcatcagcatatcggcaaacaagataaagggtatccgtgcggctttgtgtcaggattattatacggcaaagtacacacgtctgcataatgacgctaatgttctgtgcatgggcggcagagtaataggagcgggtacggctgaggagatagtaagagtattcctgtcaaccgagttcgagggcggaagacacgcagcccgtgttgacaagatgatggcactcgaaaataagtaa

SEQ ID NO: 3702 - DNA, 465 bp, Eubacterium ventriosum
atgaagattggatttggatgcgaccatgcagcaattgacttaaagaatgaacttattgaatatatgacagaaaagggctacgaatgtgttgattatggcacaggctatgatgaaaacggagaaattattaagtgcgattatccaaacaagggtcgtgaagttggtgaagcagttgtaagaaaagatgtagattacggtgtacttatgtgtggaaccggaatcggtatttctgttgcagcaaacaaggttccaggtgtaattgcagcagtttgcagcgaaccttattcggcaaaacttacaaagcagcataacaatgctaatgttattgcttttggcgcaagagttgttggagtagaacttgcaaaaatgattcttgatgaattttttggagcagagtttgaaggtggaagacaccaggcaagagttgacatgattcatggaattgaagcagattatagcaaataa

SEQ ID NO: 3703 - DNA, 453 bp, Eubacterium ventriosum
atgaaaattggaattggaaatgatcatgtagcagttgaaatgaagaatgaaatcaaggcatatcttgaagaaaaaggacatgaagttgtagatttcggtacaaattcttctgagagatgtaattaccctgtatatggcgaggcagtagccaatgccattgttaacggtgaagtagattgtggtgttttaatttgtggaacaggtgtaggaatttcactttcagctaacaaggttaacggaattagagcctgcgtatgtagcgagccatatagcgcaagattatctaagcagcataacaacactaacattattgcatttggcgcaagagttattggcatagaacttgcaaaaatgatagtagatgaatggcttaatgcagaatatgaaggtggccgtcatcaggttagaatcgatatgattaaagacatcgaggaaaaacagaaacagaagtaa

SEQ ID NO: 3704 - DNA, 471 bp, Heliobacterium modesticaldum Ice1
atgaagatcgccattggcagcgaccacggcgggttccggatgaaagaggatatcggggcttttctggcggaggagatagaactggcaggcgtcaagcccgaggtcatcgataagggaaccttttccgaggaatcggtcgattaccccgaatttggcgtcaaggtagccaaagcggttgtcgagggggaagccgatttcggcatcgtcatctgcggcacggggatcggcatctctatcgccgccaacaaggttcccggcatccgcgccgccctctgcggcgacaccttttcggcgcgcatggcgcgggaacataatgacgccaacgtactcgctctgggggcgagggtgatcggtcccggcttggcccgggacatcgtggcggctttcctttcgtcggcttttgccggcggcaggcatgcccggcgggtggacatgctgcgggccatcgaggggcaggggacggtaaaatga

SEQ ID NO: 3705 - DNA, 450 bp, Anaerostipes caccae DSM 14662
atgaaaatttctttaggatgtgacgaggcagcatttgacttgaaagaggcgattaaaaagcatctggaagatgcgggacatgaagtggtagacaacggcgtgggaccgggggaagtggaactttacccggatgtggcagtgcgtacctgtgaaaaagtaacaagcaacgaatgcgacaggggaattcttgtatgcggaacaggaatcggtatggcgatgacagccaacaaggtgccgggcatccgtgcggcagtctgccacgatccattctcaacagagcgctctatcctgagcaacgacggaaatgtgatgtgtatgggagcaagagtcatcgcaccacagctggcattatatttactggatatctggatgggacttaccttcaaagacggaccgtctaccgagaaagtagaacggattacatattacgaaaaacagttcagcaaataa

SEQ ID NO: 3706 - DNA, 450 bp, Anaerostipes caccae DSM 14662
atgaagatttcaattggatgtgacgaagcagcttatgagttaaaagaggccatcaaaaagagactggaggagacagggcatacatatgtggacaatggagtagaggccggagaaaccgcattgtatccggatgtagcagtaaaaacctgtgaaagagtggccagcggtgagtgtgacaggggaattctcgtgtgcggcaccggcatcggtatggctatgacggcaaacaaggtgccgggaatcagggcagcggtctgtcacgatccgttttctacagagcgctccattctgagcaatgacggaaatgtgatgtgcatgggagccagggtgatcgcacctcagctggccttataccttttggacatttggatggggcttgaatttaaagacgggccgtctaccgaaaaggtcgagaggattacttattacgagaaacaattcagcaaatag

SEQ ID NO: 3707 - DNA, 432 bp, Bryantella formatexigens DSM 14469
atgatagcgatagcatgtgaccacggcggatatgtattaaaacaggaaatattaaaacacctcgataagagagggcttgcgtataaggacttcggctgcgacagcgaggcggcggtggattatccggtttatgcgcgcaaggtgacggacgccatcacaaagggcgaatgcgagcgcggtattctgatctgcggaaccggcatcggcatctcgattgcggcaaacaaagtaaaaggcatccgggcggcgctgtgtacggactgctttgcggcagaggcaacgcgcctgcataatgatgcgaatgtccttgcgcttggcggcagagtggtaggaccggggctggcgctgaaaattgtggatacgtttctggatacgccattttcgcaggaggaacgccacaagagaagaatttctctgattgaagaggactag

SEQ ID NO: 3708 - DNA, 429 bp, Butyrivibrio crossotus
atgatcgcattaggttcagatcatggcggatttgcattaaagtctgcaattataaaacatcttgaaaatagaggattggaatacaaagactacggttgttacaacaccgattcatgtgattatcccgtattcgggcgtgcagcggcagaagcggttgcagacggcacatgtgataaaggaattgtagtatgtacaacaggaatcggtatatcaatagctgccaataaggttaagggtatcagatgtgcactgtgcacaagcaccaatcttgcaaaaatgacacgacttcacaacaacgccaatatgcttgcacttggtgcatcggtagtaagcgaagaacttgcaatggatatagttgatacgttcttagatactgaattcagcaacgaagaaagacacataagacgtgttgaaatgatagaaaaataa

SEQ ID NO: 3709 - DNA, 426 bp, Coprococcus eutactus
atgatagcacttggatgtgatcatggcggatatgagcttatgcaggaggtcattaagcaccttgaggagagaggacttgagtacaagaattttggatgctacagcacagagtctgtagactatccgatatatggacaggctgcagcaaaggcggtggcttcaggcgagtgtgataagggaatcatcatctgcggaacaggaataggaatatccatatcggcaaataagataaagggtatcagagctgcgctctgccacgactgcttctcagctcaggctaccagagagcacaacgatgcgaatatgcttgctatgggagcaagagtcataggaccgggactggctctcaagatagtggatatattcctcgacacaccattttcaaatgacgagcgccatgtaagaaggattggaatgatagagtaa

SEQ ID NO: 3710 - DNA, 465 bp, Dorea formicigenerans ATCC 27755
atgaaaagaggaggctataacgtcatgaaaatcggaattggtaatgatcatgcagcagtagacatgaagaatcaggtagtagagtacctggaaggaaaaggatatgaagttgtgaactttggtacagatacatatgagagctgtaattatccagagtacggcgagaaagttggacgagctgttgcagcaggagatgtagatcttggtatcctgatctgtggtacaggagttggaatctctttggcagcaaataaagtaaaaggtgttcgtgcagttgtttgctcagagccatattctgcaaaactttccagacagcataacaataccaatattctggcattcggtgcccgtgtaatcggaattgagcttgcaaagatgatcatcgatgagtggttaaatgcagaattcgaaggcggaagacaccagaccagagtagatatgattacagcaattgagaataaataa

SEQ ID NO: 3711 - DNA, 447 bp, Dorea longicatena DSM 13814
atgaaaatcgcaatcggatgtgatccaaacgcacagcaggcaaaagaggaactgatcaaatttatggaagataagggttatggagagatcaaagacttcggaagcgaagatccgatctatgctaacacagcagttgcagttgcagaagctgttgcttccggcgagtatgaccgcggaatcctgatctgtggaacaggtcttggagtttctatcgcagctaataaagtaaaaggcgcttatgcagcattactttcagacatctactcagcgaaaagagcccgtctcagcaacgatgccaacatcgcatgtatgggagctttcacaatcggtaacaaattaagagaagaattaacagacgctttcctgacaaacgaattcgttccgggatgctcttctcagccaaaggtagatgctttcagagagtacgaagcagctcaccagaaataa

SEQ ID NO: 3712 - DNA, 447 bp, Dorea longicatena DSM 13814
atgaacatgaaaattgcaatcggttgtgatccaaatgcagaagaagcaaagcaggaaatcattgcttacattgaaaagaaaggctatggagaggtgacagacttcggaagtgaagatccgatctatgcgaatgtagcaattgatgtagcagaacatgtagcatccggggaatatgacagaggtgtgctgatctgcggaacagggcttggggtatctattgctgccaataaggtaaaaggtgcatatgccgcactggtatctgacgtatattctgcgacaagagcaagactcagtaacgatgccaacattgtctgtatgggagcattcacgacaggtgcaaaagtacgtgagatgcttgtggacgctttctttacgaacgaattcgtaccgggatgttcttcacagcctaaagtagatgcattcagagagtatgatcagaaccgctaa

SEQ ID NO: 3713 - DNA, 480 bp, Dorea longicatena DSM 13814
atgaaagacaaaggtaggaacaggaatatgaagattggaattgcaaatgatcattctgcagtagacatgaaaaatgagattgtagaatatctggaaagtctgggacatgaagtcgtgaactatggaacagattcttatgaaagctgtaattatccggaattcggtgagaagatcgggaatgcagtggcaagcggtgaagtagagcaggggatcgcaatctgcggaaccggtgccggaatctcgctggcagcgaataaagtaaatggaatccgtgcagtagtgtgcagtgatccatatacagcaagaatggcgaaagagcacaacgatgcgaacgtgatcgcattcggggcacgtgtgatcggtatcgagactgcgaaatgcatcgtggatgagtggcttaatgctaagtttgaaggcggaagacatgccacaagagtggacatgatcatggacgtggaaaagagaaatcataatttatag

SEQ ID NO: 3714 - DNA, 471 bp, Oribacterium sinus F0268
atgaaaatgaagattgcaatgggaaacgatcatgccgctgtagagatgaaaatggagcttaaggcctatctggaggagcagggaatcgagattatcaatgtgggaacagatactccggaacgctatgattatcccttggcaggctatcaggtagccaagcttgtacaggagggaaaggcggacttcggcatcgctatttgtggaacgggagtgggcatttccttagcagccaataaagttcccggcattcgagcattcccctgctcagagccctattccgcagctatgggcagaagacacaacaatgccaatgtactttgtcttggtgccagagtagtaggtgttgagcttgcaaagatgattgtggacagcttccttttagcagaatttgaagggggaagacacgcagaaagagtagccctgatttccgaaatcgaagaggatgcagaaggattcaaaaagaggatgtag

SEQ ID NO: 3715 - DNA, 459 bp, Roseburia intestinalis L1-82
atgaggaatacaatgaaaatcgctattggaaatgatcatgcagcaacagaattaaaatttgtcatcatggattatctgaaagaattgggacatgaagtcattaattttggaacagatacgtcagacagctgtaactatccggagtatggtgaaaaagtcggacgtgccgttgtggcaggggaggcagactgtggagtgctgatctgtggaaccggagtcggtatctcaatcgctgcaaataaagtaaagggagtccgtgcggcagtgtgttctgactgcgcaactgcaagacttgtcaaggagcataataatgcgaatattattgcatttggtgcaagaattgtcggaaccgagctggcaaaagatatcgtaaaagcatatttagatgcagagtttttaggtggaagacatcagacgaggattgatctgatccatgagatagaagaacgaaactcataa

SEQ ID NO: 3716 - DNA, 444 bp, Roseburia inulinivorans DSM 16841
atgaaaatcgcaattggaaacgatcatgcagcaacagaattgaaatttatcatcatggactatgtgaaaagtcttggccacgaagttgtaaattttggaacggatggcaatgagagctgcaattacccggaatttggagagaaagtaggacgtgcagttgtaaacggcgaggctgactgcggaatcttgatctgcggtaccggagtaggaatctccatcgcagcaaacaaggtaaacggtgtccgtgcagcagtatgttctgactgtgcaactgcaagactggtaaaagagcataataatgccaatattattgcatttggcgcgcgtattgtcggaagcgagcttgcaaaagacattgtaaaagcatatttagatgcagaatttcagggtggaagacatcagacaagaattgatatgatccacgaaattgagacaagaaactag

SEQ ID NO: 3717 - DNA, 462 bp, Shuttleworthia satelles DSM 14600
atgaaaatcgcaatcggcaatgaccacgcggcaacggccctgaaatttgagatgatggattatctgggaaatctggggcatgaactggtgaactttggcacagacgaggacgccagtgtcaattatccggattatggagaggcagttgccagggcggtcgcaagaaaagaggtggattgcggggtcctgatctgcggtaccggtatcggcatttcccttgcagcgaataaagtagagggaattcgtgcggccagcgtttccgaccctgtctctgcccgtctggccagagaacacaacgatgccaatatcatctgcttcggggcccgtattgtcggccctgaaatggccagggccatcctggacgcctatcttggggcggaatttcttgggggcaggcatgcagaccgggttcgcctgattcacgagattgagaaacgcacgatcgagggccgggagctgtga

SEQ ID NO: 3718 - DNA, 459 bp, Candidatus Desulforudis audaxviator MP104C
ttgcgaatcgccattgcctgtgaccacggcggattcaaactcaagcaggaagtactggactgtttgaaggatagcggttttcaagttcaagattgcgggacgttttccgaggcctcggtcgactacccggacgtggtgctgccggtggccgaggccgtagcccggggggagtgggaccgggccatcctgttatgcggcacgggcatcggggtggcgatggtggccaacaaagtgccgggggtccgggcggcggtcgcccacgacccttattcggcccgtcattcgcgggcccacaacgacgcgaacgtcctcgctctcggagagcgggtcgtcggtccgggcttggcccgcgatatcgtgaccgtctggcttcaaaccgaattcgagggcggccggcacgctcggcgggtcggcaagatcgcggccgttgaagaaaaatacgccccgaggaggagttag

SEQ ID NO: 3719 - DNA, 450 bp, Desulfitobacterium hafniense
ttgaaaattgcactaggagcagatcatggggggtacgaacttaaaaatgagattcgtgcccatttagaagaacaagggattgagattctggatttcggcaccaacactaaagattctgtggagtatcccaggtatggtttctatgtaggtgatgcagtgactaaaggcaaagcagacttaggaattgtggtctgtggtacgggcttagggatctccatcgctgccaataaagtaccaggggttcgtgctgcagtctgcactgagacctattccgcacgtatggcgcgggaacataataatgccaatatcctggctctcggaggcagagtcaccggtttgggcttggccttggatatcgtggatatgtttgttaaaactccttttgccggtggacgacatgcttgtcgggtcgatctcatcgaggccattgaaaaaggagatactctctaa

SEQ ID NO: 3720 - DNA, 465 bp, Desulfitobacterium hafniense
ttggaggtgtcccttttgaaaattgcattaggagcagatcatggcgggtacgaacttaaaaatgagattcgtgcccatttagaagaacaagggattgagattctggatttcggcaccaacactaaagattctgtggattatcccaggtatggtttctatgtaggtgatgcagtgactaaaggcaaagcagacttaggaattgtggtctgtggtacgggtttagggatctccatcgctgccaataaagtaccgggggttcgtgctgcagtctgcactgagacctattccgcacgtatggcgcgggaacataataatgccaatatcctggctctcggaggcagagtcaccggtttggggttggccttggatatcgtggatatgtttgttaaaactccttttgctggtggacggcatgcttgtcgggtcgatctcatcgacgccattgaaaaaggagaaactctctaa

SEQ ID NO: 3721 - DNA, 450 bp, Desulfotomaculum acetoxidans
ttgcgagttgccatagccgctgatcacgggggctttcagttaaaaaaagaaattattgagtgcctgcgtgctgacggttttgagtataaagattttggtacatattcagaggagtcagttgattacccggatttggctctggctgtggcggaagccgtcaaggccggggattatgacagaggaataatttgctgcggtacaggcataggagtctccctggcggcaaataaagtgccgggcattcgtgccgccctttgtcatgacactttttccgcgcgttgtgcgcgggagcataatgacgcaaatattttaactttgggtcagagggtgattggcgccggtttagctgcggaaattgtcaggatctggctgaatactgtttttgccggtggacgtcatgcccgcagagtagaaaagattgcccaaatagaagcaaaatataataagtaa

SEQ ID NO: 3722 - DNA, 459 bp, Desulfotomaculum reducens
ttgaaaaacatatcaatagtactgggaagcgatcatgcaggtttcgaaatgaaagaacaaataaaggaatatttgcaaggtcaggggcacacagtgcaggacatgggttgtaacggcaccgaatcctgtgactacccggattttgctctggctgtgggagaaaaaattcgctctggccaatgtcagcagggcattctcatctgtggtaccggtgtgggtatggccattgccgtaaacaaggtacctggtgtacgggcggctaacgtttttgcaccggaaattgcgcaactggcccgggaacacaacaacgccaacgtcctcaccatgggatcaagatttatcgacctagcccaggccaaggctatcgtggaaaaatttatcaacactgaatttgccggcgatcgccacgccaaacgggtggacaagattagtgctattgagaaaaagtatagcttatag

SEQ ID NO: 3723 - DNA, 462 bp, Pelotomaculum thermopropionicum SI
gtgaaggtagctgtagccagcgatcacggagggttcaggctgaaagaggaagtaatcgggcttcttcgggagctcggcattgcctatagggatttcggtacatattcagaggacccggttgactacccggacatggccctggcagtggccgaagccgtccggaagggtgagtacgacaggggcgtgctttgctgcggcaccgggataggggtggccatctgcgcaaacaaagtgccgggtataagagcggcgctgtgccacgacactttctcggccagggccgccagggagcataacgacgccaacatattgaccatgggccagcgggtaatcgggccgggtctggccagggatattgttgcaacctggctccaggcggagtttcagggtgggcgccatgcccgccgtgtagataaaatacgctgcattgagcaggaatattacagctttggccggagttga

SEQ ID NO: 3724 - DNA, 438 bp, Anaerotruncus colihominis DSM 17241
atgaaaattgcaatcggatgcgatcagaacgcgtcggagctgaaggagcagctcaaagcatttattatggagctggggcatgtatgcgtggattttggcggggatgaaccgatctatgccaatacggcgatccgtcttgcgcaggcggtggcggccgaagaatgcgaccgcggcgttttgatctgcggaacggggatcggtatgtgcatcgcggccaacaaggtcaaaggcgcttatgcggcgctggtcaacaatgtgtaccaggcgcagcgcgcgcagcttagcaaccgcgcgaacatcatgactctgggcgcgcaggtcacgggcgtggagctggcaaaatgccttgtgcaatcgtatctgaaagaacaatttgacccgcagtccagatcagcgccgaaggtgcagcggatctgcgattatgaaaacgggcgctga

SEQ ID NO: 3725 - DNA, 441 bp, Anaerotruncus colihominis DSM 17241
atgatgctcgcacttgcagccgaccacggcggctttgctctcaaagaggaggtcaaggcctggcttgatgaacaacagatcccctataaggatttcggtacacacgacggtgcgtcctgtgactacgccgatatggccgcgcccgcctgcgacgcggttatttccggtgactgtgacaaggcgcttttattctgcggaacgggcatcggtatttcaatggccgccaataagatcaagggtatacgggcggcctgctgctccgattacttcagcgccaaatatacgcgcctgcacaacgatgcgaacgtgctgtgcatgggcggccgtgtgatcggtcccggcgcggcgattgagctgatcgacgtatttttacacactgagtttgagggcggccgccatcagcgccgcattgataagatcgccgctttggaaaaccgctga

SEQ ID NO: 3726 - DNA, 447 bp, Faecalibacterium prausnitzii A2-165
atggcaaaacccattgcgcttgccgccgatcatggcggttttgaactgaaggaagccgtcaaggctcacctggacgagctggggctggagtatatcgactttggcacccacagcactgccagcgtggattaccccgatatggcactgcctgcctgtgacgctgtggtcagcggccagtgcgacaaagccctgctgttctgcggcaccggtgtcggcatcagcatggccgccaacaaggtcaagggcatccgcgcctgctgctgctccgacagcttcagctgcgagtacacccgccgccacaacgatgccaacgccctgtgcatgggcggccgcgttgtcggccccggccttgcctgccagctggtggatctgttcctgaacaccccgtttgagggcggccgccacgaaaagcgcattgcaaaactgatggcaatcgaaacccgataa

SEQ ID NO: 3727 - DNA, 447 bp, Faecalibacterium prausnitzii M21/2
atggcaaaacccatcgcacttgccgccgaccacggcggatttgaactgaaagaggctgtcaaggcacatctggaggagcttggtctggagtatatcgactttggcacccacagcaccgacagcgtggactaccccgatatggctgtgcccgcctgtgacgcagtggtgagcggccagtgcgagaaggcactgctgttctgcggcaccggtgtgggcatcagcatggcagccaacaagatcaagggcatccgcgcctgctgctgctccgacagcttcagctgcgagtatacccgccgccacaacgacgccaacgccctgtgcatgggcggccgcgtagtgggcgcaggccttgcctgccagctggtggatatcttcctgaacaccgagtttgagggcggccgtcatcagcgccgcatcgacaagctgaccgcactggaaaaccgctga

SEQ ID NO: 3728 - DNA, 435 bp, Ruminococcus flavefaciens
atgatagctataggctgtgaccacgcaggtgtggaaatgaaaaaggcaattatcgaggaactttcaaagaagggctttgaattcaaggatatgggtactgacggtgagccatgcgattacccgaatatggctgaggctgtatgcggtctcatcacatcgggcgaatgcgaaaaaggtattctcatctgcggtacaggcattggtatgtccattgccgctaacaagataaagggcatcagggctgcactctgctccgattctttctcaacaaagttcacccgtctgcacaacgactcaaacgttatgtgcatgggcgcaagaacactgggtccgggacttgcctgcgagcttgctgagatattcctgactacaggattcgagggcggccgtcatcagagacgagttgaccttatcactgctctggaaaacaagtaa

SEQ ID NO: 3729 - DNA, 522 bp, Ruminococcus gnavus
atgtggatgcttgacaattatctttggatattggacaatagaagagaattggaaaaagaaagagatacgaggagagagatcatgagaattggaattggaaatgaccattcagcattggaattaaaagcagaaatcatcgaatttctgaaagaaaaaggacatgaagtcgtagatttcggaacggattcatctgaaagctgtgactatccgaagtatggggaagcagtaggccgtgcagttgttgcaaaagaagtggactgtggaatcttgatttgcggtacaggactgggaatatctcttgcagcaaacaaggtcaaaggagtgcgtgcagcagtttgcagcgagccgtttacagcgaagatgtccagagcacacaataactgtaatgtgcttgcatttggcgcaagagtggtaggtgcagagctcgcgaaaatgatcgtagatgtatggctgaacacggagtttgaaggcggacgccaccagagacgtgtggatatgatcatggagatcgaagagagataa

SEQ ID NO: 3730 - DNA, 447 bp, Ruminococcus lactaris
atgaaaatcggaattggaaatgaccattcagcactggaactgaaagcagagattattgaacttctgaaagagaggggacatgaagtagtagattatgggacaaattcaccggagagctgtgattatcccgtttatggagagaaagtgggacgtgcagttgcatcaggagaagttgaaagaggaatcctgatctgtggaacgggtcttggtatttcactggctgcgaacaaagtaaaaggggttcgtgcggccgtatgcagtgagccgtttacagccaagatgtccagagctcataataactgcaatattcttgcctttggtgcgagggttgtcggtgcagaactggctaagatgattgtggagacatggcttgatacagagtttgagggtggccgtcatcagagaagagtggatatgctgatggatattgaaaaccggaatgagtaa

SEQ ID NO: 3731 - DNA, 462 bp, Ruminococcus obeum
atgatagcattaggatgtgaccatggcggttatgaactgaaacaggagattattaaatatttagaggaaaacaatatcgaatataaagatttcggatgtgacagtacagattctacggattatccgatctatgccaaaagagtagccattgcgattcagaatggtgactgtgaaaaaggtattctgatctgtggaacaggcatcggtatttctatcacagcaaataaattcaaaggtattcgtgcagctctttgttccgactgcttcagtgcagaggcaacaagacttcataacaatgccaatattcttgcaatgggcggcagagtagtcggacctggactggcagtcaagatcgtggatacattcctgaatacaccgttctcagaggaagaacgtcatatccgcagaatcaaacagatcgaagaggatacagatatcacagacgcttatccggaaatctaa

SEQ ID NO: 3732 - DNA, 432 bp, Ruminococcus sp. 5_1_39BFAA
atgatagctctaggatgtgatcacggtggatatgaattaaaacaggagattaagaaatatctggatgagaaaggaattgaatataaagattatggatgtgacagtctggattccgtagattatccggtatatgcaaagaaggttgcacatgcaattcttgacggcgaatgtgagaagggaatcctgatctgcggaacaggtatcggaatttccattacagcaaacaagtttaaaggaatcagagctgcagtctgcacagattgttttacagcagaggctacaagacttcacaatgatgccaatatccttgcacttggcggaagagtggtaggacctgggctggcattgaagattgtggatacatttttgaatacaccgttttccaacgatgagagacatatcagaagaattaatcagatagagactgaataa

SEQ ID NO: 3733 - DNA, 441 bp, Ruminococcus torques
atgaagatcggaatcggaaatgaccattcagcattagaattaaaggcggaaatcattagtttcctgaaagaaaaaggacatgaagtagtagattacggaacaaattcaagcgagagctgtgattatccggtctacggggaaatcgtggcaagagcagtggcagcaggcgaggttgaacagggaatcctgatctgcggaacaggtcttggaatttctcttgcggcaaataaagtaaaaggaatccgcgccgcggtttgcagcgagccgtttacggcaaagatggcaagagtgcacaataactgtaatatcctggcgttcggagctcgtgtggtaggagcggagcttgcgaaaatgatcgtagagacatggcttgacgctgagtttgaaggaggacgtcatcaaagaagagttgacctgattacagcgattgaggagaaataa

SEQ ID NO: 3734 - DNA, 432 bp, Subdoligranulum variabile DSM 15176
atgatcgccatcggctgcgaccacggcggatacgaactcaagcagaagattttggctcacctgcggcagcgcggactggaataccgggacttcggctgtgattccaccgcttcggtggattaccccgtctatggcaaggcggtggcccatgccgtggcatcgggcgagtgcgaaaaaggcatcgtcatctgcagcaccggcatcggcatctccatcgccgccaacaaggtgcccggcatccgctgcgcgctgtgcggggattgcttctctgccaaagccacccgcctgcacaacaacgccaacgtgcttgctctgggcgcgctggtcaccggacccggcctggcgctggagatcgtggacatcttcctggacacgcctttctcggaggaggagcgtcacagccgtcgggtatcccagctggaggaagaataa

SEQ ID NO: 3735 - DNA, 453 bp, Subdoligranulum variabile DSM 15176
atgcaatttgacaaaccgatcgcactggctgccgaccatggcggctacgagctgaaagaggccatcaaggctcatttggatgagctgggtgtggcctatgaggacttcggcaccgattccaccgccagtgtggattacccggactatgccgtggtgggctgcaaggccgtgcaggatggccgctgtgcgctggtgattctctgctgtggtaccggtgtgggtatgtccatgtgtgccaacaagatgcaggggatccgtgcctgctgctgcagcgataccttcagcgccgaacttacccgccgccacaacaatgccaatgccctgtgcctgggcggccgtgtggtgggggccggtcttgcctgcaagatcgtggacgccttcctcaacgccgagtttgaaggcggccgccaccagacgcgcatcgacaagatgatggcgctgcagaaccagtaa

SEQ ID NO: 3736 - DNA, 468 bp, Dethiobacter alkaliphilus AHT 1
atgaaaattgccattgccagtgatcatggcggttttaaactaaaaaaacacattgccgaatatctgaaggaaaagggttatacatacaaagacttcggtacactgactgaagaatcggtggattatcccgattttgccatattggtggccgaagcggtggcccagggtgagtatgatctgggtattctctgctgcggcaccggaatcggtgtgaacatggtggccaataaagtgccgggaattcgggccgcccactgtcatgatacattttccgcccgcatgacccgggagcacaacgatgccaatgtgctgaccatgggtgagcgggtcatcggccggggactggccattgaagttgtggaagcatttttacagggtgaatacgccggtgggcgccacgcctgccgtgtggaaaaaataaaagaaattgaagccaggtttctggatccggataagtccggtcactaa

SEQ ID NO: 3737 - DNA, 447 bp, Anaerocellum thermophilum
gtgaagattgcaataggttctgaccatgcaggattttctttgaaagaggcggtgaagaaacatcttgagaaaaaagggattgagttcaaggactttgggacgtactctcaagagtcttgcgactacccggacattgcaaaggatgtggcgctggcagtaaaaaacgaagagtttacatttggtatactcatctgtgggacaggaattggaatctctattgctgcaaacaaagtaaggggaattagagctgcgctttgtcatgacacattttctgctaaagctgcacgagctcataacaatgcaaacatccttgcgatgggtgcaagggttatcggtgaagggcttgcatgtgagattgtagatgcatttttggcatcaaactttgaaggtggaaggcatcagagaaggattgataagatacatcttatagagaatgaccagaaatag

SEQ ID NO: 3738 - DNA, 429 bp, Blautia hansenii DSM 20583
atgatagcattaggatgtgaccacggtggttacgaattaaaacaggaaattattaagtatttagaagaaaaaaatattccatacaaggatttcggatgccacagtacagaagcagtagattatccgatttatgccagaatggtaggaaaggcaattcagacaggagaatgtgaaaagggtatcctgatttgcggaacaggaattggaatttctattgcggcaaataaaatgaaaggtatccgtgcagctctttgtacagactgtttctgtgcggaagctacaagagagcacaacgatgccaatattttagcgctgggcggcagagtcgtaggaccgggacttgcagtaaaaattgtagatacatttttaaatacagaattttctcacgcagaacgccatcagaaacgtattgatttaattgaggaataa

SEQ ID NO: 3739 - DNA, 432 bp, Blautia hydrogenotrophica DSM 10507
atgattgcgattggatgtgaccatggcggatttgaactgaaacaggagattttggcatatttgcgcgagaagggaatcgagtataaggattttggctgtgacagcacagcatcggtggattaccctgtctatgcaaagaaagtctgcaaagcgatcacagacggagagtgtgagaagggaattctgatctgtggaacaggaatcggaatctctataacagcgaataagcagaagggaatccgggctgcgctgtgtacagattgtttctgtgcagaggccacgaggcttcacaacgacgccaatgtgctggcattaggaggaagagtagtagggcctggtctggcagtgaaaattgtggatacgtttttacatactccgttttcaggcgaggagagacatgccagaagaatccgtatgatggaagaggactaa

SEQ ID NO: 3740 - DNA, 456 bp, Epulopiscium sp. 'N.t. morphotype B'
atgaaaatagcaattggcaatgatcatgtggctgtcgcattaaaaaattatatcacgaagtatctacaagaaaaaaatatcgaggttattgatgttgggacaaataacaatgatagaaccgattacccaatacctgctgcgaaggtaagtgaactcgttacatctggcgttgccgatagaggcatacttatatgtggcaccggcgttggaatttccattgctgccaacaaaattcatggcatcagagccgttgtatgctccgagccatactctgcaaaactatctgtcgagcataacaataccaatattttagcattaggatctcgagttgttgccgacgaattagcaaagatgattgtgtcggagtggcttgacgccagttatgagggcggtcgacaccaaaaacgaatcgatatgatcactcaattagaggttagcggggtacttacattatga

SEQ ID NO: 3741 - DNA, 429 bp, Epulopiscium sp. 'N.t. morphotype B'
atgatagccattggttcagaccatggaggatttgcattaaagcaagagataatagctcatcttaaggaaagaggtatagactttgcagatgttggttgctatgacgaacagtcgacagattatcccgactatgcaaaaaaggttgccgatatggttcttagcaaggaggctgaaacaggaatactaatttgcggtactggtataggtatttcgataacggcaaataagataaaaggaattcgctgcgctttatgccacgatatatttagtgcaaaagcaacccgagaacataacgatgcaaatgttttggcgtttggtgggcgtataataggccctggattggcattagcaatagtagatgaatttttgaatacaccattttcgaatgacccacgccacataagacgaatatccaaaattgaaaattag

SEQ ID NO: 3742 - DNA, 441 bp, Clostridiales bacterium 1_7_47FAA
atgaaaatcgcaattggcaacgaccatacagcaattgaaatgaaggaaatcatcaaggaattcgtggagggtaagggatatgaggtcattgacctgggaaccaactccaccgagagctgtgactatcctgtatacggcgagaaggtaggacgcgcggttgccggtggggaagctgacctgggtatcgctatctgcggaaccggtgtggggatctcgctggcagccaacaaggtaaaaggaatccgcgcatgtgtgtgcagtgaaccgtatacggccaagctttccaggatgcacaacaattccaatgtgctggcctttggcgccagggtggtgggaagcgaacttgccaagatgattaccgaggcatggctggacgctgaatttgagggcggaagacatgagcgcagggtgaatatgatcatggatattgagaattcatag

SEQ ID NO: 3743 - DNA, 465 bp, Clostridiales bacterium 1_7_47FAA
atgagagttggatttggtaatgaccatgttgcaattgaacttaaaaacatattgatgggacatcttagggaaaagggatatgaatgcattgatttcggccccacggacccggcggacaaggtgaactatccggagcccggacgcctggtggcggaagcgctcatgcggggggagatagacaagggagtattgatctgcggtacgggaatcggtatttccctggcagccaacaaggtgcccggcatccgcgcggccgtgtgctccgagccttattccgcaaagcttacggtggagcacaacaacgccaatatcatagccatgggcgcaagggtggttggacctgaactggctaagatgattgtggacgaattctttggcgctgaatttgaaggcggaagacatgcggtgcgcgtggacatgatatctgaaatcgaagcgaaatatggggcgaagtggcatgaatag

SEQ ID NO: 3744 - DNA, 441 bp, Acidaminococcus sp. D21
atgatgaagatcattatgggctgcgatcacggcggctttgaacttaaggaaaccttgaagaaggtcctcattgaaaaaggctatgaagtggaggactatggaatccataaacaggagcgtgtcgattatccggactatgcccaaaaggtgggagaagccattgccagcggcaaaggggatcaaggcatcctcatctgcggcacgggaatcggcatgagcattgcggccaataaggtgaagggcgtccgcgcagccctttgcaatgactgctattcggctgccaaagccagacagcacaacaatgccaatgtgctctgcatgggggcccgcgttctggggccgggccttgcccaggaaatcatggaagcctatctcaatgcttccttccttggcagctatcatgaaggccgtgtggaaaagatcatggcccttgaaaaataa

SEQ ID NO: 3745 - DNA, 510 bp, Dialister invisus DSM 15470
gtggatggtgttaagtgtgtaatagttattcatgaaatgggagagatttttatgcgagtagcgatagcgagtgatcatggcggataccggttaaaggagcggttgaaaaaatatttgaaaaataaggatatagattgtatagactgcggaacagatagtgaagattcttgcgactatcctgattttgcacagaaagcatgcggtcttgtccaagcccaaacagtcaattttgcgattctaatttgtgggacaggaattggaatgagcattgctgcaaataaaatgatgggtattcgtgccgcgctttgcggcgatgaattttcagctcattatacaagagcacataataatgcgaatgtactgactcttggagcaagagttataggagagggtttggcagaaaatattgttgatatttttttaaacagttcttttgaaggcggaagacatgccaggcgtatagataaaattacagaaattgaaaggatgaaatcatgtacgaatctttaa

SEQ ID NO: 3746 - DNA, 444 bp, Mitsuokella multacida DSM 20544
atgaacattacgattggcagtgaccacggcgcggtagcgctcaaggacgaggtcaagatggtcctgaaggaatacgaggatatcaaggtaacggatgtcggcacgttcggcacgcagtccgtcgattaccctgacatcgccgaaaaagtctgcgcagacgtgacgagcggcaaggccgacttcggcatcgtgctctgcggtacgggcatcggcatctcgatcgcggccaacaaggtcaagggcatccgctgcgcactctgcaacgatgtctactcggccaagaaagcgcgcgagcacaacaacgccaacgtcctcgcgatgggcggccgcgtgctcggcttcggcccagctggcgagatcgtccgcgctttcgtcgagagctcgttcgagggcggccgccacgagcgccgcgtcaacaagatcatggcaatcgagcagaagtaa

SEQ ID NO: 3747 - DNA, 465 bp, Selenomonas flueggei ATCC 43531
atgaggcctgtaatcgtgtttggttcagatcatgccggctatcatatgaaggagtttttgattagagaacttgaacagaatggttatcaaatagaagataggggccctttttgtaaagatcctgttgattcagggatatatgccattgctgttgctgaggaagtagcacggcatccgcaggtaaaactgggggtattgatctgcggtaccggaattggtatgtccatgatggcaaataaagtggttggaatccgtgcctcattggtttctgatttgttttctgcaaagatgacgcgggcgcataatgcggcgaatgtcctttgccttggtgcacgtattattgctgaaaatatggcattggaaattacaaaaacatggcttgctgcagagccattgggaggaaagtatgcggctcgtgtggcacatatgatggcatatgagaaagagagatgtgaccgtgggtag

SEQ ID NO: 3748 - DNA, 522 bp, Selenomonas flueggei ATCC 43531
atgatctgttttttttcattgaattgtgttaagataaggacgaatatacatgcagagaaggaggagctcatgaacattacgattggcagcgatcatggagccgtggatctcaaagaagaagtcaagatggtgcttcacgaattcagtgacatccaggtgacggatgtcggcacctttggcaaagagtcggtggactatcccgacatcgcggagaaagtctgcgctgacattgtttccggcaaggcggatcgcggcattgtcctctgcggcacgggaatcggcatctccatcgcggcaaacaagatcaacggcatccgcgccgcactctgtaccgacgtctattcggcgatcatgtcgcgcaagcacaacgacgcgaacgtccttgccatgggggggcgcgtgacaggtatcggccctgcgggagagatcgtgcgcgcatggatacgcactgcgttcgagggcggccgccatgcacgccgtgtcgataaaatcatggcactcgagcagaaaaaagacaggtaa

SEQ ID NO: 3749 - DNA, 453 bp, Selenomonas noxia ATCC 43541
atgaatatagtcatcggcagtgaccacggagcggtggagctcaaagaagagatcaaaatggtgctccacgagttcagtgatatccgtgtaaaggatgtcggtacgttcggcaaggaggcagtcgattatcccgatgttgcacagaaggtatgtgctgaaatcatcgcaggaaaggcagaccgcggcatcgccctctgcgggacggggatcggcatctcgattgctgcgaacaagattgatggaatccgtgcggcactttgtacggatgtctactcggcgattatgtcgcggcggcacaacgatgcaaatgtgctcgctatgggcggccgcgtaacggggttcggccctgcgggcgagattgtgcgcgcatggattcggacggaatttgagggcggacgccatgcgcgccgcattgagaagacaatggcgctcgaagagcaaacgaatcattga

SEQ ID NO: 3750 - DNA, 456 bp, Selenomonas sputigena ATCC 35185
atgaagaaaacaatcgtcataggcgcagatcatgcgggctatcccatgaagcagttcttgctgcagcagttgacggaagcgggctgcagtgttgaggatgcgggcacgtatgatgaggcgtcctgcaacacgcagccctacgcgcaaaaggtggcggaagaggtggcgaagggcgaggggaagttgggcatcctcgtctgcggcacgggcgcggcgatgtgcatcatggcgaacaaggtcaagggagcgcgtgccgtcgtcgtgcacgacctgtttacggcgcgcatgacccgcacgcacaatgacgccaacatcctctgcatggggcagcgcgtcatagcgaactacatggcatgggagattgcaaagacgtggctctcctatgagccgcttggaggcaagtatgctgagcggcgcgaaaccatcgcgaggtatgaggaggagcatatgaagtga

SEQ ID NO: 3751 - DNA, 441 bp, Thermosinus carboxydivorans Nor1
atgttagtagcgatcggcagtgatcacggcggatttcgccttaaggaagaaatcaaacggtttttggaggaggagaaaatcgcctaccgcgattttggcacctactcgaccgattcggtagattaccccgacatttcccgcagcgtcgcccaagcggtggcgaccggcgaatgtgaccggggcattattatatgcggtaccggtatcggcgtgtccatcgccgcgaacaagattaagggcatccgggcggctctatgccatgacgtctattcggcccagatgtcacgggaacacaatgacgctaatattctcaccatgggcgagcgggtcatcggaccgggcttggcccgggccatcgtggccaaatggctcgccaccgagtttgccggcggtcgtcatgcccggcgggtgtgccagatcgccagcctggaagaagaatag

SEQ ID NO: 3752 - DNA, 438 bp, Veillonella dispar
atgaaagttgcaatcggttgtgatcatggcggattacatttaaaagcatccgttaaggaattattaaatgcattgggacatgaagtagaggattttggctgtcatacagctgattcttgcgactatcctgacattgctgtacctgtagcaaatgcagttgtatctggtcaagcagaccgaggtattttgatttgtggtactggtattggtatcggtattgcagcaaataagatttcaggtattcgcgctgctctttgtcatgatacattctctgctcatgcatgtcgtgaacataatgacgctaatattctcacaatgggggaacgcgttattggtcctggtctagctaacgatattgtagccatctttatggaaacagagttcgaaggtggtcgtcacgcacgccgtgtagagaaaattaaagcactagagaagtaa

SEQ ID NO: 3753 - DNA, 438 bp, Veillonella parvula
atgaaagttgcaatcggttgtgatcatggcggattaaatttaaaggcatccgttaaggaattgttaaatgcattgggacatgaagtagaggactttggctgtcatacagctgattcttgcgactatcctgatattgctgtacctgtagcaaatgcagttgtatctggtcaagtagacagaggtattttgatttgtggtactggtattggtatcggtattgcagcaaataagattgcaggtattcgcgctgctctttgtcatgatacattctctgcccatgcatgtcgtgaacataatgacgctaatattctcacaatgggggaacgcgttatcggccccggccttgcaaaggacatcgttactatttggatggcaacggattttgaaggtggccgtcatgaacgccgtgtggaaaagattaaagccttagagaagtaa

SEQ ID NO: 3754 - DNA, 477 bp, Halothermothrix orenii
ttgaaagtcattaaaaataaacaatatgtaattggcagtgataatgcaggctatcctttaaaggagatcattaaagaattacttgaatctgaagggttagaatatgaggacgttggagttgattcagaccaggataagacgatatatcctgagatagctgaaagagttgttaacaggataaaaaaaagtaactatgaaaaagagggcatattaatctgtggaacaggtattggaatggcaatcacagctaataaattctccagaatatatgctgcagtttgtcatgatgtttattcggcagaacgagctagattgagtaatgatactaatgtcattactatgggggcccgggtaattgggccagtgcttgccaaaaaaattataagagaatggttaagtcttgaatttaaaccaggtcggtcgacacctaagctaaagcaaatcaagaaatatgaaaatcaaaattttgtgagttaa

SEQ ID NO: 3755 - DNA, 489 bp, Natranaerobius thermophilus JW/NM-WN-LF
atgacatatttaacgccgaaaaaagtgctaactgaaacaggtcaaattcttggaatcgccagtgatcatggtggcctggaattaaaacaagagattataaatcacttacaagattcaggtataaaaatcgaagacttaggttgctaccaggatgagtcggtggattatcctgattatgcagaaaaacttacacaaaaacttgtgaataatgaaatttcatacgggatattagtatgtgggacggggataggtatttcgataagtgccaataaagttcccgggattagagcagccctttgtcatgactgtttctcggcccgtatggcaagagagcataacgatgcaaatattattgcccttggtgaaagaataataggaaagggtcttgctttagaagttgttgacaccttcttaaacagtccctttggaggcggtcgccatgaaaggcgagtaaataaaattacaaagttagaacaaaaatactcttaa

SEQ ID NO: 3756 - DNA, 480 bp, Carboxydothermus hydrogenoformans Z-2901
gtgaagatagccatcggggctgaccacgcgggatttaacttaaaggaagaaataaaaaagcacctggaaaaaaaggggattgctgtgattgacaaagggacttactccgcggaatcggtggactaccccgattttggggaagccgtggccgaggcggtggtgcaaaaggaagtagattttggcattgtaatttgcggtaccgggataggaatttccatcgccgccaataaggttcctgggatccgggcagccctttgttcggacactttttccgcccattcagcccgggagcacaatgatgccaacgttttagctctgggggcccgggtggtgggagtgggtcttgccctggatatcgtggacacctttcttggagcatcctttgaaggtggccgccacgcccgccgggtagaaaagatagcgggtattgaagagaaatattgtaaaccccaaacatccaataaaagggagcgtgaataa

SEQ ID NO: 3757 - DNA, 450 bp, Ammonifex degensii
gtgaaaatagccataggttcggatcacggcggctttcagctcaaaaaaaccatctgccgcttcctcgaggaggagggtatagcctaccaggatttcggcacctactcctccgagtcttgcgactatccggacatagccttcgctgtggcggaggcggtggcgcgcggggagttcgatcgggggattttgatttgcggcaccggcatagggatggctattgcggccaataaggtgccggggataagggcagctttgtgtcacgatacctattcagcccgcatgtcccgggagcataacgatgccaacgtgttaaccttaggagagcgggtagtaggaccaggcctggccgtggaaatagttaaggcctggctctcttcttcctttgcaggagagcggcacagccgccgcgtggagaaaatcaaggcgcgcgaaagaggaggttcgaagtag

SEQ ID NO: 3758 - DNA, 546 bp, Moorella thermoacetica
ttgtggcgaacatttaagtatggtttaatattatgggggagagatgaagtgaaattgcgcgtagctctgggtagcgatcatggcggttttcacctgaagatggcgattaaagactacctgaaccggcaggggattgccaatcacgacttcggcacctacaatgccgaatccgtcgattatccagattatgcccataaagtagcggctgccgtcgccagcggcgagtatgatcgcggcatcttgtgctgcggcacgggcatcggcgtctgtatcgccgccaataaggtaccgggtatccgggccgccctgtgccatgataccttttctgcccgggcggcgcgggagcataatgacgccaacatcctgaccctgggggaacgggttatcggtcccggtttggccctggagattgttgatacctggttaaaggccgaattcagcggcggccgtcatgcccgccgggttcagaagatcagcgccattgaagaccagtaccggggccgggaagaccgggttgttgtaccctgttgccatgacgggaagtag

SEQ ID NO: 3759 - DNA, 462 bp, Thermoanaerobacter italicus Ab9
atgatgaagataattttgggtagtgatcattttggtttcgatttaaaagaggttattaaagaacatttacagtctaaaggaattgcagtagttgacataggggtttatgataaaaatccagtggattaccccgatattgctgtagcacttgccgaaagagttgcatcaggagaatttgaaagaggaattcttatttgtggcacagggatagggatggctattgttgctaataaagtacctggagtaagagctgcggtatgccatgatgtgtattctgcggaaagagcacgtaaaagtaatgatgcacaaattatgactatgggtggagtcatagtaggaccagaactagctaaaaaacttgtagatgtgtggcttgagtcagaatttcaaggaggacgttctttaccaaaagtggagaagattaaaatgatagatgcaaaatatcgcggtgtggctaaataa

SEQ ID NO: 3760 - DNA, 447 bp, Thermoanaerobacter mathranii
atgagaattggtatagggaacgaccatgtaggatacgcactaaaattggaaatagccgagcacctgaaaaaactcggtcatgaagtggtggattttggacaccacagcacagaaagaacggattatcctatctatgcaaagatggtagccgacgcggtgaccgaaaagaaagtcgattgcggcattctaatatgcggcaccggtgtgggcatggccatcgccgccaataaggtgggtggtataagggcggtcgtatgtagcgaaccttattcggcaaaactttcaaagcagcacaacaataccaatatcctaacattaggtgcccgggtggttgggagtgaattggcaaaaatgatagtcgaagaatggctcggagctgaatatgaagcgggccgccatgcaaggagattggagatgatagaggagatggaaaaaagacaaaggtaa

SEQ ID NO: 3761 - DNA, 447 bp, Thermoanaerobacter pseudethanolicus ATCC 33223
gtgattgcattaggagctgaccatggtggctatgaacttaaagaagctataaaaaagtatttagatgaaaaaggaatagcctataaagattttggaacttttggtacagaatctgtagattatccagattatgccctcaaagtagcagaggctgttgcatctcatgagtgcagcgaaggaattttagtctgtgggacaggcattggtatgtcaatagcggcaaataaagtaccaggaattagagctgctcatgcagaagatgttttttcagcaaaagccgctaaggaacacaacaatgctaatattttgtgcttgggaggacgcatcacaggaccaggacttgctgtgatgatggtggaagaatggttaaatgcaactttccaaggaggacgtcatcagagaaggattgacaaaatagcggaaattgagaaaaagtatagcaaatga

SEQ ID NO: 3762 - DNA, 462 bp, Thermoanaerobacter sp. X514
atgatgaagataattttgggtagtgatcattttggttttgatttaaaagaagttattaaagaacatctacagtctaaaggaattgcagtagttgacataggggtttatgataaaaatccagtggattatcccgatattgctgtagcacttgccgaaagagttgcatcgggagaatttgaaagaggaattcttatttgtggcacagggatagggatggctattgttgccaataaagtgcctggagtaagagctgcagtatgccatgatgtgtattctgcagaaagagcacgtaaaagtaatgatgcacaaattatgactatgggtggagtcatagtaggaccagaactagctaaaaaacttgtagatgtgtggcttgagtcagaatttcaaggaggacgttctttaccaaaagtggagaaaattaaaatgatagatgcaaaatatcgcggtatggctaaataa

SEQ ID NO: 3763 - DNA, 453 bp, Caldicellulosiruptor saccharolyticus
atgaagttgaaattagcaataggtgctgaccatgcaggttttagattaaaagaggctgtaaaaaaacatcttgacaaaagaggaattgagtacaaagactttggcacgtattcagaggagtcttgtgattatccagacattgcaagggatgtggcaattgcagtgaaaaacggtgagtttgactttgggattttaatctgtggcacaggaataggtatttctattgctgcaaataaaataaaaggtatcagagcagccctttgccatgatacattttcagcaaaggcagcccgcgcgcataacaacgcaaacatccttgcaatgggtgcaagggttattggagaaggacttgcatgcgaaatcgtagatagttttctgtcagcccaatttgaaggtggaaggcaccaaagaagagtggacaagatacatgagattgaaaatatgcaggattaa

SEQ ID NO: 3764 - DNA, 447 bp, Thermoanaerobacterium thermosaccharolyticum
atgattgcaataggttctgatcacggtggatatgagcttaaagaagctattaagaagcacttagatgagaaaggaattgaatacaaagattttggcacatttagcgaggaatcagtagattatcctgactttgcattaaaagtagcggaggcagtagccagtggtcagtttgaaaaaggtatacttctttgtggaactggtgtaggcatttcaattgctgccaataaggtaccaggaatcagggcagctaacgtatctgatgcattttcagcaaggtactcaaaagagcacaataatgcaaatgtgctatgcatggggggaagagttgtaggaccaggtcttgcagccattttggttgatgaatggcttaatgcggaatttcaaggtggaagacatcagaaaagacttgataagattacagaaattgaaaaaaagtattcaaaataa

SEQ ID NO: 3765 - DNA, 453 bp, Thermoanaerobacterium thermosaccharolyticum
atgataatatcattaggatgcgatcatggtggatatgagctaaaagagataataaagaaacatttagaagataaaaatatagaatataaagattttggcacacattcgaaagaatctgtagattatcctgaatatgcactaaaggtagcagaaagcataagaaatggagaaagtgacttaggtatattatgttgtggcacaggcatagggatatcaattgctgcgaataaagttcctggaataagggctgctgttgtaggagatgtattttctgcaagggcttgcaaagaacacaacaatgcaaacataatatgccttggaggaagggtaacaggttcaggacttgctttaatgatagtagacgaatggcttaatgctgaatttagtggcggaaggcatcaaaaaagaatagataaaataactgaaattgaaaagaagtatagtataaaatag

SEQ ID NO: 3766 - DNA, 459 bp, Thermoanaerobacterium thermosaccharolyticum
atgatagctataggttcggatcacgctggatttgaattaaaagaaatcataaaggaatatctagaccagcgtggaattgaatataaagattttggcacttttgataagacaccaacggatacagcggatatcgcacaacctgttgcggaagctgtcgcgaataatgaatgcgaaaggggtattttgatatgtggtaccggaattggcatgtcaatcgcggcaaataaagttcccaaaattagagctgcattagttgaaaatgtcttttctgcaaagtcgagcagagaacacaataatgcaaatataatttgcttaggagcgagagttataggctctggattagcattaatgattattgatacgtggttaaatacagaattcaagggtgaagataagcgcataagacgcattaataaaatcactaatattgaaaggaaatattgcaatattacaaaatga

SEQ ID NO: 3767 - DNA, 462 bp, Coprothermobacter proteolyticus
atgcgaattgtcatgggtgcagatcacgccggttatcaactaaaggaaaggctaaaagaaaacctcatagaacttgggcatgaagtggtggataaggggacaaattccattgaatcggttgactatcccgactatgcagctgaagtttgcactgatattacgaagaatggtggctttggcatactcatctgtggaactggtatcggtatgagcataactgccaataagtttcccggaatacgagcggcacttgcctatgacctttatgcagcaaagaaagctcgccagcacaacgatgcgaacgtgttatgtttgggcggtagggtcttaggtccagacttagctatggaaattgtgcagaccttcttgaatacctctttcgagggaggtagacacttaagaaggataaggaaaatagaaaaaatcgaggagagaaacctgaataaaggatgtgaggcctaa

SEQ ID NO: 3768 - DNA, 441 bp, Catenibacterium mitsuokai DSM 15897
atgaaaattgcagtcgcttgtgatcatggtggattacgtttaaagaatgttcttattgatgaaatgaagaaacagggttatgaagttgtagactatggtacttatactgaagactcttgtgattatcctgattatgcatctaaggcagctaaagctgttgcatcaggagaatgtgagaaaggtgtcgttgtttgtggaacaggcatcggtgtatcaattacatgtaataaggtagatggtatccgctgcgcattatgtcatgatgtatttagtgcgaaagcgacaagagctcataatgatactaacatgattgcaatgggacagagagttattggagaaggactcgctgttgagattcttaatgcatggctacatactgattttgaaggtggaagacatgttaagagaattgaaaaaatgatggctttagaaaaggagtaa

SEQ ID NO: 3769 - DNA, 456 bp, Erysipelothrix rhusiopathiae
atgaaaatcgctatagcagcggaccacggagggtttgaaacaaaagagggactccgtttagtattggaagaaatgggacatgaggtaaaggattttggggtttattctgaagaatcgcaggattatcctgatttcgcatatcctgcagcaaaagctgtagctgaaggtttgtatgatcgaggtgtagttgtttgtggaaccggtgtaggtgtttcaattgtcgcgaataaagttagagggattcgctgtgctctagtaacaagtactgaggttgcgcaactgacacgtgaacacaatgattcaaacatgcttgcattgggagggcgtacaacgccttatgaaaccaatgtcgcaattcttaagacatggattgagacaccatatagcgaagatgcgcgtcatggtcgtcgtatttgtaagatatctgatttagagaccaaggagggccgtgaatga

SEQ ID NO: 3770 - DNA, 447 bp, Holdemania filiformis DSM 12042
atgaaaattgcaatggcttgtgatcatggcgcttataaaaataaggaagcgctgaaagcaaagttgattcaggaaggttacgaggttgaagatttcggatgcttcagcgaggaaagcatcgattatccggaagtggcttatccgtgcgcgaaagcggttgcggatggaaaagcggaccgcggcatcgtcatgtgcggaacggggatcggcgtcagcatcgtcgcgaataaagtgccgggcattcgctgcgcgcatgtgcatgatctggaaaccgcaaagctgacccgcgagcataacgattccaatgttctggcgatgggcggacggattatcagccaggagctgatcgagcagatcgcggaagtctggctgacgacaccgttttccaacgaagaacggcatcagcgccggattgctcagatcgcggaattggagaagcacgcctag

SEQ ID NO: 3771 - DNA, 456 bp, Clostridium ramosum
atgaaaattggaattggaaatgatcatgttgcggttgaatataaaaatgtgatcagagagtatattgaagcaaaatatggctatgaagtaatcaattatggtactgatagcagtgaaagatttaattatccagtttctggtgaagcggtcgctaatgcagttgtaaatggtgaggttgataaaggtatcgtaatctgcggaacaggcgtaggaatttctttggctgccaacaaagtaaatggaattcgctgtgtgacatgtagtgagccatattcagccaaattatcaagagagcataataatactaatatgctggcttttggcgcacgagtagtaggaattgaacttgcaaaaatgattgttgatgcctggttaactggtgagtatgaaggtgggcgtcatcaagttagaatcgatatgttgaaagaaattgaagaaagacaaaaaagtaaataa

SEQ ID NO: 3772 - DNA, 453 bp, Clostridium ramosum
atgaaaattggaattggaaatgatcatgttgcagttgaatataaaaatgtgatcagagagtatattgaagcaaaatatggctatgaagtaatcaattatggtactgatagcagtgaaagatttaattatccagtttctggtgaagcggtcgctaatgcagttgtaaatggtgaggttgataaaggtatcgtaatctgcggaacaggcgtaggaatttctttggctgccaacaaagtaaatggaattcgctgtgtgacatgtagtgagccatattcagccaaattatcaagagagcataataatactaatatgctggcttttggcgcacgagtagtaggaattgaacttgcaaaaatgattgttgatgcctggttaactggtgagtatgaaggtgggcgtcatcaagttagaattgatatgctcaaagatattgaagtgaggcaatgtaagtaa

SEQ ID NO: 3773 - DNA, 444 bp, Clostridium ramosum
atgaaaattgcaatggcttgtgaccatggtggcttaagactaaaaaatgttttaaaagattatttagaagctaatggttacatagtagaagatttcggaacatacagcgaagatagttgtgattatcctgattatgcaggaaaagcagctaaagcggttgctagtggatcgtgcgacagaggggttgtcgtatgtggaactggtatcggtgtaagtattactgctaataaagtgaaaggaattcgctgtgcgttatgccacgatgtatttagcgccaaagcaactcgagcacataatgatactaacatgattgctatggggcaacgagttattggtgaaggtttagctttagaaattttaacagcctggttagaaggcaaatatgaaggtggtcgacatgaccagcggattgcaaaaatgatggcttacgagggggaagagtaa

SEQ ID NO: 3774 - DNA, 444 bp, Clostridium spiroforme
atgaaaattgcagtagcgtgcgatcatggtggatttagattaaaaaatgttttagttgaatatttaaaagatactggttatgaagtagaagattttggttgttataatgaagaaagttgtgattatcctgattatgctggaaaagcagctttagcagtagctaaaggaacatgcgataaaggaattgttgtatgtggaacaggaataggtgtaagtattacagctaataaagtaaaaggtattcgttgtgcattatgccatgatgtatttagcgctaaagcaacacgagcacataatgatacaaatatgcttgctatgggccaaagagtgattggtgaaggtttagctttagaaattgtaaaagcatggttagatggtcaatatgaaggtggaagacatgatcaacgaattgcaaaaatgatggcatatgagggggaaaattag

SEQ ID NO: 3775 - DNA, 450 bp, Eubacterium biforme
atgatgaaaattggtatggcatgtgatcatggagcatatacatataaggaagaaatcaaacaaatgttaattgatgaaggccatgaagttgtagattgtggatgtcatgatacaaatagtgtagattatccggatatggcaaaagcgtgtgcagatttagttgcgaataaagaagtggataagggtattgttatgtgtggtactggaattggaatttcaattgcagctaataaagtaaaaggaattcgttgtgcattatgtacagatgtaactatggctcgtttaactcgtgaacacaatgatgcgaatatgttgagtatgggacaaagaacaacgggaattgaaacttgcaaagatattgttcatactttcttgaacactccatttagtgagggtgaaagacataaaggaagaatcgcaaaaatcagtgcaattgaggatgctcaataa

SEQ ID NO: 3776 - DNA, 450 bp, Eubacterium dolichum
atgattatgaaaattgcggttgcctgtgatcatggcggatatgattataaagaaattgtgaaagatttactgttggaaatgggacatgaagtaaaggatttcgggtgtccttctacacagtcggtagattatacggattttgcggcaccatgtgcaaaagcggtagcaagcaaagaatatgatcggggaatcgttatttgcggtaccggcatcggtgtaagtattacagcaaataaggtaaagggcattcgttgtgcattgtgtagtgatccggttagtgcacagcttactcgtttacataatgattccaatatgttggctatgggagcacgtatcattggtgtagaaatgatgaaggaaatcgtacgtgtgtgggttgaaacacctttttccgaagatgaacgtcatattcgaagaatcaaaaaaatcagcgaattggaaaatgaataa

SEQ ID NO: 3777 - DNA, 432 bp, Fusobacterium mortiferum
atgaaaatagctttaggtgctgaccatggtggatttgaattaaaggagaaaataaaatctcatttattagaaaaaggatatgaggttttagatttaggaactaactcaacagcttctgttgattatccaaagtttggacatgcagtagggcatgcagtagtaaacaaagatgcagattatggaatagtagtatgtggaacaggaataggaatctctattgctgctaataaagttccaggagttagagcagctctttgcacaaatacaactatggcaagacttacaagagaacataatgatgctaatgtattagctatgggaggaagaatagtaggagatgttcttgctcttgagatggtagatattttcctttcaactaaatttgaaggtggaagacatactaatagaataaattctattgaaactatctaa

SEQ ID NO: 3778 - DNA, 450 bp, Fusobacterium nucleatum
atgaagatagctttaggtgcagaccatggtggttatgaattaaaagaaaaaataaaacaacatttagctaaaaaagaagggatagaagtaattgactttggaactaatagtacagaaagtgttgattatccaaagtatgggcatttagttgctaaaagtgttgtagataaagaggttgattttggaattttagtttgtggaacaggtataggtatttctattgcggccaataagataaaaggaataagggctgcaaactgtacaaatacaactatggcaaaattgacaagagaacataataatgcaaatattttagctttaggagctagaatagttggagatgttctagcattagatattgttgatgaatttttatctgcttcttttgaaggtggaagacaccaaaaaagagttgatcaaatagaagtggaagaatgtaatttattttaa

SEQ ID NO: 3779 - DNA, 450 bp, Fusobacterium nucleatum
atgaaaatagcattaggagcagatcatgcaggttttgagttaaaagaaaaaataaaggaatatctattaaaaaaaggtggaatagaagttatagacaaaggaactaacaataaggaaagtgtagattatccaaaatatggacatgcagtagcaaatgcagttgttagtaaagaagtagattttggaattttagtttgtacaactggtgtagggatttctattgctgcaaataaaattaaaggagtaagagctgcactttgcactgatacaactactgcaaaattaacaagagaacacaatgatgcaaatatcctagcattaggttcaggaattgttggacaatttgttgcattagatatagttgatacattcttatcaacttcttttgaaggtggaagacatcaaaaaagagtggatcaaatagaagtggaaggttgtaatttattttaa

SEQ ID NO: 3780 - DNA, 450 bp, Fusobacterium nucleatum
atgaaaatagcattaggagcagatcatgcaggttttgaattaaaggaaaaaataaaagaatatctattaaaaaaaggtggaatagaaattatagacaaaggaactaatagcaaagaaagtgtagattatcctaagtatgggcatgcagtagcaaatgcagttgttagtaaagaagtagattttggaattttagtttgtacaactggtgtaggtatttctattgctgcaaataaaattaaaggagtaagagctgcactttgcactgatacaactactgcaaaattaacaagagaacacaatgatgcaaatatcttagcattaggttcaggaatagttgggcaatttgttgccttagatatagttgatacattcctatcaactgcttttgaaggtggaagacataaaacaagagtggatcaaatagaggtagaaggttgtaatttattttaa

SEQ ID NO: 3781 - DNA, 444 bp, Fusobacterium periodonticum
atgaaaatagcattaggtgcagatcacggtggatatgaattaaaagaaaaaataaaacaacatctaagcaaaaaagaaggaatagaagttatagattttggaactaacagtacagaaagtgttgattatccaaaatatggtcatttagttgcaaatagtgtagttaacaaagaagttgactttggtatcttagtttgtggaactggtataggaatttctatagcagctaacaaaattaaaggtataagagcagcaaactgcacaaatacgactatggcaaaattgacaagagaacacaatgatgcaaatattttagctctaggtgctagaatagttggagatgttttagctttagatatagttgatgaattcttagctgcttcttttgaaggtggaagacatcaaaagagaatagatgaaatagaaacttgtaatttattttaa

SEQ ID NO: 3782 - DNA, 444 bp, Fusobacterium sp. 2_1_31
atgaagatagcattaggtgcagatcacggtggatttgaattaaaagaaaaaataaaacaacatctaagcaaaaaagaaggaatagaagttatagattttggaactaatagtacagaaagtgttgattatccaaaatatggtcatttagttgcgaatagtgtagtaaataaagaagttgactttggtatcttagtttgtggaactggtataggaatttctatagcagctaacaaaattaaaggtataagagctgcaaactgtacaaatacaactatggcaaaattaacaagacaacataatgatgcaaatattttagctttaggtgctagaatagttggagatgttttagctttagatatagttgatgaattcttagctgcttcttttgaaggtggaagacatcaaaagagaatagatgaaatagaagcttgtaatttattttaa

SEQ ID NO: 3783 - DNA, 450 bp, Fusobacterium sp. 3_1_33
atgaaaatagctttgggtgcagatcatggtggttatgaattgaaggaaaaaataaaacaatatttatccataagaaaaggaatagaactaatagattttggaactaacagtacagaaagtgttgattatccaaaatatgggcatttagttgctaaaagtattatagataaagaagttgattatggaattttagtttgtggaacaggtataggtatttctattgcagctaataagataaaaggaataagagctgcaaattgtacaaatacaactatggcaagattatcaagacaacataatgatgcaaatattttagctttaggagctagaatagttggagatgtactggcactagatattgttgatgaatttttatctgcttcttttgagggtggaagacatcaaaaaagagtggatcaaatagaaatagaagaatgtaatttattttag

SEQ ID NO: 3784 - DNA, 444 bp, Fusobacterium sp. 3_1_5R
ttgaagaagataggattgggagcagatcatggaggatttgcattaaaagaagtcattaaaaagcatttattagaaaaaggatatgaagttgaagattttggaactcactcaacagaatcagtagattatccaaaatatggaaagctagtagcacatgctgtgattgataaaaaagtagattgtggaattttggtatgtggaaccggaattggaatttcgattgcagcgaataaactatcaggaattcgtgcagctctttgtacaaatgttaccatggctaaactaacaagacaacacaatgatgctaatattcttgctttaggaggaagaattattggagatgttgttgctttagaaattgttgatactttcttaacgactgaatttgaaggtggaagacatagtagaagaatagaaagtattgaatcttgtgaattattctaa

SEQ ID NO: 3785 - DNA, 450 bp, Fusobacterium sp. 4_1_13
atgaaaatagcattaggagcagatcatgcaggttttgaattaaaggaaaaaataaaagaatatctattaaaaaaaggtggaatagaagttatagacaaaggaactaatagcaaagaaagtgtagattatcctaagtatgggcatgcagtagcaaatgcagttgttagtaaagaagtagattttggaattttagtttgtacaactggtgtaggtatttctattgctgcaaataaaattaaaggagtaagagctgcactttgcactgatacaactactgcaaaattaacaagagaacacaatgatgcaaatatcttagcattaggttcaggaatagttgggcaatttgttgccttagatatagttgatacattcctatcaactgcttttgaaggtggaagacataaaacaagagtggatcaaatagaagtagaagggtgtaatttattttaa

SEQ ID NO: 3786 - DNA, 450 bp, Fusobacterium sp. 7_1
atgaagatagctttgggtgcagaccatggtggttatgaattaaaagaaaaaataaaacaatatctagctaaaaaaggtggaatagaagtaattgactttggaactaatagtatagaaagtgtagattatccaaaatatgggcatttagttgctaaaagtattgtagaaaaaaaagttgattttggaattttagtttgtggaacaggaataggaatttctattgcagcaaataagattaaaggtataagagctgcaaactgcacaaatacaactatggcaagattagcaagacagcataatgatgcaaatattttagctttaggtgctagaatagttggagatgtgttagcattagatattgttgatgagtttttggtttcttcttttgaaggtggaagacatcaaaaaagagtggatcaaatagaaatagaagaatgtaatttattttag

SEQ ID NO: 3787 - DNA, 450 bp, Fusobacterium sp. D11
atgaaaatagctttaggtgcagatcatggtggttatgaattgaaggaaaaaataaaacaatatttatccatgaaaaaaggaatagaactaatagattttggaactaacagtacagaaagtgttgattatccaaaatatgggcatttagttgctaaaagtattatagataaagaagttgattatggaattttagtttgtggaacaggtataggcatttctattgcagctaataagataaaaggaataagagctgcaaattgtacaaatacaactatggcaagattatcaagacaacataatgatgcaaatattttagctttaggagctagaatagttggagatgtactggcactagatattgttgatgaatttttatctgcttcttttgagggtggaagacatcaaaaaagagtggatcaaatagaaatagaagaatgtaatttattttag

SEQ ID NO: 3788 - DNA, 444 bp, Fusobacterium sp. D12
ttgaaaaagataggattaggagcggatcacggaggttttgcattaaaagaagagataaaacaacatctattggagaaaggatatgaagtagaagacttcggaactcattcgacggagtcggtggattacccaaaatatggaaagttggtggctcatgccgtagttgataaaaaagtggactgtggaattttagtttgtggaacaggaattggaatttccattgcggccaacaaaatttccggaattcgagcagccctttgtaccaatgtaaccatggcgagattgaccagacaacacaatgatgcaaatattcttgccttagggggaagaattattggagacgttgtggctctggaaattgtagatactttcttggaaacggaatttgaaggaggaagacattccagaagaattgaaagtattgagtcttgtgacttattctaa

SEQ ID NO: 3789 - DNA, 432 bp, Fusobacterium ulcerans
atgaaaattgctttaggtgcagatcatggtggatttgagctaaaagaaaaagtaaaaactcatcttattgaaaaaggatatgaagtattggatttgggaactaattcaactgactctgtagattatcctgaatttggtcatgcagtaggacatgctgttgctgataaaaaagctgaatttggaattgttatctgtggaactggaataggtatctctattgctgccaataaagttcccggtgtaagagcagctctttgcacaaacactactatggctagattgactagagaacataacaatgccaatattcttgcaatgggtggaagaatcgtcggagacgttcttgctcttgaaatggtagatactttccttggtactgaattccaaggtggaagacatgaaaaaagaatcaacaaaatagaaagtatctaa

SEQ ID NO: 3790 - DNA, 432 bp, Fusobacterium varium
atgaaaattgctttaggtgcagatcatggaggatttgaactaaaagaaaaagtaaaaacacatcttataaaaaatggatatgaagtattagatcttgggacaaattcaactgactctgtagattatcctgaatttggtcatgctgttggtcatgctgttgttgaaaaaaaagctgaatttggaatagttatctgtggaactggaataggtatttccattgctgctaataaagttcctggtgtcagagcagctctttgcactaatactacaatggcaagattgactagagaacataataatgctaatattcttgcaatgggtggcagaattgttggagatgttcttgcacttgaaatggtagatgtttttcttgctactgaattccaaggtggaagacatgagaaaagaatcaataaaatagaaactatctaa

SEQ ID NO: 3791 - DNA, 429 bp, Leptotrichia buccalis C-1013-b
gtgaaaatagcaattggaaatgaccatgcgggagtagaatttaaaaataaacttatggaagaattgagaagcaaagggtatgaaattatgaatgtaggaactgatacattagattcggtggattatcctgatattgcgaaaaaagttagtgaaaaagtacttaatggagaagcaaaatttggaattttgatttgtggaactggaataggaatttctattgctgcaaataaaataaagggaattcgtgcggctctttgccacaatgaatatacagcaaaactttcaagacttcacaatgatgcaaatattatagcgttaggagcgagagttttaggtgaagatttagggctggcttgtgttgaagcatttgtaaatacagaatttgaaggtggcagacatgctaaaagagtcggaaaaatagaattgtaa

SEQ ID NO: 3792 - DNA, 435 bp, Leptotrichia goodfellowii F0264
atgaaaatagccataggaaacgatcatgcaggggtcgatttaaaacataaaattgtagaatttctgagaaaaaaaggacatgaagtaactaatgtcggaacggatactcttgattctgttgattatccggacattgcaaaagaagttgcagaaaaagtattgagcggagaagcgaaatacggagtgttgatttgcggaacaggaataggaatttcaatttctgcaaataaagtgaaaggaataagagcggcacttgtacataatgaatttacggcaagactgtcgagacttcataatgatgccaatgttattgcattgggagccagagttttaggagatgaacttgcggcaatgtgtgtcgatacatttataaatactgaatttgaaggtggcagacatgcaagaagagtaggaaaaatagaggaggaaaaataa

SEQ ID NO: 3793 - DNA, 432 bp, Leptotrichia goodfellowii F0264
atgaaaatagcaataggaagtgaccatgtaggattggaattaaaacctgtaatagtggaatatttaaaagaattaggacatgaagtcgaagattttggagcgtattcaaaagaacgaacagattatccaatttatggagaaaaggttgcaaaagctgttatagaaggaaattatgactgcggaatagttatgtgtggaacgggagtaggcatctccatagcggcaaataaaataaaaggaataagagctgtcgtatgcagtgaaccttattcggcaaaattgtctaaagagcataataatactaatatattagcattcggatcaagagtaataggaagtgaattggcaaagatgattgtaaaggaatggctggaggctgagtttgaaggtggacgtcatgcgaatagggtgaatatgcttgataatatgtaa

SEQ ID NO: 3794 - DNA, 429 bp, Leptotrichia hofstadii F0254
atgaaaatagcgattggaaatgatcatgcaggggtagaatttaaaaataaaatgatgaaggaacttagaagcaaaggatatgaaattgtaaatgtgggaactgatactttagattcagttgattatcctgatattgcaaaagaagttggtgaaaaagttcttgctggggaagtggactttggaattttaatctgtggaactggaattggaatttctattgccgcaaataaaataaaaggaattcgtgcggctctttgtcacaacgagtatacagcaaaactttcaaggcttcacaatgatgcaaatattatagcgttaggagctagagttttaggagaagatttgggattagcatgtgttgaagcgtttataaatacagagtttgaaggtggcagacacgctaaaagagttggaaaaatagaattataa

SEQ ID NO: 3795 - DNA, 450 bp, Sebaldella termitidis
atgaatattgcattaggctgtgatgaggccggcttcgatctaaaacagatcatagctgctaaattaaaagagctggggcatagtatagaagactatggctgttatgataaaaatcctgttttatatcctgatatcggaagaaaagtggcagaagcaatagccggcggaaaacatgaaagaggagttttaatttgcggtacaggtataggcatgtgtattactgctaataaaatcccgggtgtcagtgcagcagtttgtcatgacagtttttcggcagtccgttcaagatgttccaataatgcacaaattatgtgtatgggtgcaagagtaataggaaatgaactggcaaaacagctgttagaaatctggctttcaaatgatttttcaggcggaggcagtacagacaaagtagaaatgattaatgaaatagaaaaaatttaccgccgttga

SEQ ID NO: 3796 - DNA, 432 bp, Sebaldella termitidis
atgaaaatagcaattggtaatgaccatgcaggtgttgatcttaaagaaaaagtagcagattttttaaaaggtaaaggatacgaggtcgaaaatgtgggaacagatactaaagaatctgtagattatcctgatattgcaagaaaagtagctaaacttgtcaatgataaagagtgtgaatttggtatagttatatgcggtaccggtataggaatatcaattgctgccaataaagtaccagggataagatgtgcattgtgccataattcgtttactgcgaaattaagcagacttcataataattctaatgttttatctttaggtgcgagagtaatcggagatgagctggcactcgatattgtagatgcgtatctgactacagactttgaaggcggaagacatgccagaagagtagataagatagaagaatgctaa

SEQ ID NO: 3797 - DNA, 444 bp, Sebaldella termitidis
atgaaattagcaataggaagtgatcatgtcggattggaattaaagccgataattattgattatttgaaagagctgggacatgaagtggaagattttggtccgtatacagcagaaagaacagattatcctgtttatggcaaaaaggtagcagaggaagtagtaagcggtaattttgatcttggaattttgatatgcggtacaggagtaggaatctctatagctgccaataaagtaaagggaatacgtgctgtggtgtgcagcgagccttactcggcaaagttatcaagagagcataataatacaaatatactggcttttggtgcaagagtcataggaagcgagcttgccaagatgatagtaaaagaatggcttgatgccgaatttgaaggtgagcgtcatgcgaaccgtgtaaaaatgataagtgaaatagaaaacgaaagatag

SEQ ID NO: 3798 - DNA, 453 bp, Streptobacillus moniliformis
atgaaaattgcaatagggaatgatcattctggtgttgattttaaaaatcaattagtagattatttattatcaaaaggaattgaagttttaaatgtaggaactgatagtgcagattctgtagattatccagatatagctaaagaagtttcaaagaatgtattgaataaaaatgtagattttggaatattaatatgtggtacaggtataggaatatcaatagctgcaaatagaatatctggaattagagcagctttagttactaatgaattatgtgcaagattatcaagacaacataatgatgcaaatgttttagtattaggtgcaagagttacaggaattgaacttgcaaaatcatgtatagatgcttttttaagtgctgattttgaaggtggaagacatagtggaagattttcaaaaatagaatgtaattgtggaagtggagtgatagattaa

SEQ ID NO: 3799 - DNA, 483 bp, Gemmatimonas aurantiaca T-27
gtggcacatccgggtgaacgcattccgatcgcttccgatcacgccggcttcgaactgaaggaacgcttgcgcaccgtgctgtcggagatggggtactccgtcgatgacatcggcacgcacagcacggcgagcaccgactaccccgactacgcgcacccgctctcgcagcaggtgtcggacggcgccgtgcagcgtggggtgctgctgtgtggcacggggttgggcatgtcgtacgtggcgaatcggtacccgggtgtgcgcgcggccgtctcctggagtccggagatcgccgcgctcgcccgcaagcacaatgacgcgaacgtgctggtgttgccggcgcgttttgtgtccgatgaagacgccattgccatcctgcgcacgtggctcgagacgccgttcgaaggagggcgtcatcagggccgtgtggccaagatcgaacagaccaacgaacacggggatgacaccccagggagtggtgcatga

SEQ ID NO: 3800 - DNA, 477 bp, Leptospirillum rubarum
atgatggaatcttcgcaatctcgtatcgtcatcggctccgaccacgccggttatcccctgaaagaatccttacggaaacgtctggagaaagacggctacccccttctggatgtcgggacgttctccgaagaatctgtcgactatcccgattatgccgaaaaagtcgcccgggctctgcatgccggagagggagatattggcattctcctctgcggaaccggcatcggcgtatccattgccgccaataaaatcaaaggcatccgggcggctctcatttacaacgatgagacagccagtcttgcacaccggcataacaatgccaatgttatttgtttcggcggacgggaagtctccgaagatcaggcccacacctggacccgactcttcctctccgcatccttcgaaggcggaaggcaccaacgaagaattgacgagatttctgcacttgaatcgcccggaaacattgggcactcctaa

SEQ ID NO: 3801 - DNA, 477 bp, Leptospirillum sp. Group II '5-way CG'
atgatggaatcttcacaagctcgtattgtcatcggatccgaccacgccggttatcccctgaaagaatccttacggaaacgtctggaaaaagatggttatccccttctggatgtcgggacattctccgaagaatctgtcgactatcccgattatgctgaaaaagtcgcccgtgccctgcacgccggagagggagatattggcattctcctctgcggaaccggcatcggtgtatccattgccgccaacaaaatcaggggcatccgggcggcgctcgtttacaacgatgagacagccagtcttgcccaccggcataacaatgccaatgttatttgtttcggcggacgggaaatctctctagagcaggcccacacctggaccagactctttctctccgcatccttcgaaggtggccggcaccaacgaagaattgacgagatctctgcccttgaatcccctggaagcacagggcagtcttaa

SEQ ID NO: 3802 - DNA, 459 bp, Leptospirillum ferrodiazotrophum
atgattctctattttggctcggaccatgctggccgcgagcttaaggacatccttctggctcatgccaagtccaaagggatctctaccaccgattgcggaaccaatgccgacctttccgtcgactatcccgactatgcccgcaaggtcggcgaggccgttatgtcgactcctgaagcctacggcgtcctcgtctgcggaaccggtatcggaatgagcatcgccgccaacaagatccggggcatccgggccgccctcgtctacaacgaggagacggcccgtctggcccatcagcacaacaacgccaacatcattgtctttggaggccgggaaatggctgccaaagacgcctcttcctggctcgacaccttcctttccgccgcatttgaaggagggcgccatggccgaagaattgagaaaatcgccgagatcgaacaggaaaatcacggaacaaatccctaa

SEQ ID NO: 3803 - DNA, 453 bp, Thermodesulfovibrio yellowstonii
atgaagattgcaattggtgctgatcatgcaggttttgaattaaaagaactaatttcccaaattgttgaagatgcagggtatgaagttattgatatgggaactggttcatcctgttctgttgattatccagactatgcagaagcagttgcacaggcagtatctgatgaaaaagctgaaagaggcattttaatatgcggcacaggaataggaatgtcaatagttgcaaataaatttaagaatgtaagagcagccttatgtaatgacctgtttactgcaaaaatgtcaagacttcataatgatgctaatattctttgtatgggcgcaagagtcattggaaaaggacttgcaatagagatagtcaaaacatggcttagcacaccctttgaagctgaaagacatttaaaaagggttgaaaaaataaatattatagaaaggaaggttattaataaatga

SEQ ID NO: 3804 - DNA, 438 bp, Blastopirellula marina DSM 3645
atgaagatcgtcgtcgcttccgaccacgccggctttcactacaagcaagcgattttggagtacttacagaaattgggacacgaagcggccgattacggcacgttttcggcagagtcatgcgactaccctgatttcatcatgccagccgctcaagcagtcgccgatggcaaatttgagcgtggaatcgtgctcggcggctccggcaacggcgaagcgatcgcggccaatcggatccgcggagtgcgctgcgcttattgctggagcgtagaaaccgcccagcttggccgccggcataacaacgccaacgtgatcgcgatgggcgaacgcctgatcgagttgccgctggcgctagaaattgtcgacgcttggctcgccggcgagttcgaagggggccggcatcaacgtcgcatcgagaagctcgacgtgttcgaaggctaa

SEQ ID NO: 3805 - DNA, 462 bp, Blastopirellula marina DSM 3645
atgcgcatcgccattggcagcgaccatcgcggcgtaggcgttcggcacagtattattgagttgttaaaacgactcgggcacgaagtgcaagacgtcggcgctttcgattgcggtagtgtcgattatcccgatattgcggcgacggtcagccaaagcgtcgccgccgaagaggtcgatcgcggcatcttgatctgcggcagcggcatcggcatggcgatcgtcgccaataaagtgcccggcgttcgcgccgcgacctgtcacgatgacctaaccgccgaaatgagccgccgacacaacaatgtgaacgtattatgtttgtcggccgacatgctcggcgaacgactgatcgaccggatggtcgaaatttggctaacgaccgaattcgagggtgggcgtcatgctcgtcgtatcgaaaaaatcagtgagtttgaaaaacgactacacgagccgaagtctccctag

SEQ ID NO: 3806 - DNA, 456 bp, Gemmata obscuriglobus
atgaaggttgccgtgggcaacgaccaccgcgggctgtgcgtgcggccgcgcgtcctcgggttgctggccgaactggggcacgaggtgcacgacctcggcgccagcggaccggccggcgtggactaccccgactacgcgatcccggtggccgaagaggtagccgccggtaaagccgaccgcggcgtcctcatctgcgcgaccggtcacgggatgtgcatcgcggcgaacaaggtccacggcatccgggccgtcaacagccgcgatgtcatcgacgccgagctgagccgccgacacaacgactcgaacatcctgtgtctggcggcggacttgctcggggaagaccaaatcgagcgcatcatccgggcgtggctgctgaccgacttcgagggcgggcgccacacccgccgccgcgagaaagtggacgcctacgaaaagagccacgagaaccggacctga

SEQ ID NO: 3807 - DNA, 474 bp, Planctomyces limnophilus
atgcgaattgcccttggatgtgatcacggcggatttccactcaaggctaaagtcgccgaagtggtgaagtcgtgcggtcacgaaattgttgatctggggacagattcgagctgttccgtcgactatccggattatgggctcacaggggggctggccattgcccgccgggaggcggatcgcgcgattctgctctgcggctcaggaattggtatcagcgtcgctgccaataaggtacctggtgtgcgtgcgggcgtctgccacgacacttactcggcccatcaaggggttgagcacgatgatatgaacgtcctatgtctgggtgcccggattgtcggcgaagctctcgcactcgagatcgtgcagtcgtttctgaatgcgcggtacacccacgaagaacgccacgcccgccgcctggctaaacttctcgaaatcgaacgccgtgccaattcgggtgaatggacaccagcttcttaa

SEQ ID NO: 3808 - DNA, 462 bp, Planctomyces limnophilus
atgatgaagatagccgttgccagcgatcatcgcggcgtgcaaatcaaatccaaaatcctcgcactggtgtccgatctcggacatcaggctctcgattttggaccgcaggatcacgagagcgtcgattaccccgactacggtgcccgcgtggcaaaagccgtctctcgtgcagaggtcgatcgtggcatcctcatctgtggcacaggcatgggcatgtgcatcgtcgccaataaattccgtggtgttcgagccgctacttgccacgatgacgtcactgccgaactcagtcgccgacacaataacgctaacgtcatgtgtctctcgggcgatcttctcggcgagccatttgccatgagaatggtcgaaatctggctcaccactgaattcgaaggtgccaggcatgcccggcgtgtcgacaaaatctctcattacgagtccgaagaattttcatcgaactcctga

SEQ ID NO: 3809 - DNA, 462 bp, Planctomyces maris
atgacatctccaactcctgcagaaacccccgtcaaaagtattgttattgcctccgaccatgccggctatcggtacaaacgccgcatcattgagtatctgacgaaagaaggataccaggtggaagacatgggcaccgattccacagagtcggttgactatcccgactttatcatgccggcggcccgcgcggttgcggaaggaaagtatacgcggggcattgtcctgggaggttccgggaatggagaagcgatcgccgcgaatcgcatcaaaggcgtgcgttgtgcggtctgctggaacgagaaatcagcgcgactggcgagcatgcataataacgccaacatgatctcaattggcgaacgcatggtttcgctgcacgatgtgtacgagatcatcgacatctggctcagcacgccgttcgaagggggccgccacgccagacgcattgaaaagctggatgaataa

SEQ ID NO: 3810 - DNA, 456 bp, Planctomyces maris
atgaaaattgcagttgccagtgatcaccggggatttgctacaaaggccaagatcctcacacttctcaaccagttaggacatgtggcctttgattatggtcccgaggatggagaaagtgtcgactatcccgactacgcagtaaaagtcgcgaaagccatcggtgaaaaagcaattgatcgtggtatcctgatctgtggtactggcatgggcatgtgcatcgttgccaataaatttccaggagtgcgtgcgactccctgccacgacgatatcaccgcccagatgagccgcctgcacaatgactccaatgtgctctgtctgtctgcggatctactgggagaccggctcgtcaaccgcatgattgaaatctggctgaaagaggaattcgaaggtggcagacacgcacggcggctggaaaaactgcacaaagttgaagaagagaacatgcccccgcattaa

SEQ ID NO: 3811 - DNA, 519 bp, Rhodopirellula baltica SH 1
ttggcatctcttttttggctcgttctttcgtcggtacctggtcctatgtcgcaaaatgcggattccgtctcgcccattcgcctggctgttggtggtgaccatgccggtttcgctctgaaacaactggttgtcgagcgttttggttcgcaggtcaccagcctgatcgactgcggcaccgatgacgaaacctcctgcgactaccccgatttcgctgtcgaagtcgccgaacgaatcaacagcggcgaagccgatcgtggcttgctgatttgcggcagcggtgtcggggtcagcgtcgcggccaataaaatcaccggcatacgcgcggcgatttgtcatgacacatactccgcacgccaaggcgtggagcacgacgacatgaatgtgctctgcatcggaggccgaatcatcggcagcgaattggcattcgaaatcatctcgtcgtttctgaacgccaaatacactcccgaagaacgccatcagcggcgactcgacaagatcctggctctcgaatgcgactga

SEQ ID NO: 3812 - DNA, 474 bp, Rhodopirellula baltica SH 1
atgacaatcaaagtaggcctggcgagcgaccaccgtggcgtgcacatcaaagcacgtctcttgcaaacgcttcaacgcgaagggttcgaggtatgcgatgagggcaccgactcgaccgaccctgtcgactaccccgatttcgcaatccgcgttgccgagcaaattcgcgacggcagattggatcgcgggatcctgatctgcggcactgggatcggaatggcaattgtcgccaacaaattccatggtgtccgagcggcttcatgttacgacgaagtcatcgtcgaaatgtctcgccgccacaacgatgtcaacgtgctgtgtttgccaggtgatttgatcggtgaacgccctgtcgatgaattggttctgatgtggcttcgcaccgatttcgaatgcgggcgccacgcacaacgcgtcgacaagattacggcaatcgacagcatcgacacgcctgacatcaatcgcggcgtctag

SEQ ID NO: 3813 - DNA, 468 bp, Candidatus Kuenenia stuttgartiensis
ttgtgtgacgataaaatgaaaattgccattggatccgaccatgccggtttatggttaaagaaatcatttatagcacattttgataaaccggagtaccagttaattgatgtaggcacatacagtacagaaccggtagattatcctgattatgcagaagcggttggcagaaaattactagatgggagcgccgataggggtattttgatttgctgtagtggtgttggagcttctgttgcggcaaacaagattcctggtattcgtgccgggctttgccacgatacctattctgctcaccagggcgtggaacatgatgatatgaacatacttgtgcttggcgcatgtatagtaggattaaaactagccattgaactcgtccagtcattcttaggcgccacatttaacggagaagaacgtcacaagagaagagtagggaaaattcaatttattgaaaaacgttacaaaggctaa

SEQ ID NO: 3814 - DNA, 510 bp, Candidatus Kuenenia stuttgartiensis
attgagaatcgggataatttttttgtacatttttttatggaagattgtgaaacgacaatgaagattgcaatagcatcagatcacagagggtatgattttaaagaacgtattaaggtaacattgaaggaattaggccattccgtaacggattttggcacttcatcaaaatcggagtccgtggattaccccgattttggaatgaaggcggcgctttcggtgggacacggggaatgcgacaggggtattttaatctgcggcaccggaataggtatgtcgcttgtagcaaacaaggtaaggggcgtcagggcgactttatgccacaatctttatacggtagaaatgagcagacggcataatgatgccaatgtactgtgcatcggtgcggatattatcgacgaagaacttttggaacaaaaagtaaaactatggttagaaacgccttttgaagggggaagacacgcccgccgtttggagaaaatagtggaactggaaaatggaggcggaatttaa

SEQ ID NO: 3815 - DNA, 447 bp, Caulobacter sp. K31
atgcgcatcgccatcgcctcggatcatgccgcgattgagctcaaggccgaactggccgagtggcttaccggcgaaggccatgacgtggcggatctaggttccgacggcgccgcgcgggtcgactatcccgactatggctacgagcttgccgcgtacatcgcggcaggatgggccgagcgcggcattgcgctctgcggctcgggcataggcatctccatcgcggtcaatcgcaatccggcatgccgctgcgcgctggtcaacgaccccgtctcggcaaccctcggccgcgcgcataacgacgctaacgtcatcgccctcggcgcccgcctcgttgggctggacgtggccaaggcctgcgtcgccaagttcctcgagaccgagtttgccggtggccgtcatggcccgcgtgtcgagaagctcggcctgttgcccgctccgcgatgctga

SEQ ID NO: 3816 - DNA, 462 bp, Aurantimonas manganoxydans SI85-9A1
atgaaactcgcgatcgccggcgacagcgccggagctcccctcgccaaggcccttgccgaacatctgaccggcaaggccggcctcgaggtctccgaggtcagcaacccgcccgaaggcgccgagaaattctatgccgacctgtccgaccgggtcgccagcggcattctcgacggcacctatcaccgggccatcctgtgctgcggcaccggcatcggcgtctgcctgtcggccaacaaggtgccgggcatccgcgccgcgcagacccacgacacctattcggccgagcgcgcggccctgtccaacaacgcccagatcatcaccatgggcgcccgggtggtcggctccgagctcgccaagagcatcgccgaggcgtatctggcctgcgaattcgatcccaacggccgctcggccgacaatgtgaaggcgatcgacgccctcgacgccaaatatcacggggcctga

SEQ ID NO: 3817 - DNA, 456 bp, Brucella abortus
atgaaagtagcagttgcaggcgacagcgccggcgaaggcctggccaaggttctcgccgatcacctcaaggaccgcttcgaggtttcggaaatctcgcgcacggatgctggcgcagatgcattctacgccaacctctccgaccgcgtggcttccgccgttctcgatggcacctatgaccgtgccatcctcgtttgcggcaccggcatcggcgtgtgcattgcggccaacaaggttccgggcatccgcgcagcactgacgcatgacacttattcagcggaacgcgcagccctttccaacaacgctcagatcatcaccatgggcgcgcgcgtaatcggcgcggaagtggcaaagaccattgccgacgccttcctcgcccagacttttgacgaaaatggccgctcggctggcaatgtcaacgcaatcaacgaagtgtatgccaagtacaacaagttctga

SEQ ID NO: 3818 - DNA, 495 bp, Brucella abortus
gtgcgccaccaaggttcaagcgaattaaggagtaaaatcatgaaagtagcagttgcaggcgacagcgccggcgaaggcctggccaaggttctcgccgatcacctcaaggaccgcttcgaggtttcggaaatctcgcgcacggatgctggcgcagatgcattctacgccaacctctccgaccgcgtggcttccgccgttctcgatggcacctatgaccgtgccatcctcgtttgcggcaccggcatcggcgtgtgcattgcggccaacaaggttccgggcatccgcgcagcactgacgcatgacacttattcagcggaacgcgcagccctttccaacaacgctcagatcatcaccatgggcgcgcgcgtaatcggcgcggaagtggcaaagaccattgccgacgccttcctcgcccagacttttgacgaaaatggccgctcggctggcaatgtcaacgcaatcaacgaagttgatgccaagtacaacaagttctga

SEQ ID NO: 3819 - DNA, 456 bp, Brucella melitensis
atgaaagtagcagttgcaggcgacagcgccggcgaaggcctggccaaggttctcgccgatcacctcaaggaccgcttcgaggtttcggaaatctcgcgcacggatgctggcgcagatgcattctacgccaacctctccgaccgcgtggcttccgccgttctcgatggcacctatgaccgtgccatcctcgtttgcggcaccggcatcggcgtgtgcattgcggccaacaaggttccgggcatccgcgcagcactgacgcatgacacttattcagcggaacgcgcagccctttccaacaacgctcagatcatcaccatgggcgcgcgcgtaatcggcgcggaagtggcaaagaccattgccgacgccttcctcgcccagacttttgacgaaaatggccgctcggctggcaatgtcaacgcaatcaacgaagttgatgccaagtacaacaagttctga

SEQ ID NO: 3820 - DNA, 495 bp, Brucella melitensis
gtgcgccaccaaggttcaagcgaattaaggagtaaaatcatgaaagtagcagttgcaggcgacagcgccggcgaaggcctggccaaggttctcgccgatcacctcaaggaccgcttcgaggtttcggaaatctcgcgcacggatgctggcgcagatgcattctacgccaacctctccgaccgcgtggcttccgccgttctcgatggcacctatgaccgtgccatcctcgtttgcggcaccggcatcggcgtgtgcattgcggccaacaaggttccgggcatccgcgcagcactgacgcatgacacttattcagcggaacgcgcagccctttccaacaacgctcagatcatcaccatgggcgcgcgcgtaatcggcgcggaagtggcaaagaccattgccgacgccttcctcgcccagacttttgacgaaaatggccgctcggctggcaatgtcaacgcaatcaacgaagttgatgccaagtacaacaagtgctga

SEQ ID NO: 3821 - DNA, 456 bp, Brucella suis
atgaaagtagcagttgcaggcgacagcgccggcgaaggcctggccaaggttctcgccgatcacctcaaggaccgcttcgaggtttcggaaatctcgcgcacggatgctggcgcagatgcattctacgccaacctctccgaccgcgtggcttccgccgttctcgatggcacctatgaccgtgccatcctcgtttgcggcaccggcatcggcgtgtgcattgcggccaacaaggttccgggcatccgcgcagcactgacgcatgacacttattcagcggaacgcgcagccctttccaacaacgctcagatcatcaccatgggcgcgcgcgtaatcggcgcggaagtggcaaagaccattgccgacgccttcctcgcccagacttttgacgaaaatggccgctcggctggcaatgtcaacgcaatcaacgaagttgatgccaagtacaacaagtgctga

SEQ ID NO: 3822 - DNA, 459 bp, Ochrobactrum anthropi
atgatgaaagtagcagtagcaggcgacagcgccggtgaaggtctggccaaggttctcgccgatcacctcaaggatcgcttcgaggtttcggaaatctcgcgtacagacgctggcgcagatacattctacgccaacctctccgaccgcgtggcttccgccgttctcgacggcacctatgaccgcgccatcctcgtttgcggcaccggcatcggcgtatgcattgcagccaataaggttccgggcatccgcgccgcgctgacgcatgacacctattcggcagagcgcgcagcgctttccaacaatgcccagatcatcaccatgggcgcccgcgtcatcggctcggaagtggccaagaccattgccgacgccttcctcgctgagacctttgacgaaaatggccgttcggctggcaatgtcaacgcgatcaacgaagttgacgcgaagtacaacaagggctga

SEQ ID NO: 3823 - DNA, 456 bp, Ochrobactrum intermedium LMG 3301
atgaaagtagcagtagcaggcgacagcgccggcgaaggtctggccaaggttctcgccgactatctgaaggaccgtttcgaggtttcggaaatctcgcgcacggatgctggcgcggatgcattctacgccaacctttccgaccgcgtggcttccgcagttctcgacggcacctatgaccgcgccatcctcgtttgcggcaccggcatcggcgtgtgcatcgcagccaacaaggttccgggcattcgcgccgcgctcacgcacgacacctattcggcagaacgcgcagcgctttccaacaacgcccagatcatcaccatgggcgcccgcgtcatcggctcggaagtggccaagacgattgccgacgccttcctcgcacagaccttcgacgaaaacggccgttcggctggcaacgtcaacgcgatcaacgaagtcgacgcgaaatacaacaagggctga

SEQ ID NO: 3824 - DNA, 456 bp, Ochrobactrum intermedium LMG 3301
atgaatattgtcgttggaagcgaccatgcgggctttccgttgaaagctgacgtgatcgaggtcctcaaagagctcggtcatcaggtggaagacattggtagcttcacgccggatcctgtcgatttccctgacatagcaggcctgctctgcaagaaggtgcgggatggttcagccgaacgtggcattcttgtttgcgggactggcgttggcgccgccatcgcagcaaacaagatcaacggcatccgcgcagccgtctgccacgacgtccattcggcgcaccagagtgtggagcatgacgacgtgaatgtcatgtgcatcggcgcaaaaatcgtcgggtcatggctcgctcgcgacttggtcttgtcctatctgaacgctcggtttgaccgcaacgaagatttcgtccgccgtgtcgaaaaactttccgcattggaaaatgcgcagtcagtcgcgtga

SEQ ID NO: 3825 - DNA, 447 bp, Methylobacterium sp. 4-46
atgcgactcgtgatcggatcggaccacgccggctggatgctcaagggagcggtgatcgaccacgtgcgctcgctgggccatgagctcatcgacgtcggctcgttcgacgagcatcccgtcgacttccccgacatcgcgcgcgaggtcgcccgcaaggtgacctccggcgaggctgaccgcggcctgatggtctgcgggaccggcgtcggcgcctcgatcgcggcgaacaagatgaagggcatccgggccgccgtgtgccacgacgtccactccgcgcatcagtgcgtcgagcacgacgacgtcaacgtgatgtgcatcggcgcccagatcgtggggccttggctcgccaaggacctgatcgccgcctatctcacggccgagttctccaccgacgcggatttccgccgtcgggtcgagaagttgcacgccatggacgcggaaggttga

SEQ ID NO: 3826 - DNA, 447 bp, Chelativorans sp. BNC1
atgaaaatcattattggctcagatcacgcaggttatcctctcaaggccgatatcatctcgcatatcgaaagcctcgggcatgaggtgatcgacgttggctgccacagcactgatccggtcgattttcctgatatcgcgcaggacctcaccgacaagctactgaagggggagggcgatcgcgggctcatggtttgcggcaccggtgtcggcgccgccattgccgcaaacaagcgggcgggtatccgcgccgcggtcggccacgacgtttattcggcgcaccagtgcgttgagcacgatgatgttaacgtcctttgcatcggcgcgcagattgttggggcatggctcgcccgtgacctcgtcagcgcttatcttagcgctgaattctcgactagcgaggagttccgccgccgtgtggaaaaactcaacgagatggacgggcggcgctga

SEQ ID NO: 3827 - DNA, 441 bp, Mesorhizobium opportunistum WSM2075
atgaaaatagccattggggccgacagcgccggcaagccgctgctcgatgtcatcgccgcacatctggcgaccaagcccggtctcaccgtcagcgatctcagccaggccggctactacgccgacctgtcgcaaaagctcgcccagacgatcgtcgacggcgacaacgatcgcggcatcctgttctgcggcacaggcatcggcgtttcgatttcggccaacaaggtgccgggcatccgcgccgcgctcacccacgacacctattcggccgaacgcgccgccaaatccaacaacgcgcagatcatcaccatgggcgcccgcgtcatcggcccggaactggccaaggcgatcgtcgacacgtggctggcttccgagttcgacgagaaggggccgtcggccggcaatgtccaggcgatcaacaggctcgatacggcaaaggcttaa

SEQ ID NO: 3828 - DNA, 456 bp, Agrobacterium radiobacter
atgaaacttgccatcgcaggagacagcgcaggcgaaggccttgcaaaggttctcgccgatcatctgaaggaccgttacgacgtgagcgaagtttcgcgcacggacgccggcccggacgcattctatgcaaaccttgccgaccgtgtcgcctcgggcgtcatcgacggcacctacgacaaggccatcctcgtctgcggcaccggcatcggcgtcagcatctcggccaacaaggtgccgggcattcgcgcggcgctgacccacgacacctattcggcggagcgcgccgcgctctccaacaatgcgcagatcatcaccatgggcgcccgcgtcatcggcaccgaacttgccaaggcgattgccgacgctttcctagcgcggaccttcgatacgaacggccgctcggccggcaatgtgcaggccatcgacgaagtcgacgcaaaatataacgcgcgctga

SEQ ID NO: 3829 - DNA, 447 bp, Rhizobium etli
atgaagatcgcaattggcgccgacagcgccggcaaaccgctcctggatgtcattgccgcccatctcgccggcaaggcggatctcgaagtgcacgatctcagccagtccggcttttatgccgatctctcccagcgcttggcgcagacgatcgtcgacggcgagcatgagcgcggcattcttttctgcggcaccggcatcggcgtgtgcatctccgccaacaaggtgccgggcattcgcgccgcccttacccacgacacctattcggctgaacgcgcggcgaagtcgaacaacgcccaaatcatcactatgggcgcccgcgtcatcggaccggaactggcaaaatcgatcgtcgacgtctggctcgcctccgaattcgaccccgatggtccatcggccggcaacgtgcaggcgatcgatcggctcgatgcagaaaaacacggggcttaa

SEQ ID NO: 3830 - DNA, 447 bp, Rhizobium etli
atgaagatcgcaattggcgccgacagcgccggcaaaccgctcctggatgtcattgccgcccatctcgccggcaaggcagatctcgaagtgcacgatctcagccaatccggcttctatgccgatctctcccagcgcctggcgcagacgatcgtcgacggcgagcatgagcgcggcatcctgttctgcggcaccggcatcggcgtgtgcatttccgccaacaaggtgccgggcattcgcgccgccctcacccacgacacctattcggccgaacgcgcggtgaaatccaacaacgcccagatcatcaccatgggcgcgcgcgtcatcgggccggaactggcgaaatcgatcgtcgacgtctggctcgcctccaaattcgatcccgatggcccgtcggccggcaacgtgcaggcgatcgaccggctcgatgcggaaaaacatggggcctaa

SEQ ID NO: 3831 - DNA, 694 bp, Rhizobium etli
gcacctatgaattcgtctgcgcgctgcgcgccgtcacctcggtcgacggcatgacggcggatttctatcactacgacatggaattcctcggccgcgccgcaacccgcatcatcaacgaggtgcgcggcatcaaccgggtggtttacgacgtcacgtcgaagccgccaggtacgatcgagtgggagtgaggggtgagttgatcccctcctccgccaaatttcttcgggaaacgggacgacttcttcatgactgccagcaaccgcatcgtcctctccagcgaccacgccgccgttgagctccgacaggccattgccgcccatatcgcggcgcgtggctggaccgtcgtcgacatcggaccgatgacggcggagagcacaccctatcccaagaacggcgaagcggcagcgcggctcgtcgcctccggcgattgccggttcggtatcatcctgtgcggcaccggccagggcatcatgatggcagcgaacaaggtcaagggcatccgctgcggggtctgcagcgacacattctcagcccgcatgatccgccagcacaacgacgccaatatgctgtcgatcggcgtgcgcgtggtgggccaaggtctggcgctcgatatcgtcgatgcgttcctgtccgcccagttcgagggcggccggcatgcgacgcgggtggagatgatcgaggcgctggaaagcta

SEQ ID NO: 3832 - DNA, 450 bp, Rhizobium leguminosarum
atgacagctaccaaccgcatcgccctctccagcgaccacgccgccattcagctccgacaggctattgccggtcatatcgcggcgcaggggtgggtagcggtcgatatcggaccgacgacgccggagagcacacactatcccaagcacggcgaagcggcggcgcgtctcgtcgcctccggcgattgccgctttggcatcattttatgcggtaccggccagggcatcatgatggcggcgaacaaggtaaagggcatccgttgcggcgtctgcgtcgacacattctcagcccgcatgatccgccagcacaacgatgccaacatgctttcgattggcgtgcgcgtggtgggcgaagggctggcactcgatatcgtggatgcgttcctgaccgcccagttcgagggcggccgtcatgcgacgcgggtggggatgattgaggcgctggagggctag

SEQ ID NO: 3833 - DNA, 447 bp, Rhizobium leguminosarum
atgaagattgcaattggcgccgacagcgccggcaaaccgctccttgatgtcattgccgcccatctcgccggcaaggcggatctcgaagttcacgatctcagccagtccggcttctacgccgatctctcccagcgcctggcgcagacgatcgtcgacggcgagcatcagcgcggcatcctgttttgcggcaccggcatcggtgtgtgcatttccgccaacaaggtgcctggtattcgcgccgccctcacccatgacacctattcggcggaacgcgcggcgaaatcgaacaacgcccagatcatcacgatgggtgcgcgcgtcatcgggccggaactggcgaagtcgatcgtcgacgtctggctcgcttccgaattcgaccccgatggcccgtcggccggcaacgtcgaggcgatcgaccggctcgacgcgcaaaaacatggctcctaa

SEQ ID NO: 3834 - DNA, 456 bp, Rhizobium leguminosarum
atgaagcttgccattgcaggagacagcgccggcgaaggcctcgccaaggttctggccgaccatctgaaagagcgcttcgacgtttacgaagtctcgcgcaccagcgccggtgccgatcctttctacgccaacctctcggaccgcgttgcatcaggcgtcatcgacggcacctacgacaaggcgatcctcgtttgcggcaccggcatcggcgtctgcatctcggccaacaaggttcccggcatccgcgccgccctgacgcacgacacctattcggccgagcgcgccgcgctttccaacaatgcgcagatcatcaccatgggagcccgcgtcatcggaacggagctggcaaagtcgatcgctgatgcgtttcttgcccagaccttcgacgagaacggccgctctgccggtaacgtcaaggccatggatgatctcgacgcgaagtacagcgcccgttga

SEQ ID NO: 3835 - DNA, 450 bp, Rhizobium leguminosarum
atgccagccaccaaccgcatcgccctctccagcgaccacgccgccattcagctccggcaggccattgccggccatgtcgtggcgcaaggctggatagcggtcgatatcggaccgacaacgccggagagcacacactatccgcagcacggcgaagcggctgcgcgtctcgtcgcctccggcgattgccggtttggcatcattctatgcggcaccggccagggcatcatgatggcggcgaacaaagtaaggggcatccgttgcggcgtctgcgcagacccattctcagcccgcatgatccgccagcacaacgatgccaacatgctttcgattggcgtgcgcgtggtcggcgaagggctggcgctcgatatcgtggatgcgttcctgaccgctcgtttcgagggcggccggcatgcgacgcgggtggggatgattgaggcgctggaggtgtag

SEQ ID NO: 3836 - DNA, 474 bp, Rhizobium sp. NGR234
atgaaggttgccattgcaggagacagcgcaggcgaaggtctcgccaaggtgctggccgaacacctgaaaggtcgctttgacgtgtatgaagtctcgcggaccgaggccggtcccgatcggttttacgccaatctgtcggagcgcgtcgcctctggcgtgctcgacggcacatacgacaaggccattctcgtttgtggaaccggaattggcgtctgcatcgcagcgaacaaggttccgggcatccgcgccgccctgacgcacgacacctattccgccgagcgtgctgccctttcgaataacgcgcagatcatcacattgggtgctcgtgtgatcgggccggagcacgctaagtcgatcgccgaaacgtttctgggcaagacgttcgacgaaggcggccagtcggcgggcaatgtcagggcgatcaacgacctggacagcaagtatcatccccgcgcgccaagctcgagcagatag

SEQ ID NO: 3837 - DNA, 438 bp, Rhizobium sp. NGR234
atgaaaatcgcaatcggagccgatagcgcaggcaagccgttgctcgacgtcatcgccgcccatctcgccggccggagcgacgtcgaggtcaaggatctgagccaggccggcttctacgccgacctgtctgagcatctcgcaaagacgatcaccgccggggagaacgaccgcggcatcctgatctgcggcacgggcatcggcgtctgcatctccgccaacaaagtacccggcatccgggccgcgctcacccacgacacctattcggccgagcgggccgcgaagtccaacaacgcgcagatcatcaccatgggcgcgcgggtcatcggcccggagctggcgaaatcgatcgtcgatacctggctcgccgccgaattcgatccgtacgggccgtccgccggcaatgtccaggcaatcgatcgcctagatgccggtaagtaa

SEQ ID NO: 3838 - DNA, 438 bp, Sinorhizobium medicae WSM419
atgaaaatcgcgattggagccgacagcgccggtaagcccctgctcgacgtcatcgccgcgcatctcgccacgaaaagcggcctcgaagtgaaggacctgagccagtccggctattatgccgatctctcccgagatctggcgcagacgatcacggcaggcgaaaacgagcgtggcatcctgatctgcggtaccggcattggcgtatgcatctccgccaacaaggtgcccggcatccgcgccgcgcttacccacgacacctattcggccgagcgggcagccaagtccaataatgcccagatcatcaccatgggcgcacgcgttatcggcccggaattggcgaaatcgatcgtcgacacctggcttgcctccgaattcgacccgaacgggccgtctgcggcgaatgtcgacgcgatcgatcgtctggatgcggtgaagtaa

SEQ ID NO: 3839 - DNA, 447 bp, Sinorhizobium medicae WSM419
atgcgtatcgtcatcggctccgaccatgccggcttccccctcaaggccaccattatcgaccacatcgtctcgctcggccacgaggttcacgacgcaggctcttacgacccgagccccgtggattttcccgacatcgcgaagacggtcacctcttcgatcatagacggcaaggcggatcgtgggctgatggtctgcggcactggcgtcggcgcctcgatcgcggcgaacaaggtcaaggggattcgcgcagcggtctgccatgacgtgcattccgctcatcagtcggtagaacacgacgatgtcaacgtcatgtgcattggcgcccagatcgtcggcgcatggctcgccaaggacctagtcgcagcctatctggctgccgaattctccaccgacgaagactttcgacgccgcgtgcgcaagctggccgaaatggatgagcagcgctga

SEQ ID NO: 3840 - DNA, 438 bp, Sinorhizobium meliloti
atgaaaatcgcgattggagccgacagcgccggcaagcccctgctcgacgtcatcgccgcgcatctcgccaagagaagcgatctcgaagtcaaggacctgagtcagaccggctactatgccgatctctcccgcgatctggcgcagacgatcacggccggcgaaaacgaacgcggtattctgatctgcggcaccggcatcggcgtgtgcatctcggccaacaaggtgcccggcatccgcgccgcgctgacccacgacacctattccgccgagcgggcggccaaatccaacaacgcccagatcatcaccatgggcgcgcgcgtcatcggcccggaactggcgaaatcgatcgtcgatacgtggctcgcctccgagttcgaccccaacggtccctcggcggcaaatgtcgaagcgatcgaccgcctggatcaggcgaagtaa

SEQ ID NO: 3841 - DNA, 447 bp, Sinorhizobium meliloti
atgcgtatcgtcatcggttccgaccatgctggcttccacctcaaggccacgatcatcgaccatgtcacctcgctcggccacgaggtgtacgacgcaggctcatacgatgcgaaccccgtagacttccccgacatcgcaaagatggtcacttcttcgatcatcgagggcaaggcggatcgcgggctgatggtctgcggcaccggcgtcggcgcctcgatcgcggcaaacaaggtgaaaggtatccgcgcagcggtctgccatgacgtgcattccgcccatcagtcggtggagcatgacgacgtcaacgtcatgtgcatcggcgcccagatcgtcggcgcatggttggccagggatctcgttgcagcctacctcgctgccgaattctccaccgacgaggacttccggcgccgcgtgcgcaagcttgccgaaatggacgagcagcgctga

SEQ ID NO: 3842 - DNA, 450 bp, Oceanibulbus indolifex HEL-45
atgaccgcaaaaccccgcatcatcatctcaagcgaccacgccgacattgccctgcgccaagacatcgcgcgccatgtggccgaccgcggctatgaggtcgaagacatcggcccgacaacggcagagagcaccgattaccccaaacacggcgaagccgccgcgcggcgcatcgcggcaggggaattcgaccttgggattctgatctgcggcacagggcagggcatcatgatggccgccaataaggtcaaaggcatccgctgcggtgtctgcgccgatacattctcggccaagatgatccgggcgcataacgacgcgaacatgctgtcgatgggcgcgcgggtgatcgggggcgggttggcgcttgagatcgtggatgcgtttctcgacactgaattcgaaggcgggcgtcatggccgtcgtgtcgatatgatcaccgcgattgaagactga

SEQ ID NO: 3843 - DNA, 456 bp, Octadecabacter antarcticus 238
atgaaaattgcaatcgcaggcgacaccgccggagaaggtctagcgaagacactggccgaccacttgaaggctactcacgacgtcaccgacctgtcccgagtgcagggcgaggcagaccagttctatgctagtctgtcagatcgtgtggcatcagctgtcatggacggggaattcgatcgtgccattctcgtgtgcggcaccggcattggcgttcagatcgcggccaacaaagtgtcgggcattcgcgcagcgcagtgccacgatacttattctgccaccaaggccgccacatccaacaatgcccacatcatcacaatgggcgcgcgggtgataggcgtcgaactggccaaagacattgcggaagcctttttgaacgcctcgtttgatccgcaaggtcgatccgcaggcaatgttgatgccatcgacgcggttgactcgaagtattcaagatcctga

SEQ ID NO: 3844 - DNA, 456 bp, Phaeobacter gallaeciensis 2.10
atggaccagaaaaaaccaacccgcgttgtgctttccagcgaccacgccgcgattgagctgcgtcaggccatcgcggaccatatcgccgcaaacggctgggaggtcgtcgatattggccccaccaccccggagagcacccactatcccaagcacggtgctgctgcggcggagcgcgtggcctcgggcgattgtgatctcgggatcatcctttgcgggacgggtcagggcatcatgatggctgcaaacaaggtgaagggcgtccgctgcggtgtctgctccgaaaccttctccgcgaagatgatccgtcagcacaacaacgcaaatatgctctcgattggggcgcgcgtggttggcgacagcctggcgattgagattgttgatgccttcctcaatgcggaattcgagggcggtcgccacgccacccgtgttgacatgattgagccgcaggacagctga

SEQ ID NO: 3845 - DNA, 456 bp, Phaeobacter gallaeciensis BS107
atggaccagaaaaaaccaacccgcgttgtgctttccagcgaccacgccgcgattgagctgcgtcaggctatcgcggaccatatcaccgcaaacggctgggaggtcgtcgatattggccccaccaccccggagagcacccattaccccaagcacggcgcagccgcggcggagcgtgtggcctcgggcgattgcgacctcgggatcattctttgcggaaccggccagggcatcatgatggccgcaaacaaggtgaagggcatccgttgcggggtctgctccgataccttctccgccaagatgatccgccagcacaacaacgccaatatgctctccatcggggcgcgtgtggttggtgacagcctcgcgattgagatcgttgatgccttcctcaatgctgagttcgaaggcggtcgccacgccacccgcgtggatatgattgagccgcaggacagctga

SEQ ID NO: 3846 - DNA, 459 bp, Rhodobacter sp. SW2
atgaaactggcaatcgcgggcgacagtgtcgggttcgggctggcacatctgctggctgaacacctgaagggtcgtttcgacgtggccgaggtgaccgaaaccgccagcggccccgacccgttctatgccacactggccgaccgggtggcctcgggtgtggccagcgggctttatgaccgcgccattctgatctgcggcaccggcatcggcgtcagcatcgccgccaacaaggtgcccggcatccgggccgcgctgtgccacgacacctattccgccgaacgcgccgccctgtcgaacaacgcccagatcatcaccatgggcgcgcgggtgatcggcaccgaactagccaaggcgattgccgaggcgtttcttgcacaaagcttcgatccggccgggaaaagcgcctctaacgtggcggcgctggatgcggtcgatgcgaaataccacaagccccgctga

SEQ ID NO: 3847 - DNA, 456 bp, Roseobacter denitrificans
atgaaaattgcagtggcaggcgatagcgcgggcgaaggtttggcgaaaaccctcgcggagcaccttggcgcgcaccatgacgtggtcgagatgtcacgcacgcaggacggcccggatgcgttttatgcggacctgtccaaccgggtcgctcgtgctgtgatcgcgggcgaggttgagcgtgccattctggtctgcggcaccgggatcggcgtttgcctgtcggccaacaaggtgccgggtatccgcgcggcacaatgccatgacacctattccgcaggcaaagcggccacgtcaaacaacgcgcagatcatcacgttgggggcgcgcgttgtcggcgcggaactggccaaggatattgtggatgcctatctctccagccattttgatcccgaggggcgctcggctggaaatgtgcaggcgattgaccggttggatgccgcctataacaaggcgtga

SEQ ID NO: 3848 - DNA, 456 bp, Roseobacter litoralis
atgaaaattgcagtggcaggcgatagcgcgggcgaaggtttggcgaaaaccctcgcggagcaccttggcgcgcaccatgacgtggtcgagatgtcacgcacgcaggacggcccggatgcgttttatgcggacctgtccaaccgggtcgctcatgctgtgatcgcgggcgaggttgagcgtgccattctggtctgcggcaccgggatcggcgtttgcctgtcggccaacaaggtgccgggtatccgcgcggcacaatgccatgatacctattcagcaggcaaagcggccacctccaacaatgcgcagatcatcacgctgggtgcgcgcgttgtcggcgcggaactggccaaggatattgtggatgcttatctctccagccattttgatcccgaggggcactcggctggaaatgtgcaggcgattaaccggttggacgccgcctataacaaggcgtga

SEQ ID NO: 3849 - DNA, 447 bp, Roseobacter sp. CCS2
atgaccaacaaacgcgtcgttctttccagcgatcacgccgccatcgagatgcgtcagcaaattgcggaccatatcactgccaaaggatgggaggcggttgatatcggccccacgacacccgaaagcacaccataccccgcccatggtgaagctgctgcgcggcgggtcgcgtcaagcgattgcacgttcgggattatcttgtgcgggaccggtcaagggatcatgatggccgcgaataaggtcaagggcatccgctgcggcgtatgctctgacgtgttttcggcgcaaatgatccgcgaacacaacgacgcaaatatgctggcgatgggcgcacgggtgatcgacaacgccacagcgcttaagattgtggatgcgttcctgttcaccgatttcgggggcggacgccatgccacgcgtgtggacatgatcaaagcgctggaagactga

SEQ ID NO: 3850 - DNA, 450 bp, Roseobacter sp. MED193
atgacagcctcaaaacgcgtcgttctttccagcgatcatgccgacattcagcttcgccagaccattgccgaacacattgccaaccaaggctgggaggttcttgacctcggtcccaccacttcggaaagcacagattaccccaaacatggccgcgaagccgccgagcgcgtggccgctggtgattgcgatctgggcattattgtctgcggcactggccagggcatcatgatggccgccaataaggtcaagggcatccgttgcggcgtttgcgctgatacgttttcggcccgtatgatccgccagcataacgatgcaaacatgctgtcaatcggggcgcgggttgtgggcaagggtctggcattggatatcgtcgacgccttcctctccgcagaatttgaaggcggtcgccatgccactcgtatggaaatgattgaacccgctgaagactaa

SEQ ID NO: 3851 - DNA, 450 bp, Roseobacter sp. SK209-2-6
atgaccaccagcaaacgcatcgtcatttccagcgaccacgctgatatcccacttcgccaggccattgccgagcatgtcgcagcaaagggctgggaggtcaccgatattgggcctgtcaccgccgaaagcacccattatcccaagcatgggaaagaagctgcagagcgcgttgcctcgggtgaatgccagtttggcatcattgtctgtggcaccggccagggcatcatgatggctgcaaacaaggtcaaaggcatccgctgcggcgtctgctccgacacgttttcggcccgcatgatccgcgaacacaatgacgccaatatgctctcaatcggtgcgcgcgttgtgggcaaaggcctggcctttgacattgtcgacgctttcctggatgccaaatttgaaggcgggcgtcatgcaacccgcgttgacatgatcgagcccgctgaggactga

SEQ ID NO: 3852 - DNA, 450 bp, Roseovarius nubinhibens ISM
atgagcaccgaaaaacgtatcgtcctgtcgagcgatcacgcggccatcgagctgcgtcaggccgtggcggaacatgccaagagcctcggctgggaggtcgaggatatcggccccatcagccccgagagcacccattacccgaagcacggcaaggcggcggcgcgcaaggtcgcgtcgggcgactgtgctcttgggatcattctctgtggcacggggcagggcatcatgatggccgcgaacaaggtcaagggcatccgctgtggtgtggcgagcgacacgttctcggccaagatgatccgtcagcacaatgacgccaacatgctttcgatcggggcgcgggtcgtgggcgaggggctggcgctcgagatcgtcgaggcgttcctcggcgccgagttcgaaggcggccgccatggcacgcgggtcgacatgatcaaggcgatcgaagggtaa

SEQ ID NO: 3853 - DNA, 462 bp, Roseovarius sp. HTCC2601
atgaagatcgcagtggccggcgacagcgccggagaacccctcgccatcgcgctggccgagtacctggcgcagaaccccggctacgaggtcgcggagatctcgcgcaccgaggccgggccagacgatttctacgccaacctctcggaccgggtggcgacgcaggtgctggacggcacctatgacaaggcgatcctgtgctgcggcaccggcatcggtgtctgcctcgccgccaacaaggtgcccggcatccgcgcggcgcagacccacgacacctattccgccgggaaggccgcgacctcgaacaacgcccatatcatcaccatgggcgcgcgggtggtgggcgtcgagctcgccaaggacatcgccgacgccttcctgtcgtcctccttcgatcccgaaggcaagtcggccggcaatgtccgcgccatcgacgcggtcgacgccaagtaccacacggcataa

SEQ ID NO: 3854 - DNA, 450 bp, Ruegeria pomeroyi DSS-3
atgaccgccagcaaacgtattgtcctgtccagcgatcacgccgccatcgacctgcgtcgcgcggtcgccgaccatatctcggcacagggctgggaggtggtcgatatcggcccgcaaaccaccgaaagcacccattaccccaaacatggccgcgcggcggcagagcgggtcgcctcgggcgattgcagccttgggatcattctgtgtggcaccggtcagggcatcatgatggccgccaacaaggttgcaggcatccgctgtggtgtctgtttcgacacgttctcggcccggatgatccgcatgcacaatgacgccaacatgctgtcgctgggcgcgcgcgtggtgggcgaggggctggcgctggatatcgtcgatgcgttcctgtcggcggaattcgaaggtggccgccatgcgacccgcgtggacatgatcgaaacccccgagggctaa

SEQ ID NO: 3855 - DNA, 444 bp, Ruegeria sp. R11
atgaccaccagcaaacgcatcgttctctccagcgaccacgctgccatcccgcttcgccaggccgtagccgaccacatcgcgcagcaaggctgggaagtggtggacatcggcccaaccacgccggagagcacccattacccgatccacggcgccgccgctgcagagcgcgtggcctctggtgactgtgatctcggcattatcctctgcgggaccgggcaggggatcatgatggccgcgaacaaagtgaagggcatccgctgtggcgtctgctctgacacgttctctgcggcgatgatccgtcagcacaacaacgccaacatgctctccatcggggcacgtgtcgttggtgaggggctcgcgcttgagatcgtcgatgccttccttggcgcagagttcgaaggtggccgccacgccacccgtgtggacatgatcgaagcgaactga

SEQ ID NO: 3856 - DNA, 450 bp, Ruegeria sp. TM1040
atgactgccagcaaacgtatcgttctttccagtgaccacgccgccatcgcgctgcgccgaaccatcgccaagcacatcgaggctttgggatacaccgtgaccgatctcggtccgaccacccccgagagcacccattatcccaagcacggtgaagcggccgcgcgccatgtggctgcgggcgagagcgatctgggcatcctcctgtgtggcactggtcagggcatcatgatggccgccaacaaggtgaagggcatccgctgcggcgtgtgttcggatacgttctcggcgcagatgatccgcgcgcataacgacgccaacatgctgtcgatcggcgcgcgcgtcgtgggtgaggggctggcgcttgagatcgtcgatgcgtttctcaagaccgagttcgagggcggccgccacggcacccgcgtggatatgatcaccgagatcgagggctaa

SEQ ID NO: 3857 - DNA, 450 bp, Silicibacter sp. TrichCH4B
atgactgccagcaaacgcatcgttctttccagtgatcacgccgccatcgagctgcgtcaaaccattgccaaacatatcgaggcacgcggctatagcgtgaccgaccttggccccaccacgccggagagcacccattaccccaaacatggtgaagctgccgcgcgtcacgtggcggcaggtgaaagcgacttgggcgttttgctgtgtggtaccgggcagggcatcatgatggccgccaacaaggtcaaaggcgtccgctgcggtgtctgctctgatacattctccgcccagatgatccgcgcccataatgacgccaatatgctgtcgatcggggcgcgtgtcgtgggcgaagggctggcgctggaaatcgttgatgctttcctcaacacagagtttgagggcggtcgtcacggcacccgtgtcgatatgatttccgcaatcgaaggctga

SEQ ID NO: 3858 - DNA, 435 bp, Thalassiobium sp. R2A62
atggcaacccgcattgttctatccagcgatcacgccgcattggatctgcgtcccaagattgcagcgcacatccaagcgctaggatacgaggtcgttgatatcggcccaaccacatccgagagcacccattacccaaaacatggccaagccgcagccgaacgtgtggcgtcgggcgattgcgagctaggcatcattctgtgtggcacggggcagggtatcatgatggccgcgaacaaagtgccgggcattcggtgcggtgtttgcatggatacgttttctgcacggatgatccgcgagcataacaacgcaaacatgctttcgatgggcgtgcgcgtcgttggcgagggtcttgcgctggatattgtcgatgcatttttgaatgcaaagtttgaaggcgggcgtcatgcaacgcgcgtcgatatgatcgagggctaa

SEQ ID NO: 3859 - DNA, 450 bp, Rhodobacteraceae bacterium KLH11
atgaccatcgcaaaacgcatcgttctttcaagtgatcatgcagcgattgagctgcgcaaggcggttgccgatcatgtcaccgcgcaaggctgggaggttgtcgatatcggccccaccacgcccgagagcacgcattatccgattcatggcaaagccgcggccgaggccgtcgcctcggggcgctgtcagttgggggtgatcctgtgtggcacgggtcagggcatcatgatggccgccaacaaggttccgggcattcgctgtggcgtatgctcggatacgttttcagcccgtatgatccggcagcataatgacgccaatatgctcgccctcggcgcgcgcgttgttggcgaagggcaggcgctggatatcgtggatgcctttctgacggctgaatttgaaggcggccgccacgccacacgggtcgacatgatcgaggcggacaacagctga

SEQ ID NO: 3860 - DNA, 444 bp, Rhodobacterales bacterium HTCC2083
atgacgaacctgaaacgcatcgttctctcaagtgatcattctgcgatagagctgcgccaaacgattgctcaacatattgcagggcaaggctgggatgtgctcgacatcggtccgaccaccaccgaaagcacgcattacccgacccacggacaagctgcggcagagcgtgtggtgtcgggcgagtgtgccttgggcatcatcctatgtggcacggggcaaggcatcatgatggccgcgaacaaggtcacaggtatccgctgtggcgtgtgttccgatacgttttctgcacagatgatccgagcgcataatgacgcgaatattctctctttgggcgcacgtgtcttgggggcaggcctcgcgctggagattgttgacgctttcctctccacagagtttgagggtggtcgacacgcaacccgcgtagacatgatcgagcctgcgtaa

SEQ ID NO: 3861 - DNA, 441 bp, Rhodobacterales bacterium HTCC2654
atgacccagaacaaacgcatcgtcctgtccagcgaccacgcggccatcgagctgcgccagaccatcgccaagcatatcgaggctgaggggtgggaggccgtggatatcggtccgaccacgcctgaaagcacgcactacccgctgcacggccaagcggcggcgcaaaaggtcgcctcgggcgagtgcgcgctggggatcatcctgtgcggcaccgggcagggcatcatgatggcggcgaacaaggtcgcgggcatccggtgcggcgtctgctccgacacgttctcggcccggatgatccgccagcacaacgacgcgaacatcctgtcgcttggcgcgcgggtcgtgggcgaggggctcgcgctcgacatcgtggacgcgtttctgaacgccgaattcgaaggcgggcggcacgcgacgcgggtggagatgatcgagggctga

SEQ ID NO: 3862 - DNA, 453 bp, Acidiphilium cryptum
atgagcgaaaacatgacactggtggtcggcgccgaccatgcggggttcgaattgaaggaccggctggcagaggccgcgcgcgccgccggctgggcggtgatcgattgcggcacgaattcggccgcgagcgtggattatcccgatatcgcgcatgaggtgagcatgcggatcgaggccggatcggcccgtttcggcctccttgtgtgcggttccggcatcggcatggcgatcgcggcgaaccgccacaccggcgttcgttgcgcgcaggcccatgatgcaaccgaggcgcgcctttcgcgcatgcacaataatgccaatatcctcgccctgggtgcccggctgaccggcgaaatggtcgcgctggacgcgctcaatgcgtttctgaccaccgaattcgaaggcggccggcacgagaagaggctcgccaaactgaccccggagccgaaaacatga

SEQ ID NO: 3863 - DNA, 483 bp, Gluconobacter oxydans
atgcgtattgctattggtggagacagtgcaggcgaaggcctggcacggcttctggtggaacatctctcgacactggggcggcatgtcgtcgttgacatgtcccatcccgaagacgagcgggctgaactgtattcggaactgagcgagcgcgtggcgctggccgttctgcatggagaattcgaccggggtatcctgtgctgcgggacggggatcggggtgtgcatttccgccaacaagatcccgggtatccgggccgcgctgacccacgacacatattccgcggagcgtgcggcgctgtcgaacaacgcgcatatcatcacgatgggatcgcgcgtcatcgggtcggaagtggcgaaatcaattgccgaagcctggctggcctgcacgtttgatccgcgcagtgcctcggcacggaatgtggctggcattgatgcgctcggaaagaaataccgccagcaggctcctgtcggcgcaagttgctga

SEQ ID NO: 3864 - DNA, 450 bp, Magnetospirillum gryphiswaldense
atgaccaaggacatcatcgcgcttgcttccgatcacggcggcctggaaatgaaggccatggtggccgccttgctgcaggaaaaggggttcggggtccttgaccttggcgcccatgacggccaatccgtggactatcctgatttcgccgtcgccatggcccaggcgctgaaggatggccgcgccacccgcggtgtactgatgtgcggcagcggcatcggcatttccattgccgccaaccgtttcgcccatgtgcgcgcggccttggtccacgattcctatggtgcgcgtatgtgccggctgcacaatgacgccaacgtcctggtcctgggcggacgtaccaccggcccggaagtggccaaggaatgcatcgagattttcctcgccaccccattcgaaggcggtcgccatgcgcgccgcgtcgccaaactggccgagaacggccaagcctga

SEQ ID NO: 3865 - DNA, 453 bp, Magnetospirillum magneticum AMB-1
ttgatgagcaccaaaatcatggccattgcttgcgatcacggcggcatcgaactcaaggaattgctggccaaggatctggcggcgtccggctggtcggtgctcgacttgggaaccaacggccccgaatccgtggattatcccgatttcgcggtgacgctggccgatgccctgaaaagcggtaaagccgagcgaggcgtgctgctgtgcggcaccgggatcggcatctccattgcggccaaccgttttccccatgtgcgtgccgccctggtgcacgatgccttcggggcgcgcatgtgccgccagcataatgacgccaacgtcctggtgatgggggggcgcaccaccggtcccgaagtggcgcgtgactgcctgaagatttttatcgagaccgaattcgagggcggccgccacgcgcggcgcgtctccaagctgtccggaaacggcccggcctga

SEQ ID NO: 3866 - DNA, 393 bp, Magnetospirillum magnetotacticum
  misc_feature (319)..(319): n is a, c, g, or t
atgcgcgttcacatcgccgcggaccacgccggctacgagctcaagacccatctcgtcgagcacctgggggcggcgggtcacgacgtcgtcgaccacggtgcccacacctacgacgcgcaggacgactacccgtcgttctgcttcgcggcgggcgaggcggtggcggcggagcccggctcgctcggcgtcgtcatcggcggctcgggcaacggcgagcagatcgcggcgaacaaggtcgtcggcgtgcgcgcggcgctcgcctggaacctggagaccgcgcgcctcgggcgccagcacaacgacgcgaacgtggttcgcnggtgggcgcgcgccagcactcggtggacgaggcggtcgcgctcgtcgacgcgttcctcgcggagccgttcagcg

SEQ ID NO: 3867 - DNA, 429 bp, Magnetospirillum magnetotacticum
atggccattgcctgcgatcatggcggtgtcgatctcaaggacgtgctgatcaaggatctggccgcatcgggctggacggttcttgacctggggaccgacggacccgagtccgtcgattatcctgatttcgcggtcaagctggcccaggccctgaaggacggcaaggccgaacgcggcgttctgctctgcggcaccggcatcggcatctccatcgccgccaaccgtttcgatcatatccgcgcagccctggtgcacgacgctttcggcgcccgaatgtgccgtcagcacaatgacgccaatgttcttgtcatgggcgggcgcaccatcggtcccgaagtggcgcgcgattgcctgaagattttcaccgagaccgaattcgagggcggccgtcatgcgcggcgcgtctccaagttgtccgctaacggataa

SEQ ID NO: 3868 - DNA, 435 bp, Rhodospirillum centenum
atgaccgccgaaaccatcgccatcgcttccgatcacgccggctacgacctgaaggcctcgctgaaggagatgctggagggggaggggcgtgcggtgctcgatctcggcaccgacggtcgtgagtccgtggattatccggatttcgccgacgtcatcgccgccgccctgaaggacgggcgggcgcagcggggcatcctgatctgcggtacgggcatcggcatcagcatcgctgccaatcgtcaccggcatgtgcgcgccgcactctgccacgatatcacgacggcccgtctgtcgagacagcacaacgacgccaatgtcctggtcctgggggcccggacgaccgggatcgaggtcgcgcgcgactgcgccgccaccttcctggcgacgccctacgaggggggtcgccatgcccgccgcgtcgccaagctcggctga

SEQ ID NO: 3869 - DNA, 447 bp, Rhodospirillum rubrum
atgaagatcgcgattggctgtgatgaggcggcctatgacctcaaggaaaccttgacgtccttcatcacggcgcagggtcacgaggtgaccgatttcggcaccttcgaccgcaagcccgtgctttaccccgatatcgcccacgccctggccaccgaggtcgccgccggcacccaggaccggggcgttctgttgtgcggaaccggcattggcatggccatcaccgccaataaggtgaagggaatccgcgccgcccaatgccatgacacctattccgccgaacgcgcccgcctgagcaacgatgcccagatcatcaccatgggcgcccgcgtcatcggccccgaactggccaaggcgatcgtccgcacctttttgtcgaacgaattcgtcaacggcagttcgaccccgaagatcgagcggatcaccgcctatgagaacagccccggttag

SEQ ID NO: 3870 - DNA, 477 bp, Rhodospirillum rubrum
atggcggaaaccgccaagcctaaaatcgtcgtcggcgccgatcacctggggcgggagctcaaggatctgctgcgcgatcacctgaccgcccaagggtatgaggtttgcgacatggggaccgccaccagcgatcccgtggattaccccgatgtcgccctgccggtcgcccaggccatcgccaagggggacttcgatcgcggcatcctggtgtgcggcaccggcgccggtgtctgcgtcagcgccaacaaggtgcccggggtgatcgccgttcaggttagcgatccctataccgccgaacgcgcccgggccagcaacaacgcccagatcatcacctttggcgccctgaccatcggcccggcgacggccaaggccctgaccgacatcttcatggccgccgagttccaagggggcggttcggccaagaaggttcaaaagatgcttgatatcgaccagcattacaaaaagctggccagctga

SEQ ID NO: 3871 - DNA, 489 bp, Rhodospirillum rubrum
atgaccgaccgcgaagactcctcgatcgtccccgatcattcccgtgccgaagcgaccatcgccctggcctccgatcatggcggcgtcgagttgaaggctttgcttgtcgatcacttgcgcgccaccggtcacgacgttcttgatctgggcacccagggcccggagtcggtcgattaccccgatatcgccaataccctggcccaggcgctgcgcgccggccgggcggggcggggggtgttgatctgcggcaccggcatcggcatctcgatcgccatcaaccgccatgccgacatgcgcggcgccctggttcacgacgcctttggcgcccgtctggcccgccagcacaacgatgccaatgtgctggttctcggcggtcggaccaccggcccggaaatcgccaaggattgcgccgatatctttttgtcgacccctttcgaagggggacgccatgcgcgccgggtggccaagctggggaccccctcggcctga

SEQ ID NO: 3872 - DNA, 453 bp, Anaplasma centrale
gtgctagtagtagatagggttttcgtttcttcggatcatgcgggtgtacagctccgcctccttcttggtgcgtatctggagggtctcggttgtagcgtggctgactgcggctgtgacgtcagtgatgatgctgtggattatcccgactatgtacccggagtagttgattacgtgtctgacacgagctttggagtgctgatttgcggtaccgggatagggatgagcatagcagcaaacaggagcaggtgggttagggctgcgctgtgccacgattcgctattcgccaggcttgcaagggagcataatgatgcgaatgtcttgtgctttggttccaggtatatagatcctgatgtggcaaagtctgtgctatatacctttcttaccactaagtttctgggtggtaggcattctgctagagtaaaaaaattgggggaagttggaagttgcagctag

SEQ ID NO: 3873 - DNA, 441 bp, Anaplasma marginale
gtgttggtggtagatagggttttcgttgcttcggatcatgcgggtgtgcagctccggcttcttctcggtgcatacctgggggatcttgggtgtgaagttgctgactgtggctgcgatgtcggtgatgatgctgcggattatcctgactgcgtgccgggcgtggttgattgcgtgtctgacacaagctttggggtgctgatttgtggcacagggatagggatgagtatcgcagcaaacaggaataagtggatcagggccgcgctgtgccatgatccgacgttcgctaggcttgctagagagcataatgacgcgaacgtcttgtgctttggtgccagatacgtagagcctgatgtggctaagtctgtgctatacacatttctcactaccaggttcttgggtgggaggcacgcggccagagtgaaaaagttgggtagtggctag

SEQ ID NO: 3874 - DNA, 435 bp, Anaplasma marginale
gtggtagatagggttttcgttgcttcagatcatgcgggtgtgcagctccggcttcttctcggtgcatacctgggggatcttgggtgtgaagttgctgactgtggctgcgatgtcggtgatgatgctgcggattatcctgactgcgtgccgggcgtggttgattgcgtgtctgacacaagctttggggtgctgatttgtggcacagggatagggatgagtatcgcagcaaacaggaataagtggatcagggccgcgctgtgccatgatccgacgttcgctaggcttgctagagagcataatgacgcgaacgtcttgtgctttggtgccaggtacgtagagcctgatgtggctaagtctgtgctatacacatttctcactaccaggttcttgggtgggaggcacgcggccagagtgaaaaagttgggtagtggctag

SEQ ID NO: 3875 - DNA, 441 bp, Anaplasma marginale
gtgttggtggtagatagggttttcgttgcttcggatcatgcgggtgtgcagctccggcttcttctcggtgcatacctgggggatcttgggtgtgaagttgctgactgtggctgcgatgtcggtgatgatgctgcggattatcctgactgcgtgccgggcgtggttgattgcgtgtctgacacaagctttggggtgctgatttgtggcacagggatagggatgagtatcgcagcaaataggaataagtggatcagggccgcgctgtgccatgatccgacgttcgctaggcttgctagagagcataatgacgcgaacgtcttgtgctttggtgccaggtacgtagagcctgatgtggctaagtctgtgctatacacatttctcactaccaagttcttgggtgggaggcatgcagccagagtgaaaaagttgggtagtggctag

SEQ ID NO: 3876 - DNA, 432 bp, Anaplasma phagocytophilum HZ
gtggtaaaaagggtttttctctcctctgatcatgctggcgtagaactcagattgtttcttagcgcgtatctaagagacttaggttgcgaagtttttgactgcggttgcgatcctaaagagcattccgtagactacccagattacgtacatgacgttgtaagagaagtatcagatacgagttttggagttttgatatgcggaacgggtataggcatgagtatagcagccaaccgtcataaaaatattagagccgctctttgttcttctaccatgcttgcaaagctttctagagaacacaatgatgcgaatgttctgtgttttggctctcgttatatagatcctgatactgcacagtccgtattatacacgttcatgacaacggcgttcttagggggaagacatgccgtaagagtacaaaaacttggtgaatga

SEQ ID NO: 3877 - DNA, 450 bp, Ehrlichia canis
atgttagttatgcagaaagtttttatttcttctgatcatgctggggtagagttaaggttagttattaaattgtatttgaataatttaggctatattgtagaagattatggttgtgttgagtctggtgttcctgtggattatccggattatgtacagaatgttgtagattgtgtaattaatgatagtttggcgtttggtattttaatatgtggtacaggtattggaatgagtattgtggcgaatcgtcacaggaaaattagagcagctttgtgctataatgtagaagtagctaggttagcacgtgagcataatgatgctaatgtactttgtcttggagctagacatattagttatgaagatgctcaatccatagtttataattttctcactacaaaattttctgaaggaaggcatgtgcaaagaataatcaaaatagataattgtttatga

SEQ ID NO: 3878 - DNA, 447 bp, Ehrlichia chaffeensis
atgttgactatgcagaaaattttcatttcttctgatcatgctggaatagagttaagattagttattaagttatatttaagcaatttaggttatgtagtagaggattatggttgcatggaatctagtattgctgtagattacccggattatgtacaaaatgttgtagattgtgtcattaacactttagggttcggtattttaatatgtggtacaggtattggcatgagtattgtggcaaatcgtcacagaaaaattagggcagctttgtgttataatgtagaagtagctaagttagcacgtgagcataataatgctaatgtactttgtcttggtgctagatatattaatcatggagaagctcagtctatagtttatcagttcattactacaaaattttctgaagggaggcatgtacaaagaatagcaaaaatagataattgtttatga

SEQ ID NO: 3879 - DNA, 441 bp, Ehrlichia ruminantium str. Welgevonden
atgcagaaaatttttatttcttctgatcatgctggagtggaattgagactctttattaaattatatttagaaagcttgagttatacagtagaagattatggttgtgtaatatctgatgttattgtagattatccagattatgtacaagatgttgttcattgtgttactagtaatgattcaggatttggtattttaatatgtggtactggaattggtatgagtattgcagcaaatcgttataagaaggttagggcagctttatgttatactacagaacttgctaggtttgcacgggaacataataatgcaaatgtactttgtcttggagctaggtatattacatatgaaaaagctaagttaatagtgtataagtttctaaatacaaagtttgctgaaggtaggcatacacaaagaatagaaaaaatagatagttatttatga

SEQ ID NO: 3880 - DNA, 447 bp, Ehrlichia ruminantium str. Welgevonden
ttgaatatgcagaaaatttttatttcttctgatcatgctggagtggaattgagactctttattaaattatatttagaaagcttgagttatacagtagaagattatggttgtgtaatatctgatgttattgtagattatccagattatgtacaagatgttgttcattgtgttactagtaatgattcaggatttggtattttaatatgtggtactggaattggtatgagtattgcagcaaatcgttataagaaggttagggcagctttatgttatactacagaacttgctaggtttgcacgggaacataataatgcaaatgtactttgtcttggagctaggtatattacatatgaaaaagctaagttaatagtgtataagtttctaaatacaaagtttgctgaaggtaggcatacacaaagaatagaaaaaatagatagttatttatga

SEQ ID NO: 3881 - DNA, 441 bp, Neorickettsia risticii str. Illinois
atgagggtttccataggtgctgatcatgcggggttcgcactcaaagcagttttaatagacttctttaaggcacggggctgttccccggtggataggggtgcgtattgctcagatgtttctgattatcctgattttgctaagtctgtttccttagacgtattggacggaagggtggattttggcattttaatatgtggttctggaatcgggatgagtataactgctaacaggtacaaaaagatccgtgctgccctgtgttacgatgtgcgagcagcaaagatggctagggaacataatgatgcaaacgtcttatgtcttgcaggaagagctctaactgtgtcaaggtgtcttgaaatagttgaagtatttgtgagtagtgagtttagttgtgaagagcgtcacaagaaaaggatagaaaagattgatgtgggaggggaatag

SEQ ID NO: 3882 - DNA, 459 bp, Neorickettsia sennetsu str. Miyayama
ttgaacgtgagggtttccataggtgctgatcatgcggggtttgcactcaaagcagttttgatagacttctttagggcacggggatgcttgcccgtggataggggtgcgtattgcttagatgtttctgattatcctgattttgctaaatctgtttccttagacgtatcggatgggagggtggattttggcatcttaatatgtggttctggtatcgggatgagtataaccgccaacaggtataaaaaggtccgggctgctctgtgttatgatgtgcgagcagcaaagatggctagggaacataatgatgcaaatgtcttatgtcttgcaggaagagatctgactgtatcaaggtgtcttgaaatagttgaggcatttgtaagtagtaagtttagttgtgaggagcgtcacaagaaaaggatagaaaaaattgatgaggggggggggaatagtgttttttaa

SEQ ID NO: 3883 - DNA, 483 bp, Orientia tsutsugamushi str. Boryong
atgaaggtgtttttattgccaagatttttttttatggtttcatctaatattattgctattgcatctgatcaaaaagagtacgagttaaaaacaaaaatttgtcaacatttatctgagcaagaacgttttattagtttttcagtccttgatctaggaggtaataataatcagcaggttgattatccagatattgccaacttattatgtgatactataattaataatcgagctagatatggtattttaatttgcacaacaggtattggcatgagtatagctgcaaatcggcattctgatattagagccgctttatgctttaatgaatatatggcagagcaatcgcgtttgcacaataatgctaatatcttaattataggagccaaggtttctaattttaggtctgttattaatatgatttcaaaatttataactacaaaatttgaaggtggccgccacttgactagacttgaaaagcttagatag

SEQ ID NO: 3884 - DNA, 450 bp, Orientia tsutsugamushi str. Ikeda
atggtttcatctaatattattgctatagcatctgatcaaaaagagtacgagttaaaaacaaaaatttgtcaacatttatctgagcaagaacgttttattagtttttcagtccttgatctaggaggtaataataatcagcaggttgattatccagatattgccaacttattatgtgatactataattaataatcgagctaaatatggtattttaatttgcacaacaggtattggcatgagtatagctgcaaataggcattctgatattagagccgctttatgctttaatgaatatatggcagagcaatcgcgtttgcacaataatgctaatatcttaattataggagccaaggtttctaattttaggtctgttattaatatgatttcaaaatttataactacaaaatttgaaggtggccgccacttgactagacttgaaaagcttagatag

SEQ ID NO: 3885 - DNA, 447 bp, unknown
  alpha proteobacterium HIMB114
ttgtctaaaacttttataactaaaaaaatattcatatcttctgaccatgccggttatgatcttaaaaaatatttaattaatcagatttcaaagaaaaaaattaaaattatagatttaggtccattttcaaaagattcagttgattacccggactttgctaaaaaactatctaagaaaataaccaatattaattttggaattctggtttgcggaactggtattggaatgtcaattatggcgaatcgttatagaaaagtcagagcatcattggtctttaattctaaaacagcgaaattagcaagagaacataacaatgctaatgttttggtgctaggttcaagggtgacaaataaaaaaaatgctttaaaaataacggaagttttctttaaaacaaaatttttaaaaggaaggcacttaagaagggtaaagaaatttaataatgtctaa

SEQ ID NO: 3886 - DNA, 426 bp, Candidatus Pelagibacter sp. HTCC7211
ttgagaaaaatatttattgcatctgatcatgctggatttgatttgaaagaagtaatcaaagaatatctctcaaaaaaaaaattagcttttcaagatttaggaccagataatgataaaagtgtagattatcctatatatgcacataatgtcgcaaaaaaagtaaaagttaacaaaaacaatgttggaattttaatttgtggttcaggaactggtatgaatattacagcaaataaacataaaaatatacgtgcagctcaatgttttaatttgaaatcaactaaattatcaagattgcataatgatgcaaacatcattacattagggtctagattaataacaaaaaaaaatgccttgaattttattggtatttttttaaaaactaaatttgaaggtggcagacactctaaaagaataaggaaaatttaa

SEQ ID NO: 3887 - DNA, 426 bp, Candidatus Pelagibacter ubique HTCC1062
ttgaaaaaaatatttttatcctctgatcacgctggctataaattaaaagaattaattaaacttcatttagataaaaagaaaattaactatacagacttaggtccattcaatagtgaaagtgttgactatccagactatgctcataaagttgctaaaaaagttaaaacaaacaataatcatgcaggcatactcgtatgtggctctgggatgggaatgaatattgctgcaaatagacataaaaatatacgcgccgctcagtgttttaatttgaaatcaactaaattatcaagattgcataacaatgcaaatatcattacattaggttcaagacttcttactaaaaaaactgctataaattgtgtaagcgtttttttaaatacaaagtttgaaggtggaagacacgcaaaaagaattaaaaagatttaa

SEQ ID NO: 3888 - DNA, 447 bp, Erythrobacter litoralis
atggcgacgcgcatgaagatagcgatcgcatccgaccacgccgccgtcgagctcaaggccgaactgcgcgactggctcatcgagcagggccacgaggttgccgacctcggaccggacacgaccgacagcgtcgattatcccgacttcggctacaagcttgcgggcgttgttgccgatggcacagctgagcgcggtgtcgcgctgtgcggtagcgggatcggcatttccatgtcggtcaatcgcaatccggcggtgcgttgcgcactggtcggcgagccgctttccgccgccctctcgcgcgaacacaacgatgcaaatgtcatcgccatgggcgcgcgcctgacgggcagcgacatggccaaggcctgcctcaccgccttcctcgaaaccgaattcggcggcggtcgtcaccagcgccgcgtcgacaaactctccaacccgaactga

SEQ ID NO: 3889 - DNA, 480 bp, Erythrobacter sp. NAP1
atgcgtatagccattgcatcagatcacgccgccaccgacctcaaggcaagcctggccgaatggttgatggacgaaggccacgaagtcgccgatcttggccccgaagagggcgagagcgtcgactatcccgattacggctacaaactagccgaagtggtcgcagacgggaccgctcagttcggtatcgctctgtgcggatcggggattggcatctcgatcagcgtcaatcgtcacccggcgcttcgctgcgctttggtgtctgagccgctgtcggccgctcttgcgcgcgaacataacaatgcgaactgcatcgcccttggcgcgcggctcatcggcatcgaaatggcgaagtcttgcgtagctacatttctcaacaccgaatttgccgacgaaggcgatcccgccgggcgtcaccaacgccgcgttgccaagcttggtaatccgccgacctctcccgatcacatcgagacacatcaatga

SEQ ID NO: 3890 - DNA, 450 bp, Erythrobacter sp. SD-21
atgggggcggccatgcgtatcgcccttgcttccgaccatgccgccatcgagctcaaagcagccttgcgcgactggcttatcgaacagggtcacgaggtcgccgacctcgggccggagaccaacgaaagcgtcgattatcccgactttggctacaagctcgccggcgtcgttgccgacgggacagctgagcgcggcattgcgctgtgcggcagcgggatcggcatctcgatgagcgtgaaccgcaatccgggcgtgcgctgcgcgctggtttcggagccgctatcggccgccctcgcccgcgagcacaacgacgcgaactgcatcgcgcttggcgcgcgcttgaccgccgtggacatggctaaggcttgcgtcaccgctttcctcgaaacagaattcgccggcgggcgccaccagcgccgcgtcgacaagctctgcaatcccagcctgtag

SEQ ID NO: 3891 - DNA, 438 bp, Novosphingobium aromaticivorans DSM 12444
atgcgtatcgccatcgcttccgatcacgccgccgtcgacctcaagtcgacactgcgcgaatacctgatcgatctcggccacgaagttgccgacctcgggccggaaaccgccgaccgcgtcgactaccccgattatggctacaagcttgcttcggtcgtggccgagggtatcgccgacttcggtgtcgcgctttgcggatcgggcatcggcatctcgatcgcggtgaaccgcaacccggcctgccgctgcgcactggtatccgaaccgctttcggcggcgcttgcccgcgaacacaacgatgcgaacgtcatcgcgatgggcgcgcggcttaccggcgaggacatggcgaaggcctgcctcgacgctttcctttccaccgaattcggcggaggccgccatgcgggccgcgtcgaaaagctttccaatcccgcgatctga

SEQ ID NO: 3892 - DNA, 438 bp, Sphingomonas sp. SKA58
atgaacatcgccatcgcttccgatcatgccgccgtcgaattgaaggcggaactggcgcagtggctgcgcgcggaaggtcatctggtcgaggacctggggccggcgaccgccgaccgggtggattatcccgattatggttacaaacttgcgacggcgatcgcatcgggcgcggccgaccgcggcatcgcgctgtgcggatcgggcatcggcatctcgatcgcggtcaatcgcaaccctgcctgccggtgcgcgctggtcggcgagccgctgtcggccgccctttcacgcgagcataatgacgccaacgtcctggccatgggcgcgcgcctgaccggcgtggacatggccaaggcctgcgtaaccgcattcctgaccaccgaatttggcggcggacgtcatgccggccgcgtggacaaactctcccagcctgcgctctga

SEQ ID NO: 3893 - DNA, 459 bp, Sphingomonas wittichii RW1
atggccgagaccatcgccatcgcatccgatcatgccgctttcgacatgaaagccgccctcaccgaatggctgcgcgccgaaggccatgaggtcctcgacctcggccccgacagcgccgcctccgtcgactatccggactatggctatcgcctggccgaggcgatagccgcgggcgaggccgcgcgcgggatcgcgctgtgcgggtcggggatcggcatctcgatctcggtcaaccgtcaccccgccgcccgctgcgcgctggtgaacgaggtgctgtcggcccggctgtgccgcgagcataacgacgccaacgtcatcgcgctcggcgcccggctgatcggcatcgaacaggccaaggcctgcgtctccgccttcctctcgaccggcttcgcgggcgaccgccaccagcgccgcgtcgacaagctatcccaccctcgcttccacaaggagcacgcatga

SEQ ID NO: 3894 - DNA, 453 bp, Sphingopyxis alaskensis RB2256
atgcgcatcgccatcgccgccgaccacgccgcctatgaactgaaagccctgctcgccgactggctgcgcgaaaagggacacgaggtcgaggatctgggcaccaacggccccgacagcgtcgattatcccgattatggctatcggctgggcggtgcgatcgccgacggccgcgccgaccgcggcgttgccctgtgcggatcgggcatcggcatctcgatctcggtcaaccgcaaccccgccgcgcgctgcgctttggtgtccgagccgctgtcggcgaagctggcgcgcgagcataatgacgcgaacgtgatcgccatgggtgcgcgcctcacgggtatcgacatggccaaggcgtgcctcgacgctttcctgaccaccgatttcgccggcgaccgccacgcgcgccgcgtcgacaaactctctaacccgccgcaactggagaccagccgatga

SEQ ID NO: 3895 - DNA, 474 bp, Zymomonas mobilis
gtgacctctgctgtgccatcaaatacgaaaaaaaagctggtgattgcttccgatcacgcagcatttgagttgaaatcaaccttgattacttggctgaaagagcttggtcatgaggtcgaagaccttggccctcatgaaaaccattcagtcgattatcccgattacggttataagctggctgtcgctatcgcagaaaaaaccgctgatttcggtattgctttatgtggctcgggaatcggtatctcgatcgctgtcaatcgccatccggctgcccgttgcgctttgattacggataaccttaccgcccgtttggcaagagaacataacaatgccaatgttatcgctatgggtgcgagattgatcggcattgaaaccgctaaggattgtatttcagctttccttgcaacgccgtttggaggtgaacgtcatgttcgccgtatcgataaactttcgaatcctcagttcaatatctag

SEQ ID NO: 3896 - DNA, 462 bp, unknown
  alpha proteobacterium BAL199
atgagcgacgacgtcatcgccttggcgtctgatcacgccggactcgcgctgaagacgacactgatcgacgaattgaagcgtctgggtcacgttgttgtcgacctgggcactcattccggcgcgtcggtcgactatccggactatgggtaccggattgcggctgccctcgctgatggcaaggccgatcgtggtgttgcgatctgcgggtccggtatcggaatctgcattgcggccaatcgattcgcctgggtgcgcgccgtgaactgtcacgatgtcaccagcgcccgtctgtcgcgcgagcacaacgatgccaacgtcatcgcgttcggcgaacgggttattggcgtggaggttgccaaggaggcgttgcgcgtgttcctgcagacgccgtttgccggcgatcgccatgtcgcccgcgtgaacaaactgggggcaccaccgaagatcccgagcgtgtcctga

SEQ ID NO: 3897 - DNA, 495 bp, Burkholderia mallei
atgaaagtggcgatcggctgcgacgaagcggcctacgcgctcaaggagtcgatcaagcggcacctgcgcgcgacgcaccccgagctcgagctggtcgacttcggcacgcacagcgcggacgaggcggtgctgtaccccgatatcgcgatcgaagtcgcgcagcgcgtcgcggccggcgaatttccgcgcgcgatcctgctgtgcggcacgggcatcggcgtggcgatctccgcgaacaaggtgccgggcatccgcgccgcccagtgccatgacacctactcggccgagcgcgcgcggcgcagcaacgacgcgcagatcgtcacgatgggcgcgcgcgtgatcggcaccgagctcgcgaacagcatcgtcgacgcatggcttagggcagaattcgacggcggccgctcgcagccgaaggtgcagcggatcgccgactacgaacgccgggcgggcctcacccaggccggcccgaatgacgcgcaccgcggttcatga

SEQ ID NO: 3898 - DNA, 495 bp, Burkholderia oklahomensis EO147
atgaaagtggcgatcggctgcgacgaagcggcctacgcgctcaaggagtcgatcaagcggcacctgcgcgcgacgcatcccgaggtcgaactgctcgacttcggcacgcacagcgcggacgaggcggtgctgtatcccgacatcgcgatcgaggtcgcgcagcgggtcgcggcgggcgagttcccgcgcgcgatcctgctgtgcggcacgggcatcggcgtcgcgatctccgcgaacaaggtgccgggcatccgcgccgcgcagtgtcacgacacctattcggccgagcgcgcgcggcgcagcaacgatgcgcagatcctcacgatgggcgcgcgcgtgatcggcaccgagctcgcgaacagcatcgtcgacgcgtggcttagggcagaattcgacggcggccgctcgcagccgaaggtgcagcggatcgccgattacgaacgccggacgggcctcacccaggccggtccgaacgacgcgcactgcggctcatga

SEQ ID NO: 3899 - DNA, 489 bp, Burkholderia pseudomallei
gtggcgatcggctgcgacgaagcggcctacgcgctcaaggagtcgatcaagcggcacctgcgcgcgacgcaccccgagctcgagctggtcgacttcggcacgcacagcgcggacgaggcggtgctgtaccccgatatcgcgatcgaagtcgcgcagcgcgtcgcggccggcgaatttccgcgcgcgatcctgctgtgcggcacgggcatcggcgtggcgatctccgcgaacaaggtgccgggcatccgcgccgcccagtgccatgacacctactcggccgagcgcgcgcggcgcagcaacgacgcgcagatcgtcacgatgggcgcgcgcgtgatcggcaccgagctcgcgaacagcatcgtcgacgcatggcttagggcagaattcgacggcggccgctcgcagccgaaggtgcagcggatcgccgactacgaacgccgggcgggcctcacccaggccggcccgaatgacgcgcaccgcggttcatga

SEQ ID NO: 3900 - DNA, 495 bp, Burkholderia thailandensis MSMB43
atgaaagtggcgatcggctgcgacgaagcggcctacgcgctcaaggagtcgatcaagcggcacctgcgcgcggcgcatcccgaagtcgagctgaccgacttcggcacgcacagcgcggacgaggcggtgctgtaccccgacatcgcgatcgaagtcgcgcagcgcgtcgctacgggcgagtttgcccgtgcgatcctgctgtgcggcacgggcatcggcgtcgcgatctccgcgaacaaggtgccgggcatccgcgcggcgcagtgccacgacacctactcggccgagcgcgcgcggcgcagcaacgacgcgcagatcatcacgatgggcgcgcgcgtgatcggcaccgagctcgcgaacagcatcgtcgacgcgtggcttagggcagaattcgacggcggccgctcgcagccgaaggtgcagcggatcgccgactacgaacgccgggcgggcctcacccaggccggcccgaacgacgcgcactgcggttcatga

SEQ ID NO: 3901 - DNA, 489 bp, Burkholderia thailandensis MSMB43
atgaggcaagctatgaagctggcaatcggctgcgatgaagccgcgttcgaactgaaggaaatcatcaagcagcatctcttgaagctgggagtcgacgttacggacttcggcacttacgaagctgaacctgtccactacccgaatattgcgttcgcggttgcagagaaggttgccgcaggcgaatacgagcgggcggttctgctatgcggcacggggatcggtatggcgattgccgccaataaagtccgcagtattcgggcggcgcagtgccacgacacttattctgcggaccgcgcaagcaagagcaatgatgcgcaaatcattacgatcggtgctcgcgttgtcggtccggaactcgccaaggcaatcgtcgacaagtggctcggggctcacttcgacggtgggcgctccattccgaaggtgaatctcatcagggaatatgaggataaccaccaggagaaccgcaacaatccgaacgcttgcgtttga

SEQ ID NO: 3902 - DNA, 474 bp, Delftia acidovorans SPH-1
atgaagctggccatcggctgcgacgaagccgcctgcgacctcaagaacgccgtgaagcagcatctgctggcccagggccacgaagtggccgacttcggcacgcacgacggcgagccggtgctctaccccgacatcggcatcgcggtggcgcaggccatcgtccagggccgccatgagcgcggcgttctcctgtgcggcacgggcataggcatggccattgccgccaacaaggtggcgggcatccgcgccgcgcaggcccatgacacctattcggccgagcgcgccagccgcagcaacgacgcgcagatcatcacgctgggctcgcgcgtgatcggggtggagctggccaaggccatcgtggaccgcttcctcgcatcgcgcttcgatggcggcagctcggccctgaaggtggatgccatcaccggctttgaacgctcgcaggccgccgcggccgggcgcgggcagggcgcgtga

SEQ ID NO: 3903 - DNA, 450 bp, Polaromonas sp. JS666
atgaaacttgccattggctgtgacgaggccgcctacgacctcaagcaaacgcttaaaaaacacatgattgacgccggccacgaggtgaccgatttcggcacccatgacgcgcagccggtgctctacccggatgtggccttcgcggtggcggagcaggtggcgggcggcgcctatgaacgtgccttgctgctgtgcggcaccggcatcggcatggcgatatcggccaacaaggtcaagggcgtgcgcgcggcgcagtgccacgacacctactcggccgagcgcgccagccgcagcaatgacgcgcagatcatcaccatcggcgcgcgggtggtcggccccgagctggccaaatccatcgtggacgcctggctgcgcagcggcttcgatggcgggcgttcgcagcccaaggtcgacctgatccaggcctacgaagcggggcattcgctatga

SEQ ID NO: 3904 - DNA, 480 bp, Verminephrobacter eiseniae EF01-2
atgaaaacccccatgaaaatcgccatcggctgcgacgaggccgccaacgccatgaaagactgcctgaaggccgcattgctggcccagggccaccaggtgacggacttcggcacccatgaccaccagccggtgctgtacccggacatcggcatcgcggtggcgcaggccatcgcgcgcggccaggccgagcgcggcctgctgctgtgcggcaccggcatcggcatggcgattgcagcgaacaaggtgccgggcatccgcgccgcgcaggcgcacgacacctacagcgccgagcgcgccgcgctcagcaacgacgcgcacatcatcaccatcggcgcgcgcgtgatcggcatcgaactggccaagagcatcgtgcagaccttcctggccgcgcagtatgttgccgggccgcgctcgcaacccaagctcgacgcgctggcagcgcatgagcagcggctgcggcaggccggagacagcggctga

SEQ ID NO: 3905 - DNA, 450 bp, Leptothrix cholodnii
atgaagatcgccatcggctgcgacgaagccgcctgccagatgaaggacgccatcaaggccgagctcgccgcccagggccacgaggtgcaggactacggcacgcacgacaacgcgccggtgctctaccccgacatcggcgtggcgctggccgaaggcgtggcgcgcggcgaggcccagcgcggcctgctgttctgcggcaccggcatcggcatggcgatctcggccaacaaggtgccgggcatccgcgccgcgcaggcgcacgacacctactcggccgagcgcgccagcaagagcaacgacgcccagatcatcacgatcggcgcgcgggtggtcggcatcgagctggccaaggcgatcgtgcaggccttcatcggcagctcgttcgagccccgctcgcagtcgaagctggacgcactggcggcccacgagcagcgcctgcgccagccctga

SEQ ID NO: 3906 - DNA, 477 bp, Bdellovibrio bacteriovorus
atgattgtctatgttggttgcgatcacgctgggttggatttaaaacttaaagtgatggcggctcttccagatatccaatggaaggacatgggcactcactccgctgactctgtcgactatccggactatgccgatcaggtgtgccgtgaagttgttaaagtggagcttcaaaatcaaaaaaacaacctgattgattctcaaaaaggcccggctttgggtcttttgatctgtggctccggccagggtatggccattcgcgccaacaagttcccacaaatccgtgcggcgctttgctggaataccgacatcgcccgtctgtcccgggaacataacaacgccaacattctttgcctgagcgaacgtttcacatcccctgatgatgcggtgaagatgctgcaaacgttcctgtcgacatccttcgccggtggacgccaccaacagcgcgtcgacaagctttcaagcgacactggttgttga

SEQ ID NO: 3907 - DNA, 459 bp, Desulfobacterium autotrophicum
atggatatggcgattgacacgacagcccccattatcattggctgcgaccatgccgctttccccttaaaagagaagatcatcgtctttctcaaggggttgggcattgaggtaaaggatgcaggaaccttcagccaggaatctgttagttatgttgattatggaaaaaaggttgcaaaggccgtgtctgaaggcgagtattcccggggaattctgctgtgcggtaccggccttggtatgtccatggttgccaatcggtttccccgggtgcgtgcggcactttgcagtgatattttttccgtgcgcatgagtcgggagcataatgactcaaacatccttgtgctcgggggccgcatcattggtgatgcccttgcctttgagctggtcaggacctggcttgagactccgtttgaggggggaaggcatcttgacaggatcaagagcctggaaacatctgtatag

SEQ ID NO: 3908 - DNA, 447 bp, Desulfococcus oleovorans Hxd3
atgaacatcatcattgcaagcgaccatgccggtttccggacaaaaagggacattattgactatcttcgccgcaaccatgccacctgggaggtgaccgacctggggccggaagacgacgcgccggtggattatccgatatacgcccacatggtggcaagcgccgtggcagccggggactaccggcgcggcattctcatctgcggcagcggcatcggcatgtccatgatggccaaccggttccagggggtgcgggccgccctgtgcgtgacgccccagatggccgaactgagccggcagcacaaccggtccaacgtgctgtgcctggccggtcggctggtggagctggaggaaaacattcagatcgtcaatacgtggctgaataccgactatacggacgaggcccggcacacccggcgctaccggctgatggatctgctgcaaagctga

SEQ ID NO: 3909 - DNA, 429 bp, Desulfotalea psychrophila LSv54
gtgaatataataattgcatcggaccatggtggctatgagttaaaagagttgcttaagaaaaagattgtagctctggggcataccattgaggatgtgggctgtgacagccttgactctgttgattatccggattatgcccagagggcagtcgatgctcttgtggagcatggggataggggcgttttgatttgtggtacaggcattggtatgtccattgccgcaaatagaaatagatctgttcgagcggctctctgtcatgatgagtataccgctgccatgagtcgtgagcataatgatgctaatatactttgtatgggggcgcgtgtcctttcacctgaacgtgctcagcaggttctacatacctggttgactactgaatttgttggcggaagacatttacaacgtattaccaagtttagcgatatttaa

SEQ ID NO: 3910 - DNA, 423 bp, Desulfurivibrio alkaliphilus AHT2
atgaaaattgccctggggtctgatcatggcggcttcggtctgaaagagacggtgcttacggtgttgcagcagttgggtcacgaaattcgggactgcggcaccatggacggtcagtccgttgattacccgcagattgtggacgcggtttgcgagctggtgaccgccggaacctgccagcggggaattatgatttgcggcaccgggatcggggtttccatggccgccaaccggcgccggggtatccgcgcggcgctctgtaccgagggcttcagcgcccggatgagccgtgaacacaacgatgccaatgtgctctgcctgggtgggcgaaccatcggccccggccaggcggaagaaattgtccggatctggctgagcaccgaatttgccgggggccggcacctgcgccgcatccaaatgttttaa

SEQ ID NO: 3911 - DNA, 453 bp, Desulfohalobium retbaense
atgcctgaagcgcccatcgtattcggctccgaccacgctggtctgccgttgaaatccgctttactggaaatcctgcagcaacaaggaatcgccaccgaagaccagggcacacacactttcgacagctgcgactaccccgttttagcctctgaagtctgtcagcggatccagcagacccggggcctcggcgtgctggtctgtggttcaggactgggcatgtccatggtcgccaaccgctatcagggcattcgtgcggctttgtgcaccaacgaatacctggctcgcatggccagactccacaacaacgccaacatcctctgcctcggagaccgggtactgggcatcgatttggcccaaagcattctggaaacatttctcaacaccccctttgaggggggacgtcaccaacgccgggtggatctgatcgacaccctgcctcaaagggggcagtaa

SEQ ID NO: 3912 - DNA, 435 bp, Desulfonatronospira thiodismutans ASO3-1
atgaataaaaccgtggtctttggttcggaccatgcagggctgtggctgaaaagggtcctgatggaccgtctaagtaatgaccggcagacaatagacgtggggaccgaagatgattccagctgcgattaccctgtttacgcaggcaggctgtgtgaaaaagtcctggagcttcagtgcctgggtgttctcatctgcggttccggcctgggcatgtccatgacagccaaccgtttccggggaatccgggcagctctttgctgcaacgaatacatggccaggatggccagaaagcacaataacgccaatgtcctgtgcatgggcgaaagggtcattggagtggatctggccggcagcatcctggatgtcttcctggagaccggatttgaggggggcaggcatgcaaagcgcctggatattattgaggaaattgcctga

SEQ ID NO: 3913 - DNA, 450 bp, Desulfomicrobium baculatum DSM 4028
atgcgcaccatcatcttcggctccgaccacgcaggcttcggcctcaagaacattctgatggagcacctcgcagggcgctttgacaccgtcgatgtcggcacccactctctggagagctgcgactacccgaacatcgcgggaaaattggccacggaagtgatcgcgcttaaagccaccggcatccttatctgcggctccggcatcggcgtatccatcaccgccaaccgcttcgagggcatccgcgccgccctgtgcgccaacgagtacatggcccgcatgagccgcatgcacaacgacgccaatgtgctgtgcatgggcgaacgcatcatcggcgtggacctggccaaggccatcgccgacgcgttcctcggcaccgagttcgagggcggacgccaccagcgccgcgtggacctgatcgaccggcagaccccttcacatcaaccatcataa

SEQ ID NO: 3914 - DNA, 441 bp, Desulfovibrio aespoeensis Aspo-2
gtgagcagaaccatcgtcatcggctccgaccacgggggctacacgctcaagcaggcgcttatcaaggccctggccgactggggctgcctggtcgaggaccagggaccggactgcctcgattcctgcgactacccgatctatgccgccaaggtggtcgagcgggtcaggaacgacaacggcgtgctcggcgtgctcatctgcggcacgggccagggcatgaccatgacggccaaccgcatgggcgtgcgcgcggccctgtgcaccaacgaatttctcgcccgcatggcgcgcgagcacaacgacgcgcgcatcctctgcctgggcgagcgcgtcaccggccagggactggccctggccatactcaagacatttctggaaaccgggttcgggggcgagcggcatcagcggcgcatcgacctcatggacaccgtctccaaataa

SEQ ID NO: 3915 - DNA, 435 bp, Desulfovibrio desulfuricans
atgcaatccatccatctggcatcggaccatgctggcatcgatcttaaaaccacactggccgagcatttgggaaaaaaaggcatcaacgtcgtaaaccacggcactgattccagagaaagctgcgactatcccgtcctggcgcacaagctttgcgccgctgtggaagcgtccggcgaactgggcattcttatttgcggcacgggcatcggcgtgtccatagccgccaaccgccactccggcatccgcgccgctctttgcaccacggaactgcacgcccgcttttcgcgccttcacaacaatgccaatgtgctttgcctcggcgcgcgcgtcaccggtgtggagctggcgcaggccatagtggatgcttttctggaagccccttttgaaggcggccgccaccagcgtcgcctggatatgcttaacctccccgcataa

SEQ ID NO: 3916 - DNA, 441 bp, Desulfovibrio desulfuricans
atggccaagcaagtaatcatcggctccgatcatgccggtttcagcctcaaggaacttcttgtttctgaacttaccaaaagcgggtacgatgtacacgacatgggaccggcaaccgcggaaagctgtgactatccgctttttgcgcagaaagtatgcgaacgggttctgcagcaaaaagcacagggaattctcatctgcggaaccggcataggcatgtccatggctgccaaccgcattgacggcatacgcgccgcactctgtaccaccgaattccatgccagggccacccgtctgcacaacaatgccaatgttctctgtctgggcgaacgcgtgaccggccccggtgttgcacttgagcttgccaggctttttcttgaaaccgagtttgaaggcgggcggcatcagcgccgcatcgacctgtttgattctgccagcgcctga

SEQ ID NO: 3917 - DNA, 456 bp, Desulfovibrio magneticus RS-1
atgcccaagaccgttttcctcggctccgaccatgccggcctggaactcaaaaccgttgtcgcggcccatctcgccgctgccggccatgccgtggtcgatctcggcccgtccgaagccaagagcgtggactaccccgatttcgccaaggccgtgtgcgccaaggtcctggaaaccacgggatcgtgcggcatcctcatctgcggcaccggcatcggcatgtccatggccgccaaccgcatccccggcatccgggccgccctttgcgtcaacgaatacctggcccgcatgacccgcctgcacaacgacgccaacgtcttgtgcctgggcgagcgtgtcatcggccaggggctggccgcctccatcgtcgacgccttcatggacaccgccttcgaaggcggccgccaccagcgccgcgtggacctgatcgaaacctgccggcccggctgcgggctgtag

SEQ ID NO: 3918 - DNA, 429 bp, Desulfovibrio piger ATCC 29098
atgaaatccatccacatggcctgtgaccacgccggtatcgaactcaaggaaaccctgcgcgcccatctggaaaagatgggctatacggtcaccgaccacggcacctacagcaaggaaagctgcgattaccccgtgttcgcccatgccctgtgcaatgctgtcgaagccgaagatgtgcccggcatcctgatctgcggtacggggatcggcatgtccatcgcggccaaccgtcacaagggcatccgcgcggccctgtgcaccacggagctgcatgcccgcttcacccgcctgcacaacaatgccaacgtgctgtgcctgggggcccgggtcacgggcgtggagctggcgcttgccatcgtcgataccttcctgtccaccgaattcgaaggcggccgccaccagcgccgtatcgatctcctcaacgcctag

SEQ ID NO: 3919 - DNA, 432 bp, Desulfovibrio salexigens
atggccggtaaagttgtaatcggttcggaccacggagggttcaccctcaaagcattcgccatcaaactgctcagcgacatgggttatgatgtaatcgatgccggacctgaagaagctgtcagctgcgactatcctgtttacgccgaaaaagtagccgaaatggttaccggggaagatattcccggcatcctgatttgcggaaccggactgggaatgtccatggctgcaaacaaaatcaagggcatccgtgctgccatgtgtactaatgagtacatggccaagatggcccgtgcgcacaacaatgcgaacatcctctgcctcggtgaacgagtgatcgggcccggattggcggaagaaattatccgcgccttcatgacttccgaatttgaaggtgatcggcacctgcgcagaatcaatcttttcgataaatag

SEQ ID NO: 3920 - DNA, 444 bp, Desulfovibrio vulgaris
atggcacgcaaagtattcgtcggttcggaccatgcgggtttcgccctcaagcagagcatcgtcgacagccttcgcaacgcaggacacgacgtcgaagacctcggccctgaaagcgccgtcagctgcgactacccgcactacgcccagaaagtctgcgaccgtgttctcgccgaagaggcccttggcatcctcatctgtggcacgggcatcggcatgtcgatggctgccaaccgcatccccggcatccgcgcggcactctgcacctgcgaattccacgcccgcgccacgcgccagcacaacaacgccaatgtcctctgtcttggcgaacgcgtgacagggcccggtgtggctcttgaactggcacgcctcttccttgacaccgacttcgaaggcgggcgccaccagcgccgcatcgaccttttcgacctcaacggttgccgctag

SEQ ID NO: 3921 - DNA, 453 bp, Desulfovibrio vulgaris
atgtccgcaccggtcatcatcggctccgaccacgccggtctcgccctgaagcaggtcatcatcgcccacctcaaggccacgggccgtcaggtggaagaccttggcccccagaccgccgaaagttgcgactatccgctctacgccgccaaggtgaccgagcgggtgctggccaccggcggcttcggcatcctggtttgcggcacgggcatcggcatgtccatggccgccaaccgctttccgggcatccgcgccgcgctgtgcacctgcgaattccacgcccgcgccacccgccagcacaacgacgccaacgtgctgtgccttggagaacgggtgaccggtcccggcgttgccatgggtcttgtggacctgtttctgaacacccccttcgagggtggccgccaccagcgccgcatcgaccagttcgacgggcctgcctgcaccggcggttgctag

SEQ ID NO: 3922 - DNA, 429 bp, Lawsonia intracellularis
gtgctaaaagtttacattgcttctgatcatgcaggattttctttaaaaaatactcttatagagcaattgcaagataacgattatatagtaagagatttaggtccaatgacatctgaaccttgtgattaccctttatatgctcaatatgtttgtgaacaagtattagatgaaataggcagttttggtattttaatttgtggaacaggtataggtatgagtatggctgctaaccgtataaaaggtattagagcagcactatgtacttctgagttccaagcaagagcaacacgtctacataataatgctaatatattatgtttaggtgaacgtgtaataggtaaaagcattgcaatagagattgttaatatttttttgacaacaccatttgagggtggacgacatcttcagcgtattgcttcatttgattaa

SEQ ID NO: 3923 - DNA, 453 bp, Desulfuromonas acetoxidans
atgctactgattgccagtgatcatggaggactggaactcaagcagattctggtcgattatctcaaacagcagggcgtcgatgtgaaagatcttggtgttcacgccgaagattctgttgattaccctgactatgccgcgctcgtcgccgagccgatctccaaacaggaagctgatcaggggattctggtctgcggaaccggaatcggcatgtcgatcgcagccaacaaattcccgggtgtacgtgctgcattggcccatgacgaatttacggcgcagatggcccgtgaacacaacaatgccaatatcctcgtccttggtggtcgtgttctcgaccctgagctcgcttgtcggatggtttctgtctggtacgatggtgcctatgaaggtggccgccaccaaaaccgactgaataaaatcattcagctcgaacgccactgcgacgccgacgcataa

SEQ ID NO: 3924 - DNA, 456 bp, Geobacter bemidjiensis Bem
atgatagtcctcggcagcgatcacggcggcctcgagctgaagaacgagatcaagaacctcctagaccagagggggattccctgcgaagacctcggcacccataacggcgactccgtcgactaccccgatttcggggtggccgtgtcgcgccgcgtctcggaagggagcgcggagaagggtatcctggtctgcagcaccggaatcggcatgtccatcgtggccaacaagttccctggagtacgcgcggcacttgccacggacgtcttcatggcgaccatggccaaggagcacaacaacgcgaacatactggtgctcggcgggcgcgtgctgaaaacagaactcgcccgcgagatggtggccgcctggctggacaccgcgttcgccgcgggaaggcaccaggggcgcctggacaagatcgccgcagtcgaacgccaactgggaaccaagctttcctga

SEQ ID NO: 3925 - DNA, 450 bp, Geobacter lovleyi SZ
atgaagattgctatcggttcagaccacggtggatttgaattaaaacaggccctgatcccttttctgcagggcagggacattgaggtggcagacgctggcacctattcaaccgattcggttgattaccctgaatttgctgaagcagtggccctgctggtggtacatggtgaggcagacgcaggtattgtgatctgcggtaccggcatcggcatttccattgctgccaacaagcttcccggcatcagggcggccctggtaaccacaccccagatggctgagttggccaaacaacataacaatgccaacatccttgccctagggggccgtatcctgtcgcttgaaacagctgaggcctgcgtagcagcctggcttgatgctgtttatgaaggagaccggcaccagcgccgtctggacaagatcaccaccattgaaaaaaagagctgtcagtag

SEQ ID NO: 3926 - DNA, 453 bp, Geobacter metallireducens
atgcggataggcatcgccgccgaccacggcggtttcaccatgaaggagcggatggctgccgccctcagggaggcggggtacgagttgacggacttcggcgctgaacggctggacccggacgatgattaccccgatttcgtcatccccttggcgcaagcggttggcgaagggaagctggatcgggggatcgccttctgctcgagcggcgtgggggcatccattgccgccaacaaggtccccggagcacgggcggccctgattcacgacgactactccgcccaccagggtgtggagcacgacgacatgaacatcatctgcctcggcagtctggtggtggggtacgctcaatcctgggagctggtcagggccttcctcgccgccaccttcagcggggccgagcgccaccgtcgccgcctggccaaggtggcggccctggaacagtgcgggaggtga

SEQ ID NO: 3927 - DNA, 447 bp, Geobacter metallireducens
gtgatactcgtcggaagcgatcatggaggccttgaactgaaggaggcaattaagcttctcctgactgagcggggcattactgttgaggattgtggtactgataacggcaattcggtcgattatcccgacttcggcattaaggttgcccgcaagatttcagcaggcgaagcggagaaaggtattcttttctgcggaaccggcatcgggatgtcaatcgttgccaacaagttccccaatgtaagggctgccttggcaaccgaccctttcatggctcgtatggcgaaggaacacaataacgccaatatactggttcttggagggcgggtcctcgacgaggcgacggcccgcgaaatggtttgtgtctggctcgatgccacttttgaaggggggcgtcatcaggggaggctcgataagatagccgcccttgaaaaggaactgatgaagtag

SEQ ID NO: 3928 - DNA, 447 bp, Geobacter sp. FRC-32
atgatagcactgggtagtgatcacggcggacttgcactcaaggttgaaatcaagaagcttttgctggagcgtggcattcctttcgaagactgcgggaccgataacggtgattccgtggattatcccgactttggcgaaaaagttgcgaggaaggtatccaagggtgaggtggagaagggaattcttgtctgtggcaccggtatcggcatgtccattgttgccaacaaatttccccatgtcagggctgccattgttaccgacagctttatggcccgcatggccaaggagcacaacaacgccaacattctcgttcttggaggcagagttcttgataacgatggagcaagagaaatggtatctacctggctcgatgccgccttcgaggggggccgtcaccagggaaggcttgacaagattgcactgattgaaaaagaactctacaagtag

SEQ ID NO: 3929 - DNA, 447 bp, Geobacter sp. M18
atgatagtccttggtagcgatcacggcggccttgagctgaagaacgagataaagaagctgctcgaagagcgggggcttccctgcgaggacctgggcacccacaacggcgactcggtcgattaccccgatttcggggagcgggtggcgcgccgcgtctccgaggggagcgcggaaaaggggatcctggtctgcggcaccggcatcggcatgtccatcgtggccaacaagttccccggcatccgcgcggctctcgccaccgatgtcttcatggcgaccatggccaaggagcacaacaacgccaacatcctggtgttgggcggccgcgttctggacaccgggaaggcccgcgacatggtggcggcctggctcgacaccgagtacgcagcaggcaggcaccagaaccgcctggacaagatcaccgcactggagcgcgaactcaagggatga

SEQ ID NO: 3930 - DNA, 456 bp, Geobacter sp. M21
atgatactcctcggcagcgatcacggcggtctcgaactgaagaacgagatcaagaacctcctcgacgagagggggattccctgcgaagacctcggcacccataacggcgattccgtcgactacccggacttcggggagcgggtggcgcgccgcgtttcggaagggagcgcggagaaggggatcctggtctgcggcaccggaatcggcatgtccatcgtggccaacaagtttcccggggtgcgcgcggcgcttgccacggacgtcttcatggcgaccatggccaaggagcacaacaacgcgaacatcctggtactcggcggtcgcgtgctgaaaaccgaactcgcccgcgagatggtggccgcctggctggacaccgcgttcgcggcgggaaggcaccaggggcgcctggacaagatcgccgcggtcgaggggcaactgggaaccaagctttcctga

SEQ ID NO: 3931 - DNA, 447 bp, Geobacter sulfurreducens
gtgatagtcgtcggtagcgatcacggtggtctggaactgaaggaagcggttaagcggctccttgccgagcggggggaaaccttcgaagactgcggaaccgataacggcaactcggttgattacccggacttcggcatcaaggtggcccgcagggtatccaatggcgaggcagggaaggggattctcctctgcggcaccggcatcggcatgtcgatcgttgccaacaagtttccccgggtgcgtgcggcccttgccaccgacgccttcatggcacgcatggccaaggaacataataacgcaaacatcctggtcctcgggggccgggtactcgaggaggccgtggcccgggagatggtcatcgcatggctcgacggtgtgtacgaaggcggccgtcatcagggtcggctcgacaagattgcggccctggagcgggaactgatgaagtag

SEQ ID NO: 3932 - DNA, 450 bp, Geobacter uraniireducens Rf4
atgatagcaatcggtagtgatcatggcggcctgtctctgaaagaggcattgaaaaaactgttggcagagcgtggaatctcctttgaggactgcggcaccgataatggtgattccgttgattatccggatttcggtgtaaaggtggccaggaaggtttcttcgggcgaagtggagaaggggatactcgtttgcggcaccggtatcggtatgtcgatagtggccaacaaatttcctcgagttcgcgctgcactcgtaacggattcttttatggcgcagatggccaaggaacacaataacgcaaacatactggtgctcggcggcagggtactggatgagaacgcggccagaacgatggtggcaacctggttggatgccacatttgagggtggccgtcaccaggccaggctcgacaaaatagaagacatcgaaaaggaactgcgtaggtcgtag

SEQ ID NO: 3933 - DNA, 456 bp, Pelobacter carbinolicus
atgttccttatagccagtgatcacggcggtcttgaactgaaagaacaggtcaaggcatatcttaagcaacgtaatatcgaagtgcgagacctaggaaccgataacggtgactccgtcgattaccccgatttcggggaacgtgtcgggagagcgatttccacaggtgaagccgaaaaaggcattctgatttgcggtaccggcatcggcatgtcgatcgttgcgaataaattccccggtgtccgcgcagccctgatctgggatgagttcaccgcgcgtatgtccaaggaacacaataatgccaatattatcgtcatgggcgggcgtatgctctccgacgacaaggccagccagatggtcggggtttggctcgatgctacctttgagggtggacgacaccagaaacgcctcgataaaatagcgcaaatagaggaagatatcagatccggccggctttga

SEQ ID NO: 3934 - DNA, 447 bp, Pelobacter propionicus
atgattgtaattggcagcgatcacggcgggcttgacctcaagcaggcgctgacgcgctacctggccgatcgcgctatcaaagtcagcgacatcggcaccgataacggtgattccgtggattatccccgcttcggcctcaaggtggccgagatggtggcttccggctctgccgaccgcgggattctcgtctgcggcacaggaatcggcatgtccattgccgctaacaaggttcccggaatacgggccgcactggccacggatgtcttcatgggccgcatggccaaggagcacaacaacgccaatatactggtgctgggaggtcgcgtgctggacgagcaggaggcctgtgacatcgtcggtgtctggctggacgcaaccttcgagggggggcgccatcagggcaggcttgaccagatcgctgaaatagagaaaaagtactgtaaataa

SEQ ID NO: 3935 - DNA, 483 bp, Stigmatella aurantiaca
atgcgcatcgccctggccgccgaccatgcgggtttcgagctgaagaactggctgctgcgggccctggagggcgctggccataccctcgtggacaagggcacctacagcaccgagcccgtggactacccggactgcgcccaggccgtgggcgaggccttgcgcggtggcgacgtggaccgcgccatcctcatctgcggcagcggcgtcggcgcctccattgccgtcaacaagatgcccggcgtgcgcggcggcttgtgtcatgacacctactccgcgcaccagggcgtcgagcatgacgacatgaacgtgctggtgctgggcgcccgggtcatcggcctcgccctcgcggaggaactggcgcgagccttcctcgccgcccgcttctccggggaagagcgccacaagcgccggctctccaaggttcacgccctggaggcccgcttcgcccctggcgctgggcccctcacttccccggagcggtga

SEQ ID NO: 3936 - DNA, 444 bp, Anaeromyxobacter dehalogenans 2CP-1
atggccgaacgggtgatcgcgggctccgaccacgcagggctgaacctgcgggccgaggcggtgaaggtggcgcgggcggccgggttcgaggtcgaggacctggggccgttctcgggcgagagcgtggactaccccgactacgcgcggcaggtggccgaggcggtggctgccgggcgcgcgcgcctgggcatcctggtgtgcgggaccggcatcggcatgtcgatctccgccaacaaggtccacggcgtccgggcggcccactgcgtcaccgagttcgacgcgcggatggcccgcgcccacaacgacgcgaacgtgctctgcatcggcgagcgggtgctcgggctcggcctgggcgcggccgtcgtgaaggcgttcctggagacgccgttcgagggcgggcggcaccagcggcgcgtcgacaagatcggcgccctggagcgctga

SEQ ID NO: 3937 - DNA, 444 bp, Anaeromyxobacter dehalogenans 2CP-C
atggccgaacgggtgatcgcaggctccgaccacgcagggctgcacctgcgggccgaggcggtgaaggtggcgcgggcggccgggttcgacgtcgaggacctggggccgttcacgggcgagagcgtggactaccccgactacgcccggcaggtggccgaggcggtggcggccgggcgcgcgcgcctcggcatcctggtgtgcggcacgggcatcggcatgtccatctccgccaacaaggtccacggcatccgggcggcccactgcgtcacggagttcgacgcgcggatggcccgcgcgcacaacgacgcgaacgtgctctgcatgggcgagcgggtgctcgggctgggcgtggccgccgcggtcgtgaaggcgttcctggagacgccgttcgagggcgggcggcaccagcggcgcgtggacaagatcggcgcgctggagcgctga

SEQ ID NO: 3938 - DNA, 486 bp, Anaeromyxobacter sp. Fw109-5
atgcgagtggccatcgccgcggaccacgcgggcgtcgccctggcggcgatgctgcgcgccgagctggcggtcctggggcacgaggtcgtcgatctcaccccccgcgaccaggggccggaggacgactaccccgaccacgcggtgagtgtcggcgaggcgatccgctccggccgtgccgagcgcggcgtcctcgtgtgcgggagcggcgtcggcgtggccatcgccgcgaacaagctgccggggatctacgcgggcgcgtgccacgacacctactcggcgcaccagggcgtcgagcacgacgcgatgaacgtcctcgcgctcggagcccgcgtcgtcggcgaggcgctcgcccgggagatcctcggggccttcctcggcgcgcgcccctccggcgaggagcggcaccgccggcggatctccaagacgcgcgggatagaggcgcgcgcgctccagggagcgcccggcacctcgggggagccgcgttga

SEQ ID NO: 3939 - DNA, 444 bp, Anaeromyxobacter sp. Fw109-5
atggcggatcgtgtgatcgcgggctcggaccacgcggggctttcgctccgcgccgaggccgtgaaggtggcccgcgaggccggcttcgaggtcgaggacgtcgggccgttctccggggagagcgtggattacccggactacgcccggcaggtggccgaggccgtggcgagcgggcgggcgcggctcggcctcctcgtgtgcgggaccggcatcgggatgtcgatcgcggccaacaaggtgaagggggcgcgcgctgcgcactgcgcctcggagtacgaggcgcggatggcgcgcctccacaacgacgcgaacgtgctctgcatcggcgagcgcgtggtcgggctgggcctcggggccgcgatcgtgaaggcgttcctcgagacgcgcttcgagggcggccgccacgagcgccgcgtccagaagctgaaggacatggaaaagtag

SEQ ID NO: 3940 - DNA, 444 bp, Anaeromyxobacter sp. K
atggccgaacgggtgatcgcgggctccgaccacgcagggctgaacctgcgggccgaggcggtgaaggtggcgcgggcggccgggttcgaggtcgaggacctggggccgttctcgagcgagagcgtggactacccggactacgcccggcaggtggccgaggcggtggcggccgggcgcgcgcgcctgggcatcctggtgtgcgggaccggcatcggcatgtccatctccgccaacaaggtccacggcgtccgggctgcccactgcgtcaccgagttcgacgcgcggatggcccgcgcgcacaacgacgcgaacgtgctctgcatcggcgagcgggtgctcgggctcggcgtggccgcggccgtcgtgaaggcgttcctggagacgccgttcgagggcgggcggcaccagcggcgcgtggacaagatcggcgcgctggagcgctga

SEQ ID NO: 3941 - DNA, 444 bp, Myxococcus xanthus
gtgaaagtcatcctcgcttcagaccacgcgggactggagctccggcaggagctggtggccgcgctcaccgcgcggggcgtggcccacgaagacgtgggtcccgtcacgcgggactcggtggactacccggacttcgccgcgcgggtgtcccgcgccgtgacgtccggggaggccaccctgggcgtgctggtgtgtggcaccggcattggcatgagcatcgtcgccaacaagcacaagggcatccgggcggccctgtgcaccacggagttcgaggcccggatggctcgggcccacaatgacgccaacgtgctgtgcctgggccagcgcgtggtgggggccggcgtgggccgcgccatcctggaggcgttcctcagcactgctttcgaaggcggccgccacgagcggcgcgtccagatgattcgcgaggccgagtcccagggctaa

SEQ ID NO: 3942 - DNA, 483 bp, Haliangium ochraceum DSM 14365
gtgaagtggttcgcgggtgcggaccacgccggctacgagctcaagcagcagctcgtggccgtgttgcgcgcgctgggcgatgaggtcgaggacctcggcacccacggcagcgagtcggtcgactatcctgacttcggcgccgcggtcggccgcaaggtcgcagccgaggccggcaccctgggcctggtggtgtgcggcagcggcatgggcatctgcatcgcggccaacaagatcgccggcgtgcgcgcggtcgcggtgagctgcgcctacgcggcgcgcatggcgcgggcccacaacgacgccaacgtgctggcgctgggccagcgcatcgtcggcgtcggcgtggccgaggacgccctacgcgcgttccgcgacggcgtcttcgagggcggccgccaccagcgccgcgtcgacaagctgagcgcgctcgagggcgccgacccggccgcgggcgcggaccccgcgggtgcggactcggtctga

SEQ ID NO: 3943 - DNA, 468 bp, Plesiocystis pacifica SIR-1
atgcgattccacgtcggaagcgatcacggcggcgtcgagctgcgcaaggtcctggtggcggccctcgccgagtgggaaattcccgtgctcgccgagtacggccccgccgcgccgggcgagaaggcggactaccccaacgtcgcccgcgagctcgcgcaggccgtgcttcgtgaccgcggccaaggcggcggcgaggacgtgttcggtctgctcgtgtgcggcaccggccagggcgtggcgatgaccgccaacaaggtcccgggcgtgcgcgccggcgtggtctccgacgtgttcagcgccaagatgatccgcgcccacaacgacgcgcaggtcctgtgcctgggcgagcgcgtgctgggcacggagctcgccaagcagctgctccgagccttcatcgacgcccccttcgaggggggccgccacgcccggcgcgtggggttgatggagccggcgggggaggagcgctga

SEQ ID NO: 3944 - DNA, 459 bp, Syntrophus aciditrophicus SB
atggaacaaaagatcattatcggtgcagaccacgccggatttcaactgaaggaaaccgtcaaatcctttcttgaggaaaagggctgggttgtgtcggatatcgggacggacagcgaagaagccgtcgattatcctgatttcggggaaaaggttgccggggcggtctcggccggtgtcttctcacggggcatccttgtatgcggctcaggagtgggtatggccatcgtcgccaacaagttcgacggaatccgcgcagccgtctgcctggacacagagacggcgcgtttgagccgtctgcataacgataccaacatcctcatacttgccggcagacggactcttccggaaacagcccggcagattgtcgacgtctggctggaaactccctttgaaggaggacgccaccggggacgcctggataaaattcgggctctggaaaatgagaagggcaaagcctga

SEQ ID NO: 3945 - DNA, 486 bp, Syntrophobacter fumaroxidans MPOB
atgcgtgtcggaatcgcggcggaccacggcggtttcgagctcaagcgacagttggtggaggaactcgcggcaacgggccacgacgtggtggatttcggagcacgccggttcgacccggccgacgacttcccggactatgtcgtgccgcttgcccgagcggtggtcgaacgaacggtggaaagagggcttgccgtttgcggcagcggcgtcggtgcgtcgattgcggccaacaaggtgcccggtgcgcgcgcggcgctcatcacggacgtttattccgcacgccagggagtcgaggacgatgacatgaacatgatgtgcctcggcggccgcgtcgtgggggtggaactcgccaaggaactcctgcgggcttttttgaaggcccgctacaggccagccgagcggttcgagcgccgccttgccaaggtggcggcgctggaagacgaaagctcccggacggctcatggaacaacccgccgagaggagtga

SEQ ID NO: 3946 - DNA, 441 bp, Syntrophobacter fumaroxidans MPOB
atgaagataatggtgggatgcgatcacggcggtttcgaattgaaggagaagatcgtcgcgcaccttgggactctcggtcacgaggtggtggacgccggaacgaacagcctcgaatcggtggattacccccactatgcaatgaaagtggcccgggcggtcgccaggggtgaggccgaccgcgggattctggtctgcgggagcggcatcggcatgaacatgaccgcgaatcgcgtctccggcatccgggcggtcctggcgtacgagccatacggggccatcatgagccggcgtcacaacgacagcaacgttctgtgcatgggaggccggttcacgggattggacatggccttgcagattgtggacgtctggcttcgggagcccttcgagggcggacgccatcagcggcggatcgagctgatcgaccgcctggtcgatgcctga

SEQ ID NO: 3947 - DNA, 426 bp, unknown
  delta proteobacterium MLMS-1
atgaaagtggccctgggttgtgatcatggcggtttcgccctcaaggagacggtggcccagcgcttgcgggcggcctcctgcgagattgaggattgcggggtgatggaggcgacggccgtcgattatcccgatattgccagccggctctgtcgtctggtggccgatggtgtttgtcagcgggggatcctgatctgcggcaccgggattggtatgtccatggcggccaaccggtataccgccatccgggccgccctgtgccatgaacctttttccgcccggatgagccgggagcacaatgacgccaacgtcctctgcctgggcgcccgggtgatcggccccggcctggccgccgccatcgtcgatgcctggctggccggcgagtttgccggggggcgtcatctgcaacgtatcaccatgttttcgtag

SEQ ID NO: 3948 - DNA, 426 bp, unknown
  delta proteobacterium MLMS-1
atgaaagtggccctgggttgtgatcatggcggtttcgccctcaaggagacggtggcccagcgcttgcgagcggcctcctgcgagatcgaggattgcggggtgatggaggcgacggccgtcgattatcccgatattgccagccggctctgtcgtctggtggccgatggtgtttgtcagcgggggatcctgatctgcggcaccgggattggtatgtccatggcggccaaccggtataccgccatccgggccgccctgtgccatgaacctttttccgcccggatgagccgggagcacaatgacgccaacgtcctctgcctgggcgcccgggtgatcggccccggcctggccgccgccattgtcgatgtctggctggccggcgagtttgccggggggcgtcatctgcaacgtatcaccatgttttcgtag

SEQ ID NO: 3949 - DNA, 456 bp, Arcobacter butzleri
atgaaatattttataggtgcagatcatgcaggaattgagattaaagcttttgtaaaagatttatttgagcaaagaggacatcaagtagaagatttaggaccatttaataaagatagagttgattatccagattatgcatcaaaagtatgtaaaaaagttcttgaaaatgaaggaactatgggaattctaatttgcggttcaggtttgggaatgagtatggctgcaaataaatttgatgggataagagcagcactttgccacaatgaatatagtgcaagaatggctagaaaacacaatgatgcaaatgttatttgcttaggtgaaagagtaagtggcgaaggtatgattgaagctattataaaagcttgggataaagcagaatttgaaggtggaagacacgaaggtcgagttgctaaaataaatgctttaggaaaaatgggaagttgtagagcataa

SEQ ID NO: 3950 - DNA, 438 bp, Campylobacter coli
atgcttagagaaaaaatttatattgccagtgatcacgcaggttttctacttaaagaaaaaatttgcgccttccttgaagaaaaacaaattccttttgatgatcttggaacaaaagatcctacaagttgtgattatccagattatgcacatttgttagcttctaaaatagatgaacaaagctttggaattttaatttgtggttcagggataggaatttccatcgctgctaatcgtcataaaaacattcgctgtgccttatgtaatgaaagccttagtgctaaacttgctagaaaacacaatgatgcaaatgttttagcttttggaggtagattaataggcattgatgcagctatcgatatgatagaaaattttattcaaaccccttttgatcaaggtagacatgtaaaaagaattcaaaaaattgaggtagattgttaa

SEQ ID NO: 3951 - DNA, 444 bp, Campylobacter concisus
atgaagatagataaagttttcttagctagcgatcacgctggttttgagctaaaaaacgagcttaaagaggctattaaagggcttggatacgaagtggttgatcttggtacaaacgataaaaatagcgttgattaccctgattatgcgcatttgttagcgagcaaacttgagcctaactgctacggcgtgctagtttgtggcacaggcataggcatctcaatagctgcaaataggcatgaaaacgtaaggtgtgccctttgtcacgacgaatttaccgctagacttgcaagagagcacaacgatgcaaatgtcatcgcttttggcgcaagggttatcggtgcaggcgttgctatctcggcggctgaagcctttttaaagactgagtttgcaggtggcagacacgaaagacgcgtgcaaaaaattgaacttaaggcaggcaaatga

SEQ ID NO: 3952 - DNA, 450 bp, Campylobacter curvus
atggatatagaaaaaatcttcatcgcgagcgatcatgcaggttttgagctaaaaaacgagctaaaaacgatcctctcaaatttaggacacgaagtcatcgatctgggaactaatgatggcaaaacgagcgtcgattatcctgattttgcacattcgatggctaaaaatttagcttctaaatgttacggagtgctgatatgcggcaccggcatcggtatcagcatcgctgcaaacagacaccaaaatatccgctgcgccctttgtcacgacgaatttaccgctcgtctagcaagagaacataacgacgcaaatgtgatagcctttggcgccagagtcatcggtgctggcgtggctggcgaaatgctaaaggtattttttagcacggaatttcagggtggcagacatgagcgcagagtcggtaagatcgagccaaataaggaaatttcatga

SEQ ID NO: 3953 - DNA, 447 bp, Campylobacter fetus
atgaaagttgctcagatttttatagcaagtgatcacgctggatttgatactaaggagtttgtaaaaagttatttatcaaatttcgagtttgatgtggttgatcttggagcatattctaaagatatgagcgtagattatcctgattttgccgataaaatggctgaaaatataaataacgattttaaatttggtattttaatatgcggaacaggaataggcatatccatagccgcaaatcgccatcctcatataagatgcgctctttgccatgatgctactactgcaaaattagctcgtgagcataatgatgcaaatgtactttgctttggcggcagaatagtcggaactagtatcattcaagatatggtaaaagtattttttactactgagtttgccggtggtagacatgaaaaaagagtttataaattaggaaactacaaatgctag

SEQ ID NO: 3954 - DNA, 447 bp, Campylobacter hominis ATCC BAA-381
atgcaaatagaaaaaatttttatagcaagcgatcacgcgggatttgatgcaaagcaaatcgccaaaaaaacattaaatcaaatgaattttgaagttatagatttaggcacgaacgattcgcaaaaaagcgttgattatcctgattttgcttatgctttgagtaaagaaatcgcaaaggatgaaaaaaattatggaattttgatttgcggaaccggaattggaatcagcatagctgcaaacagaaatccaaaaattcgctgcgcactttgtcacgatgcacttactgcaaaacttgcaagagaacacaatgacgcaaatattttagcttttggcggcagaattttaggtagcgctgaaatagaaagcattataaaaatattttttaatactgagtttttaggcggccgtcacgcaagaagaatagctaaactgggagaaataaaatga

SEQ ID NO: 3955 - DNA, 438 bp, Campylobacter jejuni
atgcttagggaaaaaatttatattgctagtgatcatgctggttttgaattaaaagaaaaaatttgcgtatttttaaaagaaaaaaatataatttttaacgatttaggaacaaacacttgcgcaagctgcgattatcctgattatgcgcatttacttgccgaaaaaataaacaaacggagctttggcattcttatttgtggaagtggaattggaatttctattgcagcaaatcgtcataaaaacattcgttgtgcattatgccacgaaagcttaagtgcagaacttgcaagaaggcataatgatgccaatgttttggcattaggcggaagattaattggggttgaattagctatagatattatagaaaaattcattcaaactccttttgaagaagggagacatatgcaaagaattcaaaaaattgaggtaaaaatataa

SEQ ID NO: 3956 - DNA, 438 bp, Campylobacter jejuni
atgcttagggaaaaaatttatattgctagtgatcatgctggttttgaattaaaagaaaaaatttgcgcacttttaaaagaaaaaaatataatttttaacgatttaggaacaaatacttgcgcaagctgcgattatcctgattatgcacatttgcttgccgaaaaaatagatgaacgaagctttggcattcttatttgtggaagtggaattggaatttctattgcagcaaatcgtcataaaaacattcgttgtgcattatgccatgaaagcttaagtgcagaacttgcaagaagacataatgatgccaatgttttagcattaggcggaagattaatcgggattgaattagctatagatattatagaaaaattcattcaaactccttttgaaggagggagacatatgcaaagaattcaaaaaattgaggtaaaaatataa

SEQ ID NO: 3957 - DNA, 438 bp, Campylobacter jejuni
atgcttagggaaaaaatttatattgctagtgatcatgctggttttgaattaaaagaaaaaatttgcgtatttttaaaagaaaaaaatataatttttaacgatttaggaacaaacacttgcacaagctgcgattatcctgattatgcacatttacttgccgaaaaaatagacgaacgaagctttggcattcttatttgtggaagtggaattggaatttctattgcagcaaatcgtcataaaaacattcgttgtgcattatgccatgaaagcttaagtgcagaacttgcaagaaggcataatgatgccaatgttttggcattaggcggaagattaatcggggttgaattagctatagatattatagaaaaattcattcaaactccttttgaagaagggagacatatgcaaagaattcaaaaaattgaggtaaaaatataa

SEQ ID NO: 3958 - DNA, 438 bp, Campylobacter jejuni
atgcttagggaaaaaatttatattgctagtgatcatgctggttttgaattaaaagaaaaaatttgcgtatttttaaaagaaaaaaatataatttttaacgatttaggaacaaacacttgcgcaagctgcgattatcctgattatgcacatttacttgccgaaaaaatagacgaacgaagctttggcattcttatttgtggaagtggaattggaatttctattgcagcaaatcgtcataaaaacattcgttgtgcattatgtcatgaaagcttaagtgcagaacttgcaagaaggcataatgatgccaatgttttggcattaggcggaagattaatcggggttgaattagctatagatattatagaaaaattcattcaaactccttttgaagaagggagacatatgcaaagaattcaaaaaattgaggtaaaaatataa

SEQ ID NO: 3959 - DNA, 438 bp, Campylobacter lari
atgttaagagaaaaaatttacatagcaagcgatcatgctggctttattttaaaacaagaaattatcaattttttacaagaaaaaaatataagctttgaagatttaggtccttttagtaatgatcgttgtgattatcctgattatgcacatctactaagctctaaaattaatgaaaccagttttggaattttagtttgtggatcaggtattggtatgagtatagcagcaaatcgccatacaaacatacgctgtgctttatgtaatgaacccttaagcgctaaactctcaagagagcataacgatgcaaatgttttagccttaggatctagactaaccggaatagatatggcttttgaaattataaataatttcatcaatacttcctttagtggtggaagacattgcgcgcgaattagtaaaatagaggcaaaactatga

SEQ ID NO: 3960 - DNA, 441 bp, Campylobacter rectus
atgaaaatagacaaaatttttatcgcgagcgaccacgcgggctttgatcttaaggcgcaaatttgcgagcttttaaaaaacgaaggttttagtgtatgcgacttaggaacgcatagcaaagatagcgtcgattatcccgattttgccgcacttctggcgcaaaatttacggcacgagaacgaatacggcgtgctaatctgcggcacgggtatcggcatcagtatcgcggctaatcgccatacgcacgttcgctgcgcgctttgtcacgacgtcaccacggcaaagctcgcacgcgagcataacgacgcaaacgtgctagccatgggcgctagaacgatcggcgacgcggtcgcggcagatacgataaaagccttttttgctaccgaatttgctggcggcagacacgaaagacgcgtgaaaaagctaggaggcgagaaatga

SEQ ID NO: 3961 - DNA, 441 bp, Campylobacter showae
atgaaaatagacaaaatttttatcgctagcgaccacgcgggctttgatcttaaggcgcaaatttgcaggcttttaaaaaacgaaggttttgacgtatgcgatctaggaacgcatagcaaagatagcgttgattatccagattttgccgagcttatggcacaaaatttacgcggcgataacgaatacggcgtgctaatctgcggtacgggtatcggcatcagtatcgcggccaaccgccattcgcacgttcgttgcgcgctttgtcacgacgtcaccacggcaaaactagcgcgcgagcataacgacgcaaacgtactagccatgggcgctagaacgatcggcgacgcggtcgcggcagatatgataaaggcctttttcgctaccgaatttgccggcggcagacacgaaaggcgcgtgaaaaaactaggaggcgagaaatga

SEQ ID NO: 3962 - DNA, 435 bp, Campylobacter upsaliensis
atgctaagagaacgcctttatatagcaagtgatcacgcgggatatgagcttaaaactaaactttgtgccttttttaaagaggtgcaaattcctttcatcgatcttgggacaaacgatgaaaaaagttgcgactattcggattttgcccatttacttactagtaaaatcgatgaaaaaagttttggaattttaatttgtggttctggcataggaatttccatagcagcaaataggcacaaaaatataagatgtgctttgtgtaacgagagcttaagtgcgagattagccagaaagcataatgatgcgaatgttttggcttttggagggcgtcttgtagggtttgatttagctgtggatatgattgaaaattttatcaaaacaccttttgatgaaggaagacatatgaaaagaattcaaaaaattgaggtagattga

SEQ ID NO: 3963 - DNA, 429 bp, Sulfurospirillum deleyianum DSM 6946
ttgaagttttttatcgcaacagatcacgcaggggttgccattaaaccagatgttactgctatgctccaaaaacttggtcatgatgttattgatttaggaccttttaatgatgagagggtggactaccccgattttgcacacagactgtgtcttgaggttttaaaccatgagggtacacagggtattttgatttgtggctcagggattggcatgagcttgagtgccaacaaacatgtggggattcgagcggctttgtgtcatgatgcgtacaccgcacagatggcacgggcgcacaatgatgccaatgtactctgttttggacaacgtattgtaggactgggtgtcgttgaatctatcctagatgcatggtgcaaaacctcttttgaaggtggcagacatgcacagagagtctcgaaaatagagctgtaa

SEQ ID NO: 3964 - DNA, 462 bp, Helicobacter acinonychis str. Sheeba
atgaataagcctttgaatattgctcaagttttcataggaagcgatcatgcagggttgcatcttgcagagtttgtccaacattttttagaagataagcaatttaagattcaagcttttttacccactgctagagtggattaccctgattatgcgaaactagtgtgccaaaaagtcctagaaaatgcacaaagctatggtattttagtgtgcgccacagggataggcatgagcatgggtgctaatcgttttaaggggattagagccgctttatgccttgatgcctacatggctaaaatgactcgcttgcacaataacgctaatgtcttgtgcttgggcgaaaagattagcggcatcggcgtagtggaaagcattttggaagcgtttttctctactgaatttgaacaagaccgccatgtgttgcgtatccaaaagctagacgaatcgctgaaatcatcaacctaa

SEQ ID NO: 3965 - DNA, 438 bp, Helicobacter bilis
atgttattcatagcaagtgatcatgcaggactaaagataaagcaagtggcgacaaagtattgtaaagaacacaacattgcttttaaggacttaggcgtgcatgtcagtgatagtgtggattatcccgatatggcagaggctgtgtgtcaggaaatgctaaaagatattgaaaatagtcgcgggatactcatttgtggtagtggaattggaatgagtattgctgctaataggcatagagctatccgtgctgccctatgttttgatccctatatggctgctgtcgcaagaaagcataataacgcaaatgtgttatgtttgggggaaagggtgattggagctggagttgctgaagctgttatagaagtgtttttaaacgagacttttgagggcggcagacatgcaataagagtggaaaaactcacaaatacaaaggattaa

SEQ ID NO: 3966 - DNA, 426 bp, Helicobacter canadensis MIT 98-5491
atgaagttttttatcgctagtgatcacgcaggatttgaactcaaagaatcccttattcaaatcttagaaaaaatgggatatgaagttaccaatcttggacctgtcaataatgatcgtgtggattatcctgattttgccaatctactttgccaagaggttttagccactccccaaagtcttgggattttaatatgtggcagtggaattggaatgagtattgctgctaatagacataaagggattcgtgctgcactttgtaatgaaccctatggagcaacaatggctagagcacataacgatgccaatgtgctttgtttgggagctagagtagttggattaggcatggcagagtgcatcttacaaagcttcatcaaaggagaatttgaaggtggtaggcacacccaaagagtagagaaattacaataa

SEQ ID NO: 3967 - DNA, 453 bp, Helicobacter cinaedi
atgagagaaaacaaaaaacaaacctatgtgataggcacagaccacgctggagcgaatctaaaagattttgtgatgacttttttgcgagaaaaaggctttagcgtgattgacttagccccgcaagatacacaaagggtggattaccccgattatgctaaaaaagtatgcgatgttttaaaagaaaatccgcagtataaggggatcttaatctgtggaagtggaattggaatgagcattgctgctaatcgctacaagcatatccgtgcagcattatgccacgatgcgtatatggcaaaaatggcaaggttacataatgatgctaatgtcttgtgtatgggtgagcgtatcagtggcgtgggcgaagtggagtcaattcttgaagcatttgtggattttgaatttgagggtgggcgacacgcacagagggttgagaagctaggggatatggagtag

SEQ ID NO: 3968 - DNA, 444 bp, Helicobacter hepaticus
atgacttatgttatagggacagaccacgcaggatttaagctcaaggaatttactatttcatttttgcagaaaaaaggttttgaaatcatagatttagcacctcaaactaatcaaagagtagattatcctgattacgcaaaaaaagtatgcgaggcagtgggtgaagaagtaaatcgcagaggcattttgatatgtggaagcggaattggaatgagcattgctgctaatcgttttaagcatattcgcgctgcactttgtgtagatgcttatatggcaaaaatggcacgtgcccataatgacgcaaatgtgctctgtatgggagagcgcattagtggcttaggtgaggtggagtcaatccttgaagcctttgtaagcagcgaatttgagggtgagcggcatcttgtgcgtgtggaaaagctagggaatctaggacagattctataa

SEQ ID NO: 3969 - DNA, 426 bp, Helicobacter pullorum
atgaaaatttttgttgcaagtgatcatgcgggttttgagcttaaagagagtgtggcagagattttgaaatcaatggggcatcaagtggttaatttggggccttatgataataatcgcgtggattatcctgattttgctaatttgctttgtggtgaagttttgaaagaagaggggagcttgggagttttggtttgtggaagcgggattggaatgagtattgctgctaatcgccacaaagggattcgagctgcactttgtaatgagccttatggggcaatgatggcaagggcgcacaatgatgctaatgtgctttgtcttggggctagggtgattggcattggaatggcagaaataattttgcaaagttttatttcagggaagtttgaaggtggaaggcacgctattagagtagaaaagttacaataa

SEQ ID NO: 3970 - DNA, 456 bp, Helicobacter pylori
atgaataagctcttaaagttttctcaagtttttataggcagcgatcatgcagggttgcatcttgcagagtttgtccagcgttttttagaagacaaggattttaagatccaagcttttttacccaccatgagagtggattaccctgattacgccaaattagtgtgccaaaaggtcttagaaaatgcgcaaagctatggcattttagtgtgcgccacagggataggcatgagcatgggcgctaatcgctttaagggtattagagccgctttgtgccttgatgcttacatggctaaaatgactcgcttgcacaataacgctaatgttttgtgtttgggcgaaaagattagcggcattggcgtggtggaaagcattttagaagcgtttttctctacagaatttgaacaaggccgtcatgtgttgcgcatccaaaaactagatgaatcgctgaaatcataa

SEQ ID NO: 3971 - DNA, 456 bp, Helicobacter pylori
atgaataagcccttaaagccttctcaaatttttataggaagcgatcatgcagggttgcatcttgcagagtttgtccaacattttttaaaagacaaagattttaagatccaagcttttttacccactatgagagtggattaccctgattacgcaaaattagtgtgccaaaaggtcctagaaaacccgcaaagctatggtattttagtgtgcgctacagggataggcatgagcattggcgctaatcgttttaagggtattagagccgctttatgccttgatgcttacatggctaaaatgactcgcttgcacaataacgctaatgtcttgtgtttgggcgaaaagattagcggtattggcgtggtgggaagcattttagaagcgtttttctctacagaatttgaacaaggccgccatgtgttgcgcatccaaaaactagatgaatcgctgaaatcataa

SEQ ID NO: 3972 - DNA, 456 bp, Helicobacter pylori
atgaataagcccttaaagccttctcaagtttttataggaagcgatcatgcagggttgcatcttgcagagtttgtccaacattttttagaagacaagggttttaagatccaaacttttttacctaccatgagagtggattaccctgattacgccaaattagtgtgccaaaaggtcctagaaaacccgcaaagctatggtattttagtgtgtgctacagggataggcatgagcatgggcgctaatcgttttaagggtattagagccgctttgtgccttgatgcttacatggctaaaatgactcgcttgcacaataacgctaatgtcttgtgtttgggcgaaaagattagcggtattggcgtggtggaaagcattttagaagcgtttttctctacagaatttgaacaaggccgccatgtgttgcgcatccaaaaactagatgaatcgctgaaatcataa

SEQ ID NO: 3973 - DNA, 462 bp, Helicobacter pylori
atgaataagcccttaaagccttctcaaatttttatagggagcgatcatgcagggttgcatcttgcagagtttgtccaacattttttagaagacaaagattttaagatccaagcttttttgcccactatgagagtggattaccctgattatgctaaattagtgtgccaaaaggtcctagaaaacccgcaaagctatggtattttagtgtgcgctacagggataggtatgagcatgggcgctaatcgttttaagggtattagagccgctttgtgccttgatgcttacatggccaaaatgactcgcttgcacaataacgctaatgtcttgtgtttgggcgaaaagattagcggtattggcgtggtgggaagcattttagaagcgtttttctctacagaatttgaacaaggccgccatgtgttacgcatccaaaaactagatgaatcgctgaaatcatcaacctaa

SEQ ID NO: 3974 - DNA, 456 bp, Helicobacter pylori
atgaataagcctttgaatattgctcaagtttttataggaagcgatcatgcagggttgcatcttgcagaatttgttaaacattttttagaagacaagcgttttaaagtccaagcttttttacccactatgagggtggattaccctgattacgccaaattagtgtgccaaaaggtcttagaaaatccgcaaagctatggcattttagtgtgcgctacagggataggcatgagcatgggtgctaatcgctttaagggtattagagccgccttgtgccttgatgcctacatggccaaaatgactcgcttgcacaataacgctaatgtcttgtgcttgggcgaaaagattagcggtatcggcgtagcagaaagcattttagaagcgtttttctctacagaatttgaacaaggccgccatgtgttgcgcatccaaaagctagatgaatcgctgaaatcatag

SEQ ID NO: 3975 - DNA, 450 bp, Helicobacter pylori
atgaataagcctttgaatattgctcaagtttttataggcagcgatcatgcagggttgcatcttgcagaatttgttaaacattttttagaagacaagcattttaaaatccaagcttttttacccactatgagagtggattaccctgattacgccaaattagtgtgccaaaaggtcttagaaaatccgcaaagctatggtattttggtgtgtgctacagggataggcatgagcatgggcgctaatcgctttaagggtattagagccgctttgtgccttgatgcttacatggccaaaatgactcgcttgcacaataacgctaatgtcttgtgcttgggtgaaaagattagcggtattggcgtagcagaaagcattttagaagcgtttttctctacagaatttgaacaaggccgtcatgtgttgcgcatccaaaaactagatgaaactagatga

SEQ ID NO: 3976 - DNA, 462 bp, Helicobacter pylori
atgaataagcctttgaatattgctcaagtttttataggaagcgatcatgcagggttgcatcttgcagaatttgttaaacattttttagaagacaagcgttttaagatccaagcttttttacccactatgagggtggattaccctgattacgccaaattagtgtgccaaaaggtcttagaaaatccgcaaagctatggcattttagtgtgcgccacagggataggcatgagcatgggtgctaatcgctttaagggtattagagccgctttgtgccttgatgcttacatggccaaaatgactcgcttgcacaataacgctaatgtcttgtgcttgggcgaaaagattagcggtattggcgtaacagaaagcattttagaagcgtttttctctacagaatttgaacaaggccgtcatgtgttgcgcatccaaaagctagatgaatcgctgaaatcatcaacctaa

SEQ ID NO: 3977 - DNA, 462 bp, Helicobacter pylori
atgaataagcctttgaatattgctcaagtttttataggaagcgatcatgcagggttgcatcttgcagaatttgttaaacattttttagaagacaaggattttaaaatccaagcttttttacccactatgagggtggattaccctgattacgccaaattagtgtgccaaaaggtcttagaaaatccgcaaagctatggcattttagtgtgcgccacagggataggcatgagcatgggcgctaatcgctttaagggtattagagccgctttgtgccttgatgcttacatggctaaaatgactcgcttgcacaataacgctaatgtcttgtgcttgggtgaaaagattagcggtattggcgtaacagaaagcattttagaagcgtttttctctacagaatttgaacaaggccgccatgtgttgcgtatccaaaagctagatgaattgctgaaatcatcaacctaa

SEQ ID NO: 3978 - DNA, 456 bp, Helicobacter pylori
atgaataagcccttaaaattttctcaagtttttataggcagcgatcatgcaggggtgcatcttgcagagtttgttcaacattttttagaagacaaggattttaagatccaagcttttttacccaccatgagagtggattaccctgattacgccaaattagtgtgccaaaaggtcttagaaaatgcgcaaagctatggtattttagtgtgtgctacagggataggcatgagcatgggcgctaatcgctttaagggtattagggccgctttgtgccttgatgcctacatggctaaaatgactcgcttgcacaataacgctaatgtcttgtgcttgggtgaaaagattagcggtattggcgtggtggaaagcattttagaagcgtttttctctacagaatttgaacaaggccgtcatgtgttgcgcatccaaaagctagatgaatcgctgaaatcataa

SEQ ID NO: 3979 - DNA, 456 bp, Helicobacter pylori
atgaataagcccttaaataccgctcaagtttttataggaagcgatcatgcagggttacatcttgcagaatttgttaaacattttttagaagacaagcgttttaagatccaagctttcttacccactacaagggtggattaccctgattacgccaaattagtgtgccaaaaggttttagaaaatgcacaaagctatggtattttggtgtgcgccacagggataggcatgagcatgggcgctaatcgctttaaaggtattagagccgctttgtgccttgatgcttacatggctaaaatgactcgcttgcacaataacgccaatgtcttgtgcttgggcgaaaagattagcggtatcggcgtagcagaaagcattttggaagcgtttttctctacagaatttgaacaaggccgtcatgtgttgcgtatccaaaagctagatgaatcgctgaaatcatag

SEQ ID NO: 3980 - DNA, 456 bp, Helicobacter pylori
atgaataagcctttgaatattgctcaagtttttataggaagcgatcatgcagggttgcatcttgcagaatttgttaaacattttttagaagacaagcgttttaaagtccaagcttttttacccactatgagggtggattaccctgattacgccaaattagtgtgccaaaaggtcttagaaaatgcacaaagctatggcattttagtgtgcgctacagggataggcatgagcatgggcgctaatcgctttaagggtattagagccgctttgtgtcttgatgcttacatggccaaaatgactcgcttgcacaataacgctaatgtcttgtgcttgggcgaaaagattagcggtattggcgtaacagaaagcattttagaagcgtttttctctacagaatttgaacaaggccgtcatgcgttgcgcatccaaaaactagatgaatcgctgaaatcataa

SEQ ID NO: 3981 - DNA, 456 bp, Helicobacter pylori
atgaataagcccttaaagccttctcaaatttttataggaagcgatcatgcagggttgcatcttgcaaagtttgtccaacattttttagaagacaaggattttaagatccaagcttttttacccgctatgagagtggattaccctgattacgcaaaattagtgtgccaaagggttctagaaaatgcgcaaagctatggcattttagtgtgcgctacagggataggcatgagcatgggcgctaatcgttttaagggtattagagccgctttgtgccttgatgcttacatggctaaaatgactcgcttgcacaataacgctaatgtcttgtgtttgggcgaaaagattagcggtattggcgtggtggaaagcattttagaagcgtttttctctacagaatttgaacaaggccgtcatgtgttgcgcatccaaaaactagatgaatcgctgaaatcataa

SEQ ID NO: 3982 - DNA, 426 bp, Helicobacter winghamensis ATCC BAA-430
atgcaattttttatagcaagtgatcatgcaggatttatgttaaaaggttctattcttgggattttagaacaaatgggacatagagttgtggatttaggacccttagatgcagaacgcgtggattacccagattttgcaaatactttatgtgaaaaagttttggataatgaaggaagttttggaattttaatttgcggaagtggaattggaatgagtattgctgcaaataggcataaaggtatccgtgctgctttatgtgcagaaccttatagcgcagcgatgagtcgtgcccacaatgatgccaatgtgctatgtcttggtgcgcgtattgttggaatcggaatggtagagagtattctaaaaagcttctgcgaaggggtttttgaaggtggtcgccactcttgtcgcataggaaaattacaataa

SEQ ID NO: 3983 - DNA, 438 bp, Sulfurimonas denitrificans DSM 1251
atgaaattttatatcgcaacagatcatgctggattagacctcaaagattatacagttgagttattaaaagataaaggtcatgaggttgtagatcttggaccattttgtaaagatagagtcgattatcctgattatgctactaaagtgtgtgaagctgttttaaaagacaactcagcatttggaattttaatatgtggttcaggaatcggtatgagcatggctgcaaatcgctactctaacatacgcgcagcactttgtcatgacgcatataccgcttcagttgcacgtgggcataatgatgcaaatgttctttgctttggtgagagaattataggaaaaggtgtagccgagtctattatagatgcttggattgctgggagctttgagggcggtcgtcatgagcaacgagttgcgaaaatagaagcgataaatacttaa

SEQ ID NO: 3984 - DNA, 432 bp, Wolinella succinogenes
ttgacctacttcatcgccactgatcacgctggattctccattaaagatcatgtcaaagagttcatccgccaaaaaggccacgaggtgatcgacctaggacctgcgagcgccgatagagttgactatcctgactacgcccacgagctctgccaaaaggttttagagaacagagagagcgcagggatcttaatctgtgggacagggattggcatgagtatcaccgccaaccgccacaaaggaatccgtgccgccttgtgtcatgatgcctacaccgccaccctcacccgaatgcacaatgacgccaatgtcctctgcatgggagagcgtgtggtcgggctgggcgtggtcgattcgattctagaggcttttcttagcaccccgtttgaggggggtcgtcacgcctgccgcatcggcaaaatcgaacaagagtag

SEQ ID NO: 3985 - DNA, 438 bp, Campylobacterales bacterium GD 1
ttgaagttttacatcgctacagaccatgcgggaattgatttaaaagactatacagtcgaactactaaaagaaaagggacatgaggttattgaccttggtcctttttcaaaggatagagttgattatccagactatgctgttaaagtatctgagtctgttctaggagatccaacttctcagggaattcttatttgtggttcaggtataggtatgagtatggcagcaaaccgtcacactggcatcagagctgcactttgtcacgatgcttacactgctatggtagctcgtggtcacaatgacgctaacatcttatgttttggtgagagaatcgtgggtaaaggtgtagctgagtctatactagattcttggatagcttctagttttgatggtggaagacactgcggtcgtgttgataaaatcgaagcgataaacgcttag

SEQ ID NO: 3986 - DNA, 429 bp, Caminibacter mediatlanticus TB-2
atgaaatattttattggcactgaccatgctggatttgaagttaaagattttgtgattgattatttacaaaaaaaaggaatagaagtagaagatttaggatgctattcaactgaaagtgtcgattatccagacttggctcataaagtagcaaatgcagtacttgaaaatgaaggaagtaaagggatacttatttgtggtagtggaattggaatgagtcttgcagcaaataaacataaaggaatcagagctgctctatgtcacgattattatactgcttcgatggcaagaaagcataataatgctaatattttatgttttggtgcaagaatcgttggaaaaggtgaaattgaatctattcttgaaggatggctaaatagtgaatttgaaggtggtagacatcaaagaagggtagaaaaaattgatatttaa

SEQ ID NO: 3987 - DNA, 429 bp, Nautilia profundicola AmH
atgaagtattttatcggaaccgatcacgctggttatgaaataaaacctttcgtaatagagtatttacaaaaaaagggaatagaagtagaagatttggggacttattctacggacagtgtcgattatcccgattatgctcataaagtagctgaagcagtattggcaaaccctggaacaatgggaatattgatttgcggtagcggaattggaatgagtcttgctgctaataagcataaaggtatccgtgcagctctttgtcatgatcactatacggcaaaaatggcaagactgcacaataatgcgaatattttatgtttcggtgcgagaatagtgggtcttggagtggttgaatcaatacttgacgcatggcttgatacggagtttgaaggcggaagacaccaaagaagggtagaaaaaattgatatttaa

SEQ ID NO: 3988 - DNA, 441 bp, Nitratiruptor sp. SB155-2
atgaaaaaagtatatatcggatgtgaccatgcagggttcgctatcaaaggtttggtgatcaagcttttgcaaaaaagaggatacgaagtggaagaccttggaacctatagcagtgaacgagtcgattatccagactatgccgaaaaagtagcaagagcagtggctgccgacaaagagagctttggcgtactcatttgcggtactgggatcggtatgagtattgcagcaaacaaaataaaagggatacgagcagccgaagtgcacgactactacacagcacaaatggcacgagcacacaatgatgcaaatatcgtatgctttggagagcgagtcgttggaccgggcgttgtggaatctattattgatgcatggtgcaatacagagtttgaaggtggacgacacgaaaacagagtcaaaaaaatcatggctttggaagaataa

SEQ ID NO: 3989 - DNA, 462 bp, Sulfurovum sp. NBC37-1
atgtcaaagaaattttacattgcaacagaccatgcaggttatgctgtcaaagcctacgtcaaagaactcgtcacaaacctcggccacgagatcatcgaccttggaccggactcagccgacagagtcgactacccagacttcgcaaagaagtgtacggaagccgtcattgcaaacccgggaagtttcggtatcctcatctgcggtacgggcatcggtatgtccatagctgccaacaaagtatcaggtatcagagctgctctctgccacgaccactacactgcacaattgacaagacagcacaatgacgccaacgtactctgcttcggtgaacgcgtagtcggtaaaggcgtcatcgaagacatcatagatgctttcgcctccacggaattcgaaggcggacgtcacgctacaagaataggcaaaatcgaagccggatgcagcttcggtgctgatctggggtag

SEQ ID NO: 3990 - DNA, 459 bp, Tolumonas auensis
atgaatacaattgctattggtgcagatgatgctgccttcgacttcagaaataaaatcattgaatatttaaaagaaaaaaacattccatttattgattacagcagtgataaagcaccagaaaacaaattataccctgatgttgcccataatgttgcttctgctataaaagacggaaaacatgaacgtgggatcttgatttgcggaacaggtattggcatgagcattgttgctaataaggtaccaggcatcagagcggcacagtgtcatgatcccttttctgcagaaagagccagaaaaagcaataacgcacaaatcatttcatttggcgcccgggttattggcactgagctcgcaaaaaatatattaaaaacctggtttgaatctgaatatgaaggtggaaattcagcacctaaagtagatcgcatcaattactaccaagagttctattctcataaataa

SEQ ID NO: 3991 - DNA, 468 bp, Tolumonas auensis
atgaaaattgcatttggaagtgaccatgtaggctatgaaatgaaatgtgaaatcatggcctatttagcagaaaaaggtatcgaatgtaccgactttggaccttacacaacggatcgcgttgattatcctgattatgctttagctgtagctaatgctgtgaatcaaggtgcattcgagaaagggattttgatttgcggcactggtgtaggaatttcaattgcagcaaataaagttaatggtattcgtgcggtagtgtgcagcgagccatactcagctcagctttcgagacaacataacaatacgaatgtactcgcatttggagcaagagttgtaggcattgagctagccaagatgatagttgactgttggttggcgggacaatatgaaggcgatcgtcatcaaatccgtgtcaataagattgctgaaatagaaaaacttcaagatgtagcagaaggtgcttgttcatga

SEQ ID NO: 3992 - DNA, 456 bp, Citrobacter koseri ATCC BAA-895
atgagtatgaaaaagatagcatttggctgtgatcacgttggttttatcctgaaacaggatattttgacgcacttaacccagcgcggtattacggtgattgataagggaacctggtcgccggagcgcacggattacccgcattatgccagcgaggtggcacaagccgttgtctctggcgaggttgatggcggtattctggtgtgtggcactggtgtggggatttcgataacggcaaacaagtttgccggagtccgcgccgtcgtttgcagcgaaccctattcggcacagctttcgcgccagcataatgataccaacgtgctggcttttggctcgcgggttgttgggctggagctggcaaaaatgatcgtggatgcctggctggatgcggggtttgaaggggggcgccatcaaaagcgcgtggaggcgattatggcgatagaacagcagggcaaatga

SEQ ID NO: 3993 - DNA, 459 bp, Dickeya dadantii Ech703
atgaaaccaatcgccattggtgcggatgacgctgcgtatgaattacgcagtaccattacgaattatctcgattcgctcaatattccctgggtggatttcagcagcgataaaaatgcggataaccgttattacccggatgtggcgcacgccgtcgccatgtcgattaaagccggtcagcaggatcgcggcattttaatctgcggcaccggcattgggatgagcattgtggcgaacaaagtgccgggcattcgtgccgcgcagtgccacgatacgttctcggcggagcgggcgcggaaaagcaacaacgcgcagatcgtcacgttgggcgcccgggtgatcggcgctgaactgggcaagcagattattcgcgcctggctgaatgccgagtatgaaggcggcggctcggcggcgaaggtggaacgtatcgattactatcaaaatcaacatattgccgaatag

SEQ ID NO: 3994 - DNA, 492 bp, Edwardsiella ictaluri 93-146
atgctaccgattgccattggcgccgatgatgccgctatcacccttaaagagacgcttgtcgcctatctacaacagcgtcatattccctttactgattacacggatgcaatccgcgatagcgactaccccgatattgccgtccgggtcgctcaggcaatcagagaagcacatcatcagcgggggatcctgctatgcggtaccggcattggcatgagcattatggcgaataaggtgccggggatccgggcagcacagtgccacgatacctattccgcccagcgagcgcgtaagagcaacgatgcccacatcattacgctgggtgcccgcgtcatcggccccgaactggcgaaagcgatcgttgatgcctggctgatagccgaatttgaaggtggagggtcgacgataaaagtcgctaaaattggcaattatgagcaaatatttagtgagaaataccgcggcgagctgaggataaacgctagcacgcatcgatag

SEQ ID NO: 3995 - DNA, 450 bp, Escherichia coli
atgaaaaagattgcatttggctgtgatcatgtcggtttcattttaaaacatgaaatagtggcacatttagttgagcgtggcgttgaagtgattgataaaggaacctggtcgtcagagcgtactgattatccgcattacgccagtcacgtcgcactggccgttgctggcggagaggctgatggcgggattttgatttgtggcactggcgtcggtatttcgatagcggcgaacaagtttgccggaattcgcgcggtcgtttgtagcgaaccttattccgcgcaactttcgcggcagcataacgacaccaacgtgctggcttttggttcacgagtggttggcctcgaactggcaaaaatgattgtcgatgcgtggctgggcgcacagtacgaaggcggtcgtcatcaacaacgcgtggaggcgattacggcaatagagcagcggagaaattga

SEQ ID NO: 3996 - DNA, 450 bp, Escherichia coli
atgaaaaagattgcatttggctgtgatcatgtcggtttcattttaaaacatgaaatagtggcacatttagttgagcgtggcgttgaagtgattgataaaggaacctggtcgtcagagcgtactgattatccacattacgccagtcaagtcgcactggctgttgctggcggagaggttgatggcgggattttgatttgtggtactggcgtcggtatttcgatagcggcgaaaaagtttgccggaattcgcgcggtcgtctgtagcgaaccttattccgcgcaactttcgcggcagcataacgacaccaacgtgctggcttttggttcacgagtggttggcctcgaactggcaaaaatgattgtggatgcgtggctgggcgcacagtacgaaggcggtcgtcatcaacaacgcgtggaggcgattacggcaatagagcagtggagaaattga

SEQ ID NO: 3997 - DNA, 537 bp, Escherichia coli
atgaaaacaaagattgctatcgcaagcgatgatgtaggttttgcacgtaaagaggagataaaaaaatacctcatagaagagaaaaacatggagatcgtgtacgatcccgtcacatgtaaggaacaaggtgtcaataacttcgcgcgtctggccgacgaaatggcaggcattattcaacgcgatgagtgccgtctgggaatttacatttgtgggactggcattggctttacttgtcagatcaacaaacactggggcataagagccgttgcggttactaacccctactccgcaaagcgggcgcgactcagcaataacgcacaagttattggactgggttgccgggtcaacgatctcgaatacagcaaaatgattgtcgatgcatggttggataacccattcgacttcaccaccgccagagaaaattctaaaaagaacttactagaagctgaacgtaacgataatgcattgctggttaagcccgctgatgtacgctggaatatgggtttccgaccagatgatgaaaaatctgagggttaa

SEQ ID NO: 3998 - DNA, 450 bp, Escherichia coli
atgaaaaagattgcatttggctgtgatcatgtcggtttcattttaaaacatgaaatagtggcacatttagttgagcgtggcgttgaagtgattgataaaggaacctggtcgtcagagcgtactgattatccgcattacgccagtcaagtcgcactggccgttgctggcggagaggctgatggcgggattttgatttgtggcactggcgtcggtatttcgatagcggcgaacaagtttgccggaattcgcgcggtcgtttgtagcgaaccttattccgcgcaactttcgcggcagcataacgataccaacgtgctggcttttggttcacgagtggttggcctcgaactggcaaaaatgattgtcgatgcgtggctgggcgcacagtacgaaggcggtcgtcatcaacaacgcgtggaggcgattacggcaatagagcagcaaaggaattga

SEQ ID NO: 3999 - DNA, 450 bp, Escherichia coli
atgaaaaagattgcatttggctgtgatcatgtcggtttcattttaaaacatgaaatagtggcacatttagttgagcgtgacgttgaagtgattgataaaggaacctggtcgtcagagcgtactgattatccgcattacgccagccaagtcgcactggccgttgctggcggagaggctgatggcgggattttgatttgtggcactggcgtcggtatttcgatagcggcgaacaagtttgccggaattcgcgcggtcgtttgtagcgaaccttattccgcgcaactttcgcggcagcataacgacaccaacgtgctggcttttggttcacgagtggttggcctcgaactggcaaaaatgattgtcgatgcgtggctgggcgcacagtacgaaggcggtcgtcatcaacaacgcgtggaggcgattacggcaatagagcagcaaaggaattga

SEQ ID NO: 4000 - DNA, 450 bp, Escherichia coli
atgaaaaagattgcatttggctgtgatcatgtcggtttcattttaaaacatgaaatagtggcacatttagttgagcgtggcgttgaagtgattgataaaggaacctggtcgtcagagcgtactgattatccacattacgccagtcaagtcgcactggctgttgctggcggagaggttgatggcgggattttgatttgtggtactggcgtcggtatttcgatagcggcgaacaagtttgccggaattcgcgcggtcgtctgtagcgaaccttattccgcgcaactttcgcggcagcataacgacaccaacgtgctggcttttggttcacgagtggttggcctcgaactggcaaaaatgattgtggatgcgtggctgggcgcacagtacgaaggcggtcgtcatcaacaacgcgtggaggcgattacggcaatagagcagtggagaaattga

SEQ ID NO: 4001 - DNA, 450 bp, Escherichia coli
atgaaaaagattgcatttggctgtgatcatgtcggtttcattttaaaacatgaaatagtggcacatttagttgagcgtggcgttgaagtgattgataaaggaacctggtcgtcagagcgtactgattatccgcattacgccagtcaagtcgcactggccgttgctggcggagaggctgatggcgggattttgatttgtggcactggcgtcggtatttcgatagcggcgaacaagtttgccggaattcgcgcggtcgtttgtagcgaaccttattccgcgcaactttcgcggcagcataacgacaccaacgtgctggcttttggttcaagagtggttggcctcgaactggcaaaaatgattgtcgatgcgtggctgggcgcacagtacgaaggcggtcgtcatcaacaacgcgtggaggcgattacggcaatagagcagcggagaaattga

SEQ ID NO: 4002 - DNA, 450 bp, Escherichia coli
atgaaaaagattgcatttggctgtgatcatgtcggtttcattttaaaacatgaaatagtggcacatttagttgagcgtggcgttgaagtgattgataaaggaacctggtcgtcagagcgtactgattatccgcattacgccagtcaagtcgcactggtcgttgctggcggagaggctgatggcgggattttgatttgtggcactggcgtcggtatttcgatagcggcgaacaagtttgccggaattcgcgccgtcgtttgtagcgaaccttattccgcgcaactttcgcggcagcataacgataccaacgtgctggcttttggttcacgagtggttggcctcgaactggcaaaaatgattgtcgatgcgtggctgggcgcacagtacgaaggcggtcgtcatcaacaacgcgtggaggcgattacggcaatagagcagcggagaaattga

SEQ ID NO: 4003 - DNA, 450 bp, Escherichia coli
atgaaaaagattgcatttggctgtgatcatgtcggtttcattttaaaacatgaaatagtggcacatttagttgagcgtgacgttgaagtgattgataaaggaacctggtcgttagagcgtactgattatccgcattacgccagtcaagtcgcactggccgttgctggcggagaggctgatggcgggattttgatttgtggcactggcgtcggtatttcgatagcggcgaacaagtttgccggaattcgcgcggtcgtttgtagcgaaccttattccgcgcaactttcgcggcagcataacgacaccaacgtgctggcttttggttcacgagtggttggcctcgaactggcaaaaatgattgtcgatgcgtggctgggcgcacagtacgaaggcggtcgtcatcaacaacgcgtggaggcgattacggcaatagagcagcaaaggaattga

SEQ ID NO: 4004 - DNA, 459 bp, Escherichia fergusonii
atgttaacaatcgcgattggtgctgatgatgcggcaaccgagctgaaaaatctggtgaagtcccatttacagtcgaaagggatcgaagttgtcgatttcagccacgacgttgctgataactcgctcatttacccggatatcgcctttaatctggccagtgctgtcagcgatggcacttacctgcgcggcattctgctgtgcggcaccggtataggtatggcaattgtggcgaataaagtgccgggtatccgtgccgcgcaatgtcacgacacctactccgccgagcgcgcccgtaagagcaacgacgcgcaaatcatgacgatgggcgcgcgtgttatcggcccggagctggcgaagaatattgttgatgtgtggctggcttcagagttcgaaggcggacgctcagcgccgaaagttgacaagatcagctactacgagaaacagggtaaatctgcataa

SEQ ID NO: 4005 - DNA, 450 bp, Escherichia fergusonii
atgaaaaagattgccttcggctgcgatcatgtgggttttatccttaaagaggagatccttacgcatttagcccaacgcggaatcgaggtactcgataaaggtacgtggtctggtgagcgtactgattatccacgttacgccagtgcagttgctcaagcggtggtggcgggggaagcagatggcggcattttgatttgcgggactggcgtggggatctcaattactgcaaacaaatttgctggtattcgggcggttgtttgtagcgaaccgtactctgcgcagttgtcgcggcaacataacgataccaacgtgctggcatttggctcgcgagtcgtgggcctggagctggcaaagatgatcgtcgatgcctggttggatgcaaaatttgaaggtgggcgccatctggcacgggtcgaggcaataaaagcaattgaaatgcgggatgattga

SEQ ID NO: 4006 - DNA, 459 bp, Klebsiella pneumoniae
atgaaaacaatcgctattggtgcggatgatgccgcctatgcttttcgcgatactatcgtcgcttatttgaatgggctgggaataaacgtcgcggattacagcagcgataagcgccaggggagtaccgtttatccggatgttgcccatgcggtggcgatgtcgattaaacagggcgaacacgagcgcggcattctgatctgcggtaccggcattgggatgagtattgtggccaataaagtccccggggtccgtgccgcccagtgtcacgataccttctccgctgagcgagcgcgtaaaagtaacaacgcgcagattattaccctcggcgcgcgggtgattggcactgagctgggcaaaaaaattattcaggcgtggcttgagtccgaatatgaaggcggcggctccgcgcccaaagtggaacgtattgattattacgaacaccagcatgccagagattaa

SEQ ID NO: 4007 - DNA, 459 bp, Klebsiella pneumoniae
atgaaaacaatcgctattggtgcggatgatgccgcctatgcttttcgcgatgccatcgtcgcttatttgaatgggttgggaattaacgtcgcggattacagcagcgataaacgccaggggagtaccgtttatccggatgttgcccatgcggtggcgatgtcgattaaacagggcgaacacgagcgtgggatcctgatctgcggtaccggcattgggatgagtattgtggccaataaagtccccggggtccgcgccgcacagtgtcacgataccttctccgccgagcgagcgcgtaaaagtaacaacgcgcagattattacccttggcgcgcgggtgattggcgctgagctgggcaaaaaaattattcaggcgtggcttgagtccgaatatgagggcggcggatccgcgcccaaagtggaacgtattgattattacgaacaccagcatgccagagattaa

SEQ ID NO: 4008 - DNA, 459 bp, Klebsiella pneumoniae
atgaaaacaatcgctattggtgcggatgatgccgcctatgcttttcgcgattccatcgtcgcttatttgaatgggttgggaattaacgtcgcggattacagcagcgataaacgccaggggagtaccgtttatccggatgttgcccatgcggtggcgatgtcgattaaacagggcgaacacgagcgtgggatcctgatctgcggtaccggcattgggatgagtattgtggccaataaagtccccggggtccgcgccgcacagtgtcacgataccttctccgccgagcgagcgcgtaaaagtaacaacgcgcagattattacccttggcgcgcgggtgattggcgctgagctgggcaaaaaaattattcaggcgtggcttgagtccgaatatgaaggcggcggatccgcgcccaaagtggaacgtattgattattacgaacaccagcatgccagagattaa

SEQ ID NO: 4009 - DNA, 459 bp, Pantoea sp. At-9b
atgaaaaccattgccattggtgccgatgacgcggctatcgaactgaaaaacctgattaaacgttacctggaagagaaacaatacgatgtccaggactacagcaatgacgcgcagaacgatcgtccaatgtacccggatgtggcgtttgcgctggctaccgccatccagcagggtgaacacgatcgcggcattctgctgtgcggcaccggcattggggtggcgattgtggctaacaaagtggcaggcgtgcgtgcggcccagtgccatgacaccttctctgccgagcgtgcacgtaaaagtaacaacgcgcagatcatgaccatggggtcccgcgtgattggaccggaactggcaaaaaatatcgtcaatgcttggctggcatcggagtttgaagggggaggttcgaccgcgaaagtggagaagattggttattacgaacaggtgtgtcaggcgaagtaa

SEQ ID NO: 4010 - DNA, 459 bp, Pectobacterium atrosepticum SCRI1043
atgctctcgattgcaattggtgcagacagcgccgcgattgatctaaaaaacacgattactgattatttacagcagaaggggctgacggtaaccgactacagctacgatcctactggggagaatccgatctaccccgatgttgcctacacgctggcgcatgcgattaaagacggcaaacaccaacgtgggatcctgctgtgtggcaccgggatcggcatgtgtatcgtggctaacaaggtcaatggcattcgtgccgctcagtgccatgacacctattccgctcagcgggccagaaaaagtaacaatgcgcaggtcatcgcactgggtgcgcgggttatcggtcccgaactggcaaaagagattattggcgcctggctggatgccgagtttgaaggtggcggctccgcgccaaaagtcgagaaaatcggctactacgaacatcaggaaaaacaccagtaa

SEQ ID NO: 4011 - DNA, 459 bp, Pectobacterium carotovorum subsp. carotovorum PC1
atgaaaccaatcgctattggcgcagatgatgcagcctggagtttacgcgatattctcacccgctatctggactcgctcgcgattccctgggtcgactttagcagcgacaaaaatcaggacaacaccatctaccccgatgtcgcacatgcggtcgcggtgtcgattaaagcgggaacgtacgaacgtgggatcctgttgtgcggtaccggcattggtatgagtattgtggcaaataaggtgaccggcgtacgtgctgcccagtgccatgacacctattctgcccagcgagccagaaaaagtaacaacgcgcagattatcgcacttggcgcacgagtcattggccccgaactggcaaaagagattgtgagtacctggctggatgccgaatttgaaggcggcggttccacatcgaaggttgaaaagatcggctattacgagcatcaggaaagcgcccgttaa

SEQ ID NO: 4012 - DNA, 459 bp, Pectobacterium carotovorum subsp. carotovorum WPP14
atgctctcgattgcaattggtgcagacagcgccgcgattgatctaaaaaacacgattactgattatttacagcagaaggggctgacggtgaccgactacagctacgatcccaccggggaaaatccgatctatcccgatgttgcctacacgctggcgcacgcgattaaagacggtaagcaccagcgtgggatcctgctgtgcggcaccgggatcggcatgagtatcgtggctaacaaggtcaatggcattcgtgccgctcagtgccatgacacctattccgctcagcgggccagaaaaagtaacgatgcgcaggtgatcgcactaggcgctcgggttatcggccctgaattggcaaaagagattgtcggcgcctggctggatgccgagtttgaaggtggcggatcggcaccgaaagtcgagaaaatcagctactacgaacatcaagaaaatcatcggtaa

SEQ ID NO: 4013 - DNA, 459 bp, Pectobacterium wasabiae WPP163
atgaaaccaatcgctattggcgcagatgatgcggcctggagtttacgcgatacacttacccgctatctggattcgcttaatattccctgggtcgattttagcagcgataaaaatcaggataacgcaagctaccccgacgtcgcacatacggtagccatatcaattaaagaagggacgcacgaacgcgggattctactgtgcggcacgggcatcggcatgagcattgtggcgaataaagtgaccggagtacgtgcggcacagtgccatgacacctattccgcccagcgcgccagaaaaagcaacgatgcgcagatcatcacgcttggcgcgcgcgttatcgggccagaactggcgaaagagatcgtcgccgcctggctggaatcggaatttgaaggcggtggctccgcaccgaagattgaaaaaatcagttattacgaacatcaggaaaatacccgttaa

SEQ ID NO: 4014 - DNA, 477 bp, Proteus mirabilis
atggaacagaaaataattgttatgggggcagatccttcaggttatgagcttaaaaatgccgtcaaatctcatctacaagcaaaaaattacacaataaaagatattaccgaatcagggcctattggttattgtgatgttggtgataaagttggcgctattatttcagaacatcctgaatatattggttttgttttttgtggcacagggatgggagtaagtattagtgctaataaacataaaaatgtttattgcggggtttgtgagagtgttaccactgcgcgtttttgtaaagtgattaataattgcaatatgctagccatgggtggtttactgattactccctttaaagccaatatgatggtagatgcttatttatctgcaatctttacacaagggttttctgaagcgaccccagatgatttacaatgtggcttacagaccatgaaagaggttgaaaagcgcatttatactgactaa

SEQ ID NO: 4015 - DNA, 477 bp, Proteus mirabilis
atggaacagaaaataattgttatgggggcagatccttcaggttatgaacttaaaaatgccgtcaaatctcatctacaagcaaaaaattacacaataaaagatattaccgaatcaggacctattggttattgtgatgttggtgataaagttggcgctattatttcagaacatcctgaatatattggttttgttttttgtggcacagggatgggagtaagtattagtgctaataaacataaaaatgtttattgcggggtttgtgagagtgttaccactgcgcgtttttgtaaagtgattaataattgcaatatgctagccatggggggtttactgattactccctttaaagccaatatgatggtagatgcttatttatctgcaacctttacacaagggttttctgaagcgaccccagatgatttacaatgtggcttacagaccatgaaagaagttgaaaagcgcatttatactgactaa

SEQ ID NO: 4016 - DNA, 477 bp, Proteus penneri ATCC 35198
atggaaaatagaacgattattatgggtgctgatccttcaggatttgaacttaaaaatgcgattaagtcatacttgttagaaaaaaattacacaataaaagatctcacagaatcaggccctattggctattgtgatgtaggggataaagttggttcaattatttctgaacatcctgaatatattggttttgttttctgtggtacaggaatgggagtaagtattagtgcgaacaaacataaaaatgtttattgcggtgtttgtgaaagcgtgactagtgctcgtttttgtaaaattatcaataactgtaatattcttgctatgggtgggttattaattacaccatttaaagccaaaatgatggttgatgcttatttatcggcaacctttacagaaggtttttctgaagcaacaccagaagatttacaatctggcttaaattcaatgaaacaagtagaaaagaaaatttataaaaattaa

SEQ ID NO: 4017 - DNA, 453 bp, Providencia rettgeri
atgctatctattgctattggtgcagatgacgctgcatttgaaatgaaagatttgattaaggctcacttagcagaattaaacattgaagtgactgattactgcttaaatactggggttgcagatgaaatgtatcctgatgttgcccacgctgttgcaactgcaatcgtacaaggtaaacaccagcgcggtattttaatttgtggtaccggaattggtatgtccattgttgctaataaagtcacaggcattcgagcagcactgtgccatgacacatactccgctgaacgagcacaaaaaagtaatgatgcacaaattattacctttggtgcccgtgtgattggccctgaactggctaaaaccattgtcgacacatggctggcttcccattatgaagggggacggtcagcgccgaaagtggctcgaatcagtgagtatgaaaatggggaacgttag

SEQ ID NO: 4018 - DNA, 537 bp, Salmonella enterica
atgaaaacgaaaattgcaatcgcatgtgatgatgtagggtttgatcgtaaggaggagattaaaaagtaccttgaagaagagaaaaatgcagatgtcgtgtacgatcccgtaaaacgaaaagaagacggtttcaacaacttcgctcgtctggcggatgaaatggcaggtgttattcagcgggatgaatgccgcctcggtatctacatctgtggaaccggaattggctttacttgccagataaataagcactgggggatccgtgcagtcgccgtcaccaacccctactcagccaagcgagcaagactcagtaacaatgctcaggtgattggtcttggctgcagagttaatgatcttgaatacacaaaaatgatcgttgatgcctggtatgacaatgcgttcgactttgccactgcaagggaaaattccaaaaagaatctactcgaagcagaacgcagcgacaacgcattgctgacgaaacctgaagatgtgcgatggaatatgggtttcagaccagatgatgagaaatctgagggctaa

SEQ ID NO: 4019 - DNA, 456 bp, Yersinia bercovieri
atgttatctattgccatcggctgtgatgatgcggctattgatatgaaaaatcagattcttgcctttctgcaaaacaaaaacataactgttgtcgattacagttgcgaccaacaacgcgaacccaccatctaccccgatatcgccgttcaggttgctcaagccattaaggatggcaagcatgaacgcggaattttgatctgtggaaccggcattggtatgagcatcacggccaataaagtgctgggcattcgtgccgcacagtgccatgaccccttctcagcccagcgggccagaaaaagcaataatgcacagatcatctgtctgggcgcgcgggtgattggtgttgagttagccaaaaccttggtcgatacctggcttgagtgtgatttcgatggcggcagctcaactgaaaaagtggaacgcatcagctattacgagcagcgacaaaatctctga

SEQ ID NO: 4020 - DNA, 447 bp, Yersinia frederiksenii
atgaaaattgctattggttgcgatcacgtcggtattattctcaaaccggcaattacagaacatcttattgcacgcggtattactgtaattgataaaggggcgcatgaagacacccgaactgattatccgatctatggcaaagcggtggcagaagctgtcgtatcaggagaggcaaatctgggaattgtattttgtggctcaggtattggtatctcaattgccgccaataaagtaaagggtatccgcgcggttgtttgtagcgagccctattctgcgaaattatcccgcgaacacaataatactaatgtgctctctttcggatctcgagttattggttcagatctggcaaaaatgattgtggatgcatggttggatgcgaaatttgaaggtgaacgtcaccaaaaaagagtggaaatgatcgcggcaattgaggaggaacaagcatga

SEQ ID NO: 4021 - DNA, 456 bp, Yersinia intermedia
atgaaaagtatcgctctgggttgtgatcacgttggatttattctgaaagcggatattgttgctcacttacaaacgcgtggcatcaaggtgattgacaaaggttggtggtctacagaacgtacggattatccacgttatgccaatgaagttgctgaagcggtcacttctggggaagttgatggtggcgtcttgatttgtggtacgggcgtaggtatctcgattacggcaaataaacatcctggtatccgcgcggtagtgtgcagtgaaccctattcggcacagctttcccggcaacataacaatactaatgtactggcttttggttctagggtcgtagggttggaactggctaagatgattgtggatgcctggctcgatgcagaatttgaagggggacggcatcaaacacgggtagatgccataactgaggtggaagcacggtttaacgcattgtaa

SEQ ID NO: 4022 - DNA, 456 bp, Yersinia mollaretii
atgctgtctattgccatcggctgtgatgatgcggccattgatatgaaaaatcagattcttgcctttctgcaaaatagaggcatgactgtggttgattacagttgtgaccaacagcgcgaatccaccctataccccgatatcgccattcaggtggctcaggctattaaggacggcaagcatgaacgcggaattctgatctgtggaaccggtattggcatgagcatcactgccaataaagtgctgggcattcgtgccgcacagtgccatgaccccttctccgctcaacgagccagaaaaagtaataatgcacagatcatctgtttgggcgcgcgggtgattggtattgagttagccaaaaccttggtcgatacgtggcttgattgtgatttcgatgggggcggctcaaccgaaaaagtggaacgcattagttactatgagcaacagcaaaatatatga

SEQ ID NO: 4023 - DNA, 456 bp, Yersinia pestis
atgttatctattgcaatcggctgtgatgatgccgctattgagatgaaaaaccagattgttatttttctacaaagtaagaacatcactgtcgtcgattacagctgcgatcaacaccaagaaccgacgatgtaccccgatattgccattcaggttgctctggcgattaaagccgggaaacatgaacgcgggatccttatttgtggaacaggtattgggatgagcatctctgccaataaagtttttggcgtccgtgcagctcagtgccatgatactttttctgcccaacgagccagaaaaagcaacaatgcccaaattatctgtttaggcgctcgcgttattggcccggagttagccaaaaccctgatcgaggcttggttagatgctgaatttgacggagggggatcaacggaaaaagtggaacggatccgctattacgaacagagcctgcatgattga

SEQ ID NO: 4024 - DNA, 444 bp, Legionella longbeachae
atgaagattgcggtatgcagcgatgagctttatcctgtaaatgattttgttattcaagaagtggagcatttgggtcatcaggttattctatttggtgcccttaaatcgagacacacagaatcatgggttgaaactgctcgagttgctgctgaagcaatcaaaagtgggatgtgtgatgaaggaatttttttttgttggacgggtacgggtatctctatcgttgcgaataaaattccaggaataagagccgccttatgtacagatgcacaaacaacacgaggagcaagagtttggaatagcgcaaatgtgttggccttatcaaatcggttgttaactcaggacttagcaaaagagatcctggatgcgtggtttaatacctcgttaaatgacagcaatgaaaagatcattgaagaaattggatttatagagcgtaaatatcgttga

SEQ ID NO: 4025 - DNA, 429 bp, Methylococcus capsulatus
atgaaaataggcatcgcatccgatcacgccggtttcgattacaaagaacggctccgtgcctggctcgcttcgctcggccatgaggtcgtcgactacggctgtttcagcgacgagcgcaccgattatcccacctggatacgcccctgcgcgcaggccgtggccgccggcgaggtcgagcgcggcatcgtgctcggcggcagtggcaatggcgaggccatcgtcgccaaccgggtcaaaggctgccgttgcggctactgcttcaacgaagaaaccgcctacctcacccgttggcacaacgacgccaactgcatcgccatcggccagcgcatcgtgactttggacatggccaagaagatcgtcgagacctttctctcgaccggcttcgagggtggccggcacattccacggatcgtggcgatcgacgcctag

SEQ ID NO: 4026 - DNA, 501 bp, Chromohalobacter salexigens DSM 3043
atgtcagattcacgcacggccagtcatacggccccgatgcgcgttgccctggggggcgacgaggccgcctacgagctcaaggcgttgctgatcgagcacgttcgagcgctggggcatgaggcggtggacttcggcacctatgatgccgagccggtgctgtacccggatgtggcggtcaaggtggcgcgtgccatcgaggcgggagaggtcgaacgtggggtgctggtgtgtggtaccggcatcggggtggcgatttcggccaacaaggtgcgtggtattcgtgccgcccaggcgcacgatacctattcggccgccaaggcgcgctcgagcaacgatgcgcagatcgtgacgctgggcgctcgtgtggtgggccctgaactggccaagaccatcgtcacgacgttcctggcgaccgagttcgccggcggtggctcgcgcgagaaagtggcgcgcatcctggcctacgagcgcgaaacctttcgtgacccgccgcgcgtctga

SEQ ID NO: 4027 - DNA, 447 bp, Chromohalobacter salexigens DSM 3043
atgaagatcgtcatcggctcggatcatgcgggctacaggctcaaggcctcggtggtggaatacgtggaatcgctcggccatgaagtgatcgacgtggggtcgcacgatgacaccccggtggatttccccgatattgcgaagcagatggccggcaaggtgacgagtggcgaggcggcccggggcttgatggtctgcggtaccggcgtgggcgcctccattgccgccaacaagattcgcggcattcgcgccgcggtgtgccatgacatccattcggcgcatcagtgcgtcgagcacgatgacgtcaacgtgatgtgcatcggcgcgcagatcgtcggcccctggctggccaacgacctgatcaaggcctatctcgaagccgagttttccaccagcgaagaattccgccggcgcgtggaaaagctgcatgccatggagaacgatggctag

SEQ ID NO: 4028 - DNA, 462 bp, Marinomonas sp. MWYL1
atgagaattgcaattgctggagatagtgctggcgaagggctagcaaaaattttagctgaccatcttaaagatcgttacgatgtagaggaggtttctcgtactgactctggagaagttgagccgttttatgccaatttatctgatcgtgtcgctaacgctgttttagacggaaaatatgatcgtgccattttatgttgtggtacaggaattggagtgtgtattgcagcaagtaaagttccgggtattcgagccgctctcactcatgacacttattctgcagagcgtgccgcactttctaacaatgcacaaattattactatgggtgcacgtgtaattgggcaagagttagcgaagtccattgccgatgcgtttttggttcaagtattcgatgaaaatggtcgctcggcagataatgttaaagcaataaactctattgatgaaaaatatcatgctcgcccgtaa

SEQ ID NO: 4029 - DNA, 450 bp, Actinobacillus succinogenes 130Z
atgaaaattgcaattggatgtgatgaagcggcatatcgtttaaaagttgaaattatgaaacatttagatgctattggcgttgaatatgacgatttcggcgcaggcgagggcgatgtggtgctataccccgatgttgcggaagccgtagccgtcgctgtggcggaaggcaaatatgaacgtgccattttaacctgcggtacggggatcggcatgtgcattacagcgaataaagtaccaggtgtgcgggctgcggtctgtcacgacgtattttctacggaacgttcgcgcaaaagtaatgatgcgcaaattatgtgcttaggcgaacgtgtaatcggtgtcgaattagccaaatctctgattgatgtttggtttaaatgtgattttgccggcggcggttccgcaccgaaagttgcacgtatcaatgaaattgatgcgaaataccacaaataa

SEQ ID NO: 4030 - DNA, 453 bp, Actinobacillus succinogenes 130Z
atgaaaattgctatcggatgtgatgatgccgcatataacttaaaaattgagttaatcaaatatctggaaacattaggtattgaatgcgatgactttggcgccggtgcgggcgatttgacattgtatccggatgttgccgagaaagtagctttggcggtttccgaaggcaaatatgagcgtggaattcttacctgcggaaccggtatcggcatgtgcattacggcaaataaagttccgggggtaagagcggcggtttgtcatgacgttttttctgccgaacgttcaagaaaaagtaatgatgcgcaaattatctgtttcggtgagcgtgtgattggcgtggaattagcaaaatcactacttaaagtgtggttggaatgtgattttgcaggcggtggctcaacaccaaaattagcaaaaattaaagaaattgatgctaaatataataaacgttag

SEQ ID NO: 4031 - DNA, 474 bp, Haemophilus somnus
atgaaaacaatcgctattggttcggatcatattggtttggcactcaaaacctttttaattgaaaaattagaaaaacagggacataacttactagacttaggtgctgtttcacaagaacgtacagattaccccatttacgctgaaaaagttgcttatgctgttaagcggaatgtagctgatgttggaattttaatctgtggaacaggagttggcatttctattgcagcaaataaaatctcaggcattcgatgtgcattatgttcagatgaacttaccgcactaatgtgtcgtgaacataacaactgcaatatcattgcatttggtgccaatattatatcttcagaaaaagcgatatccttagcaacactttggctgaatacgccctatgacggaggacgacatcaaaaacgccttgacatgatggaaatgcttgaaaaaacaggaagttattgtggattggttactgaaagataa

SEQ ID NO: 4032 - DNA, 453 bp, Mannheimia succiniciproducens MBEL55E
atgaaaattgctattggatgtgatgaagcggcatatcgcttaaaagttgaaattatgaagcatttagatgagctgggcattgaatatgatgattttggcgccggagaaggagatgtcgttttatatcctgatgtagcggaagccgttgcagttgcggttgccgagggaaaataccaacgggcaattctaacttgcggtaccggtattggtatgtgtattacggcaaataaagttccgggaatacgcgcggcagtatgttatgatgtgttttcaaccgagcgctcaagaaaaagtaatgacgctcagattatgtgcttgggagaacgtgttataggtgttgagttagcaaaatcattaattgatgtgtggttcaaatgtgagtttgccggtggcggttccgcacctaaagtgaaacgtattaatgaaattgatgcgaaatataacaaaagataa

SEQ ID NO: 4033 - DNA, 456 bp, Pasteurella multocida
atgaaaatcgccattggctgtgatgatgcggcttataatttgaaggtggaattaattaagtttttaacttcccttggcattgaatgtgatgattttggtgcgggtgctggtgatacaacactgtatccgaatgttgctgagaaagtcgcaatcgctgtcgcaaaaggagaatatgacagaggcattttaacctgtggaacaggaattggtatgtgcattactgcgaataagattcctgggattcgtgctgctgtgtgtcatgatgttttttctgcagagcgagcaagaaagagtaatgatgcgcagattatttgttttggtgaaagggttatcggtgtcgaattggccaaagcattattaaaaacgtggttagcgtgtgacttcgcaggtggtggttctacacctaaagttgcgcaaattaatgaaattgattctaaatatcatcgctctttatag

SEQ ID NO: 4034 - DNA, 474 bp, Azotobacter vinelandii
atgaacgagccattttctgtggctatcggttgtgatgaggcaggctttgagcttaaagagttgctcaaacgccatattgaggatctgggctacagacttaaggatttcggctgctattcgaccgatccggtgctgtacccggatatcgccaccgcggttgcgactgccattagcgccggccagcaccgtctgggtgtgctgatctgcgggaccggcataggcatggctatttctgccaacaagattcagggcattcgcgccgcgcaggcgcacgacacctattccgcggagcgggcgcgcaagagtaacgatgcgcagatcgtttccatcggggcgcgggtgattggtcccgagttggcgaaaaacatcgtcaaatccttcctcgagtcggagttcgaggccggccgttcggggccgaaagtagagcggatcaaggccgtcgagaaagccgatcgggagcagtcgcctaagtaa

SEQ ID NO: 4035 - DNA, 462 bp, Pseudomonas syringae
atgaacacacctttcccggtggctatcggatgtgacgaagcgggttacgaactcaaagaactgttgaaacgccatatcgagtcactgggttacccggtaaccgatttcggcacccactcaaccgcggcggtgctttatccggacatcgccctggcagtcgcaacggccatcaatgcaggccagcaaaggctcggtgtactggtttgcggtaccggaataggcatggccatatccgccaacaaggtgttcggcattcgtgccgctcaggcccatgacacctattcggccgagcgcgcgcgcaaaagcaacgatgcgcaaattctctcggtcggtgcgcgggtgataggtgcggagctggcgaaaagcatcgtcaaatcatttctggaatcggagttcgaggctgcacgctccggagccaaggtcgagcgcatcaatgccatcgagcgtgacggccatcagtag

SEQ ID NO: 4036 - DNA, 462 bp, Pseudomonas syringae
atgaacacacctttcccggtggctatcggatgtgatgaagcgggttatgaactcaaggaattattgaagcgccatatcgagtcgctgggttatccggtgaccgatttcggtactcattccgcggcaccggtgctttacccggacatcgccctggccgtggccacagcgatcaacgccggacagcagcggcttggcgtgctggtctgcgggaccggaataggcatggccatctccgccaacaaggtcttcggcattcgtgcggcccaggcccacgatacctattcggccgagcgggcacgcaagagcaacgatgcgcaaattctttccatcggtgcacgggtgatcggcacggaactggcgaaaagcatcgtcaaatcgttcctggagtcggagttcgaagccgcgcgctccggcgccaaggtcgagcgcatcaacgcgatagagcgtgacgggcatcaatag

SEQ ID NO: 4037 - DNA, 462 bp, Pseudomonas syringae
atgaacacacctttcccggtggctatcggatgtgatgaagcgggttatgaactcaaggaactgttgaagcgccatatcgagtcactgggttatccggtgactgacttcggcactcattccactgcgccggtgctctatccggacatcgctctggcggtcgcgacggcgatcaatgccggccagcagcggcttggcgtgctggtctgtggtactggaataggcatggccatctccgccaacaaggtccttggcattcgtgcagctcaggctcacgacacctactcggcagagcgggcacgcaagagcaacgatgcgcaaattctttccgtcggtgcacgggtgatcggtgcggaactggcgaaaagcatcgtcaaatcgtttctggagtcagagttcgaggcggctcgctccggcgccaaggtcgagcgtattaacgcgatagagcgcgacgggcatcaatag

SEQ ID NO: 4038 - DNA, 426 bp, Reinekea blandensis MED297
ttgattgttgcgttagcgtgtgaccacgctggtttttactataaagagtccattcgtaaggctcttcttgagcgcggggtgtcggttcaggattttggcgcccactcggaagagccggtcgactatcccgatatcgtccggccagccgccgaagccgttgcccggaatgattgtcaacgaggcatcatcgtcggtggcagtggcaatgaagccattgtcgcgaaccggatccggggcattcggtgcgccgtggtctggaacctcagaacggctgagttgtcgatggcacatggtaattgcaatatgattgccattgggcagcgcatgatgaccgagaccgatgcgttagcgatcgttgatcattggcttgcggcgacctttgctggcggccgacatcaacgtcggatcgataaaattgatgtgtaa

SEQ ID NO: 4039 - DNA, 441 bp, Vibrio harveyi
atgaaaattgctatcggttgtgatcatgtagggatcgaacataaagaattggttatcaaacacttagaaagtaaaggtattgaagtgattgatttcggcacgcattcagcagagcgtactgactaccctcaatacggtttagccgtcgcaaaagcggtaacaagtggcgatgcagaccaaggtcttttgatttgcggtacaggcgttggcatttcgctagcagcaaacaaagttccgggtattcgcgctgtcgtttgtagcgacccatacacggcgcagctatctaaacagcataacaacaccaacatccttgcgttcggctctcgcgttattggcattgagctagcaaaaatgatcatcgatagctggttagaagcaaagttcgaaggtggtcgtcatcagaaccgtgtaaaccaaattgcagaaattgaggagcgataa

SEQ ID NO: 4040 - DNA, 447 bp, Vibrio shilonii AK1
atgattgcaattggatgtgatgacgcagcagtagatttgaaggagtgcttgaaagctcatttagctgcgaaaggtattgagtatgtcgactacggaatcgacccagagaacgcatcactatatccggatattgccaaagaagtcagcttagcagtgagtgctggaaagcatgaacgcggcatcattctttgtggtaccggaatcggtgtatctattgtggcaaataaagtaccaggtattagagctgcactttgccacgatacgttttctgctgagcgagctcgtaagagcaacgacgcgcaaattatcactatgggttctcgcgtgatcggttctgagctcgcaaaagcgatattagatacatggttagattcagagttttctgacggaccctcgacccctaaggtaaatagaattaaggagatagagaaagaatttattggataa

SEQ ID NO: 4041 - DNA, 447 bp, Magnetococcus sp. MC-1
atgcgcattttttttgcctgcgaccatggcgccagcgagctgaaacagcaccttatggcgtacttggccaaacgggatcgtgtcgagctggtggacctgggctgtgatggaacgacctcggtagactaccccgattatgccgctaccctgtgtaaagcggtgctggccagtgctggcgatcgtggcgtgctgttgtgcggtaccggcatcgggatctccattgccgccaaccgctttgccggtattcgcgcggcactctgccatgatgcctacaccgcccgtctgtgccgtgaacataatgacgccaacgtgttggtgctgggtggtcgtaccaccggtcctgcggtggccgaagagatgctcgacctctggctggataccccctatgccgggggacgccatcagcgccgactggacaaaattgaatccaacgcccgtgaggtataa

SEQ ID NO: 4042 - DNA, 507 bp, Brachyspira hyodysenteriae WA1
ttgttgcttttaattgattattataataataaaatatatatgaaggaaataaaaactatgaaaattgctataggctgtgatcattcagctgttgaattgaaaaaagagataataaaatatttagaagaattgggacataatgttactgattttggtacgcataccacagaaagcgttgactatccaatatatggaaaaaaagttgctgatgctattgtaagtaaagaatgcgaatgcggtgttttaatatgcggaacaggtataggtatttcacttgctgctaataaagtaaaaggtataagagctgcagtttgcagtgagccttattctgctaaactttccaaacagcataataattctaatataatagctttcggtgctagggtagttggtgttgatttagctaagatgatagtaaaagaatggcttgatgctgaatatgaaggcggaaggcatgccagaagagttgacttgcttacaaaaatagagaacggcgaggaaatttaa

SEQ ID NO: 4043 - DNA, 450 bp, Brachyspira murdochii DSM 12563
atgaaaatagctataggcggagatcattcttctatagagttaaaaaaagagataacaagatatttagaagaattgggacatgatgtaaaagactttggcacttatactcctgagagtgtagattatcctatatatggaaaaaaagttgctgatgaggtggcaagcggaagatatgagggaggcgttttaatatgcggtactggtattggcatatcattagcggcaaataaggttaaaggaataagggcagcagtttgcagtgagccttattctgctaaactttctaagcagcataacaattctaatataatagcattcggtgctagagtagtaggtgttgatttagctaaaatgatagtaaaagaatggcttgatgctgaatatgaaggcggacgtcattctagaagagttgaacttctcacaaaaatagagaacggagaagaaatttaa

SEQ ID NO: 4044 - DNA, 438 bp, Leptospira biflexa
atgaaagaaaaaattggaatcgccactgatcatggaggatttgctctgaaagaattcctcaggaaaagtctcgaggaaacgtatgaaatggtcgattacggtactaagagcgaagagtccgtcgactacccaaccatcattggagatgcctgccgaaaggtactctcaaatgaagtcccacgactcatcgctctctgcggaacgggcattggagcttccattgcggcgaaccgaatgaaaggcattcgagcggccctttgccatgatgagtttacggcagaaatgtcgagacgccataacaatgccaatgtgttggttttagggggaagagttcttggaacggatttagctctgagaattgtgaaaaaatggatcgaaacagatttcgaaggtggacgccaccaaaaacgattgggtcttatcgaagaacagtcttaa

SEQ ID NO: 4045 - DNA, 438 bp, Leptospira borgpetersenii
atgaaaaaaatcggaatcgcctcggatcatggaggctttgaactcaaggaatttctccgcgactctctttccagagaattggaaatcatagattacggaaccaaaaacgaaacctcggtggattatccgatcgtcatttcggaagcctgtaaaaaagttctttccaaagaagtagaaggtttaatcgctctttgtggaaccggaatcggagcttccattgccgcaaatcgcatgaaaggaatccgtgccgcactttgtcacgatcagttcaccgcagaaatgtccaaacgccataataacgcaaacgttcttgttttgggcggaagaatcgtcggcaaggaactcgcgctcaatatcgtccgtacttgggtcaataccgtttttgaaggtggccgtcacgaaagaagagtcaaccaactcgaatctttaaattcttaa

SEQ ID NO: 4046 - DNA, 438 bp, Leptospira interrogans
atgaaaaaaatcggaattgcctctgatcacggaggttttgagctcaaggaatttctccgcaagtctcttgcaggagaattggaaatcgtagactacgggaccaaggatgaaagttctgtggattatccgattgttatctcggccgcttgtaaaaaagttctttccaaagaagtggaaggtttgatcgctctttgtggaactggaattggggcctccattgccgctaatcgtatgagtggaattcgtgctgcactttgccacgatcaatttaccgctgaaatgtctaaacgtcataataacgcgaatgttctcgttttgggtggaaggattattggtaaagagttggctcttaatatcgtacgtacttggataaatacttcttttgaaggtggacgccatgaaagaagggtcaatcaactcgagactttaaattcttaa

SEQ ID NO: 4047 - DNA, 453 bp, Treponema denticola
atgaaaatcggatttggaagcgatcattcgggagtcgcattaaaacatattttaatggaacacgttcgcaataaaggatacgaatgcgttgattacggtgcggcggattcgaaggttccggcaaactatgccgaattcggcttaaaggttgccgaagcgattaaatcgcaggaagttgaaaaaggcgttatggtgtgcggatcgggcgtcggcatttctcttgccgcaaacaaggttccgggagtgagggctgcggcgtgcagcgaaccgtgtacggcaaagctcgccgtcgaacacagcgacataaacgctgtcgccatgggcgtatgcatcgtcggacccgaagaagcaaaaatgattgtcgacgcctttctcgatgcccgctttgaaggcggcgtttacacggaacgggtcgacaccctttccgctatagaaagaaaatacggtaaataa

SEQ ID NO: 4048 - DNA, 453 bp, Treponema vincentii ATCC 35580
atgaaggtcggttttggatgcgatcatgcatcggttggattaaaacatatcttaatggaacatgtacgaaacaaagggtatgaatgtgtcgattacggaacaacagatccgaaggttccggtcgattatcccgaattcggtttaaaggttgctgaggcaattaaatcgaaggaggttgaaaaaggaatattgatctgcggatcaggtatcggtatttccctcgccgcaaataaggttccgggaatccgcgctgccgcgtgtagtgaaccgtgcaccgcaaaattggctgttgagcacagtgatatcaatattgtttctatgggggtatgtattgtaggtcctgaaatagcaaaagcaattgtcgatgctttttttgatgcacagtttgaaggcggcagctacacaaaacgcgtcaatatgatcggcgatatagaaaagaagtacggtaaataa

SEQ ID NO: 4049 - DNA, 441 bp, Acholeplasma laidlawii
atgaaaataggcattggcgcagatcatgcgggatttaatagaaaaactgaaatcattgagtacttaactaaaaaaggttatgatgttgttgatttcggagcacactcagtagaccgagtagattaccctgattatgcaaaaacagtttcagaagctgttgtaaataaggaagtcgaagtcggattattagtatgtggtactggtattggtatgagtattgcagcaaataaagtcaaaggtattagagcagctcacgtctttgatgaattaactgctagacttgcaagagagcataatcatgcaaatgtgattgcttttggtggcagaaaccaaacaacatcagaatcaaaaattattgttgatgcatatttaaatgcacatgaagaatctcgtcatcaacatcgcgtagacaagattgcagctattgaaaatggtgagtaa

SEQ ID NO: 4050 - DNA, 441 bp, Mesoplasma florum
atgaataagatatatatagcaaacgatcatacagcgattgaaatgaaaaacgctattaaaaatcatttagagaaaaaaggttatgaagttattgatttaggtaacaatgatggtaattcatgtaactatgcaaatattggaattactttagcagaagctgttgttgcggatgaaaataataaaggtattgctttatgtggtacaggaattggaataagcattgcagcaaataaagttaaaggtgctagagctggacttgtgtatgaagttcaaactgctgaattaacaagacaacataataatgcaaatatattagctactggtgctagattaattgctgttgataaagcacttttattagtagacactttcttaaatactgaatttgaaggtggaagacatcaagaaagagtaggaacattagatgagtacaataaataa

SEQ ID NO: 4051 - DNA, 432 bp, Spiroplasma citri
atgaaaattgtgattgggaatgatcatacagggattgatatgaaaaaagcaattgttaagcatttaattgaacaaaaacatgaaattattaatttaggcacagatagtattgaagcggttgattattctgatattggccaagctgttggtgaaagagtaattaaagaaaaaaatagtgttgggattataatttgtggaacaggaattggaatttcaattgctgcaaataaagtaaaaggaattcgagcagcattgtgtaatgaaacagtgctagcaaaattagcacgcgaacataataatgctaatgttttagcattgggagctagagttattgcaaatcaaaatgcaatttgaattgttgatatgtttttaaatactacttttgattctggacgtcatgctcttcgtgttgaaaaacttaataacctttag

SEQ ID NO: 4052 - DNA, 447 bp, Mycoplasma agalactiae
atgaaaaaaggtaaagtagttttagccagtgatcacggtggttgtgatttaaaaaatgaaataaaagactatgtaagcaatctaggatatgaaacagtagatttaggacctgaagatagttcaaaatctatatcatatgctgaacaaggacataaattagctaattatttattggataataaagatgtttcatttggaattggtttgtgtggcacgggtttaggtatttcatatgcactaaacagacacaatggaataagggctgctagagtaacttcagttgaggatgctaatcttgcaaaattacacaacaatgctaatgtgcttgttatgggcggcagacaagttaatattgaacaagcaaaagctatgattgatgaatacattaacaccgcatatgaaggcggcagacaccaagccagaatcgaccaaattgataaattttaa

SEQ ID NO: 4053 - DNA, 489 bp, Mycoplasma arthritidis
atgataaaaaacaaaattatcatcacaagcgatcacgcagggcataaaatgaaaatggaccttgcagataaattgcgaagagaaggatatgtagttgaaactaggggaagtagcaacgaagatgaaacactttcatactcagaagtaggaattgagtttgcaaatgaatatttacatgatccccaaagagatgaaaaacaatttattgctctatgtggttcaggaatcggtattagcacttcgctaaaccgtttcaaacaaattagatgtgcaagagtaactaactctgaagaagcaagacttgctagattacacaataatgctaatatcctatcttttggtggaaggctaatttctttagaccaagcttatgaaatctttaaacaatgagaagcaaccgaatttgaaggtggtcgtcacatttttagagttttaaaattagacgaagtcggccaagatgttgatgacgttgcagaaactaaagagtag

SEQ ID NO: 4054 - DNA, 435 bp, Mycoplasma conjunctivae
atgtacaaaagaatagcttttgcctccgaccatgcaggttttcaacgaaaacaagaattaattgattactaccaaaaacaaggttatgaaattattgatttaggccctagtgatgaaacttctacctcatatgcaacatatggtaaaaaattagctacccatttattagaaaatccagatgaactagcaattggaatttgtggcactggtcttggtatgtcatatgcactcaatcgcttcaaaaatgtcagagctgcaagaattacaagtgaaaatgatgcttatttagcaaaactacacaatgatgccaatgcgcttgcactctctgcccgttttaatagcaaagaagattctattagctttgttaacaagtttttagatactagatatgaaggtggtcgccaccaggatcgaatagatgagcttgataaataa

SEQ ID NO: 4055 - DNA, 537 bp, Mycoplasma fermentans
atggaaaaatttaggaaaaaagataaatttttaccaaacttttccagaattttgctttatcatttaaaaatagacactaaggaggctaatatggctaaaaaaaatattattgctcttgctagcgaccatggtggttgcgaattaaaaaatgaaatgcgcgattatgtaaaaagtttaggttatgaagttgttgacttaggacctgcggatggctcaaaaagtatttcatatgctgaacaagggcataacctagctaaatatattgatgaacataaaaacacaattggtttaggtttttgtggtacaggtttaggtatttcatatgccttaaaccgtcataaacacattcgcgcagctagagtagttacagttgaagatgcaaggcttgctaaattacataataatgctaatgttttagttatgggtggtagatatgtaccttttgctgaagcacaagctatgtttaacgaatacattaaaactgaatatgaaggtggcagacaccaagcaagaatcgatcaaatcgatgaattctaa

SEQ ID NO: 4056 - DNA, 480 bp, Mycoplasma gallisepticum
atagcaattatggacaagagaaaaatcatattcgtagctgatcatacaggtgttttcttaaaacaagaacttatcagtatgcttaaaactgaataccataatcaatatgaagttattgatttaggttcagatgatgaaaaaagtgcagatgattatcctgactttgcttttatgcttgaagattactttaaggatgaaaacacaagaaatatcggtgtagcgatctgtggtactggtgttgggatttgtatagcagctaacaagattaaaaatgttcgtgcaggattagtaactgatgttcaatatgcagaacttgcgattcaacatgataactgcaacgttttagttcttggagctagaacaacatcaattgatgttaataaagagatcctaagaaagttcttatcagcacaatttgaaggtggtagacaccaaagaagagtggataaaattagtaactatgaaaaaaaacaagattaa

SEQ ID NO: 4057 - DNA, 459 bp, Mycoplasma genitalium
atgagttttaatatctttattgcttctgatcataccggtttaactcttaaaaaaattattagtgaacacctaaagactaagcagtttaatgtagttgatcttggccctaattattttgatgctaatgatgattatcctgactttgcttttttggtagctgataaggtcaagaaaaattctgataaagatcttgggatactaatttgcggtactggtgttggggtttgtatggcagcaaataaagtaaaaggagtattagcggctttggttgttagtgagaaaacagcagctttagctagacaacatgataatgccaatgttttatgtctttccagtcgttttgtaactgacagtgaaaacattaaaatagtggatgattttctcaaagctaattttgaaggtggtagacaccaaagacggatagataagattattcgatatgaaaaagaaactgaatag

SEQ ID NO: 4058 - DNA, 468 bp, Mycoplasma hominis
atgaaaacgacagttaagataacaagcgatcacgcaggatatgacgcaaaaataaaccttgcaaaaagattggaaaatgaaggctacaatgtagaattatttggctcaaaaacaaataacaatagtgattcttatgcagatgctgctattgaattagttaatgaaattcacaaggatggcaatcctgatgaaaataaaaatgtaaaatatgttgcattttgtggatcaggtattggtattgaaatgactttaaacaaatttaaaggcataagagcagcaagagttacaaatgaaaacgaatctcacctagcaaaattgcataataatgctaacgtactatgtatgggtggaagattgttagaaggtaatgaagttgaaaaaatttttcatagctgagaaaacaccgaatttgaaggtggcagacatcttgaaagaattaaaaaactaagctcaattggtgaaaactaa

SEQ ID NO: 4059 - DNA, 435 bp, Mycoplasma hyopneumoniae
atgcctaaaaaatttgctattacttcagatcatgctggttttaaaagaaaagaagaaattattgagtatttaaaaaaccaaggttttgaagtaaatgatcttggcccaaaaaatgaggaatcagtttcatatgcagtttatggtaataaactagcaaattttttgctagaaaatcctgagcaaattgggattgctatttgtggaacaggattaggaatgtcttatgccttaaaccggtttaaaaaaattcgagctgctcgagttacaagtgaaaatgatgcttattttgcaaaattacataataatgcaaatgtgattgcgctttctggccgttttaattcaaaagatgaatcaatttcttttattaaaaaatttttagaaaccgaatacgaaggtggccgtcatcaagaaagaattgatgaacttgataaataa

SEQ ID NO: 4060 - DNA, 435 bp, Mycoplasma hyopneumoniae
atgcctaaaaaatttgctattacttcagatcatgctggttttaaaagaaaagaagaaattgttgagtatttaaaaaaccaaggttttgaagtaaatgatcttggcccaaaaaatgaggaatcagtttcatatgctgtttatggtaataaactagcaaattttttgctagaaaatcctgagcaaattgggattgctatttgtggaacaggattaggaatgtcttatgccttaaaccgatttaaaaaaattcgagctgctcgaattacaagtgaaaatgatgcttattttgcaaaattacataataatgcaaatgtgattgcgctttctggccgttttaattcaaaagatgaatcaatttcttttattaaaaaatttttagaaaccgaatacgaaggtggccgtcatcaagaaagaattgatgaacttgataaataa

SEQ ID NO: 4061 - DNA, 435 bp, Mycoplasma hyopneumoniae
atgcctaaaaaatttgctattacttcagatcatgctggttttaaaagaaaagaagaaattattgagtatttaaaaaaccaaggttttgaagtaaatgatcttggcccaaaaaatgaggaatcagtttcatatgctgtttatggtaataaactagcaaattttttgctagaaaatcctgagcaaattgggattgctatttgtggaacaggattaggaatgtcttatgccttaaaccgatttaaaaaaattcgagctgcgcgagttacatgtgaaaatgatgcttatcttgcaaaattacataataatgcaaatgtgattgcactttctggccgttttaattcaaaagatgaatcaatttcttttattaaaaaatttttagaaaccgaatacgaaggtggccgtcatcaagaaagaattgatgaacttgataaataa

SEQ ID NO: 4062 - DNA, 447 bp, Mycoplasma mobile
atgaaaaaaagtaaatttatcttagctagtgatcatgctggttataaattaaaagaagaaataaaaaaatatctaatcgaaaaaggattaccatatacagatttaggaacaaatagtgaaacagaaagtgtttcatatagtgaatttggaaaaaaattaggaaaatatgttcatgaaaatcccaatgattatggaattggaatttgtggaacaggtttaggaatgtcttatgctgttaatcgttttaaaaatgttagaggggcgagaattcattctgtagaagatgctcatttagctaaacaacataacaatgccaatgtattaatttttggtggaagacaacaaaaaatagaagatattaaaaaaatgattgatgaattcattaatacagaatttgaaaaaggcagacatctagatcgtattaaagatcttgatgatgaaatttaa

SEQ ID NO: 4063 - DNA, 498 bp, Mycoplasma capricolum
ttgctaaaaattcttaaaaatattattgtaaaatattttaaaagagaggttagtatgtcaaatcgaatttatataggaaacgatcatagtgcagttgaaatgaaacaagcaattgttaatcatttaaaatcaaaaaattatgaagtaattgatctaggaaataatgacggtaaatcttgtaattatgcaaaaataggtcaaactgtagctgaatatgttgtaaaagatactaatagtagaggtattgtaatttgtggaactggaattggtattagtatagctgctaataaagttaaaaacgcaagagctgctttagtatatgaaaaagaaacaactgaattagcaagaattcataatgatgcaaacattatagcactaggagctagaatgattgcaataccaaaagctataaatttggttgatatctttttaaatacaccatttgaaggtggaagacatatagaaagggttgatacattaaatgaatacaaaaattaa

SEQ ID NO: 4064 - DNA, 444 bp, Mycoplasma mycoides
atgtcaaatcgaatttatataggaaacgatcacagtgcagttgaaatgaaacaagcaattgtaaaacatttacaagaaaaaaactatgaagtaattgatctaggaaataatgatggtaaatcttgtaattatgcaaaaataggtcaagttgtagctgaacatgttgtaagtgatactaatagtagaggtattgtaatttgtggaactggaattggtattagtatagctgctaataaggttaaaaccgcaagagctgctttagtttatgaaaaagaaacagctgaattagcaagaattcataatgatgcaaacattttagcactaggagctagaattatagcaataagtaaagctattaatctagttgatgtatttttaaatacaccatttgaaggtggaagacatatagaaagagttaatactttaaatgaatacaaaaattaa

SEQ ID NO: 4065 - DNA, 498 bp, Mycoplasma mycoides
ttgctaaaaattcttaaaaatattattgtaaaatattttaaaagagaggttagtatgtcaaatcgaatttatataggaaatgatcatagcgcagttgaaatgaaacaagcaattgtaaaacatttacaagaaaaaaattatgaagtaattgatctaggaaataatgatggtaaatcttgtaattatgcaaaaataggacaagttgtagctgaacatgttgtaaatgatactaatagtagaggtattgtaatttgtggaactggaattgggattagtatagctgctaataaagttaaaaccgcaagagctgctttagtttatgaaaaagaaacagtagaattagcaagaattcataatgatgcaaacattttagcattaggagctagaattatagcaatttcaaaagctattaatctagttgatgtatttttaaatacaccatttgaaggtggaagacatatagaaagagttaatactttaaatgaatacaaaaattag

SEQ ID NO: 4066 - DNA, 477 bp, Mycoplasma penetrans
atgagtgaatcaaaaaaacaattgaagaaaattaaagtttacattggaagtgatcatggtggttttgatatgaaagaaaaaattagaaacaaccatgaattattagaaattttagattttgtagatcttggaacatatagtggtgatgaatcagtagattatccagactatgctgaaaaaattggtgagaatcttttaaaagataaaggttcttatggaattggaatttgtgggactggaattggaatttgtattgctttaaataaaattaaaggaatatatgctgcaaatgtaaacaaaacaattgaagctgaacttgctagagaacacaataatgtaaatgtcattacattatctggaagatttacatctgttgaagataatgttgaaattattaaaaaattcttttcttcacattttgaatctggaagacatgaaaaaagattagataaaataactaaattggaaaataaataa

SEQ ID NO: 4067 - DNA, 459 bp, Mycoplasma pneumoniae
atgcaaatgaaccatccaatttacattgcttctgaccacactggtttagagctcaaaagcttagtgataaaacacttagaacaacaaaagttgcaagtgattgatttaggtcctacagagctagatccacttgatgactacccggactatgcctttttgttagcgcaaacaatgcaagctaatcctaatagtttaggcatccttatttgtggtactggtgtgggtgtttgtatggccgctaacaaggctaagggtatcttagctgctttagtggtagacagtaaaacagcagcattggcacgccaacatgatgacgccaatgtgctgtgtttgtctagccgctttgtggttcctgaagaaaacattaaaatagtagatgaatttctccaggcgcagtttgagggtgggcgccatagtaaacgtgtcggtaagatcattgcttatgagagggaaaaatag

SEQ ID NO: 4068 - DNA, 468 bp, Mycoplasma pulmonis
atgaaaaaaatagcaatagcaagtgatcatgcaggatattcattaaaagaatcaattaaaaaacattataaagatcaaaattatgaagttattgatctaggaaccaatagtgaagaatcaacttcttattcagaatatggacataaattagctgagtatatgcaaaacaaagacaataaagtcgattttggtattggcatttgtggaacggggttaggaataagttatgccctaaatagacacgagggcatcattgcagcaagggtaacaagcgaagaggatgcttatttggcaaaagctcataacaatgcaaatgtcttggctcttggatcaagacaaatcagccttgaaaaagctgttaaaatcattgataaatatcaacaaagtagctttgaaggtggacggcacattccaagaattgaaggaattgaaattaaagattgctttaaaaaaaccaaatgtagctaa

SEQ ID NO: 4069 - DNA, 444 bp, Mycoplasma synoviae
atgaataaagtaataccattagcttcagatcacgcaggatttgaattaaaagaaagacttgaaaaacactttcaagcattaggttataaaatagtagatttaggtgctaaatcaaatctggattcagataataactacgcattagctggtcacgatttagcacattacatgcttgaaaataaatgcgagtttggaataggaatctgcggaactggacttgggatttcttatgcattaaaccgtcataatcatattagagctgcgagagttacatcaaacgaagacgcacatctagctaagcttcacaatgacgctaatgttttagtttttggtgctcgtcaagtgagttttgatcaggccaaagaaatgattgaaaattatataaataccacctttgaaggtggcagacatcttaaaagaataaacgatatagataggacttaa

SEQ ID NO: 4070 - DNA, 465 bp, Ureaplasma parvum serovar 3 str. ATCC 700970
atgataaaaaaaatttattttggtaatgatcatgctgcttatgaaattaaagatcaaattatcactcatttaaaacaaaaaggttatcaaattattgatgaaggtgcacaagccgcattaggttctgttgattatagtacatatgcattaaaagttgctaatgacgttgttaatgatactaaaaatgatagcataggtattttattatgtggcacgggaataggtatgaatatagcagcaagcaaagtgcatggaacgcgggttgcgttagtgtataacgaaagcagtgcaaaactagccaaggagcataataatgctaacataattactataggagcacgtgaaaatagtttaaaccaaattcttaaaatgattgatgattttttaacaagtaaatttttaggcgagcgtcaccaaaaacgtttagatataattgcaaaatatgaaaaagagcaaaatagttaa

SEQ ID NO: 4071 - DNA, 462 bp, Ureaplasma urealyticum
atgattaaaaaaatttattttggtaatgatcatgctgcttatgaaattaaagatcaaattattgctcatttaaaacaaaaaggttatgaaattattgatgaaggagcccaagtcgaattaggctctgttaactatagtccatatgctctaaaagttgctaatgatgttgttaatgatgctaaaaatgatagtttaggaattttattgtgtggcacaggaattggcatgaatatggctgcaagcaaagttaaaggtgcacgtgttgctttaatatataacgaaagtagtgcgaagttagctaaagagcataataatgctaatgtaattaccattggagcacgtgaaaatagtttagaacaaatcattaagatgattgatgattttttagaaagtaaattcgtgggtgagcgccatcaaaaacgcttagatataatcacagaatatgaaaaaaatcaaaaataa

SEQ ID NO: 4072 - DNA, 462 bp, Ureaplasma urealyticum
atgattaaaaaaatttattttggtaatgatcatgctgcttatgaaattaaagatcaaattattgctcatttaaaacaaaaaggttatgaaattattgatgaaggagcccaagtcgaattaggctctgttaactatagtccatatgctctaaaagttgctaatgatgttgttaatgatgctaaaaatgatagtttaggaattttattgtgtggcacaggaattggcatgaatatggctgcaagcaaagttaaaggtgcacgtgttgctttaatatataacgaaagtagtgcgaaattagctaaagagcataataatgctaatgtaattaccattggagcacgtgaaaatagtttagaacaaatcattaagatgattgatgattttttagaaagtaaattcatgggtgagcgccatcaaaaacgcttagatataatcacagaatatgaaaaaaatcaaaaataa

SEQ ID NO: 4073 - DNA, 444 bp, Mollicutes bacterium D7
atgaaaattgcaatggcttgtgaccatggtggcttaagactaaaaaatgttttaaaagattatttagaagctaatggttacatagtagaagatttcggaacatacagcgaagatagttgtgattatcctgattatgcaggaaaagcagctaaagcggttgctagtggatcgtgcgatagaggggttgtcgtatgtggaactggtatcggtgtaagtattactgctaataaagtgaaaggaattcgctgtgcgttatgccacgatgtatttagcgccaaagcaactcgagcacataatgatactaacatgattgctatggggcaacgagttattggtgaaggtttagctttagaaattttaacagcctggttagaaggcgaatatgaaggtggtcgacatgaccagcggattgcaaaaatgatggcttacgagggggaagagtaa

SEQ ID NO: 4074 - DNA, 438 bp, Fervidobacterium nodosum
atgaaggtagcaataggaagtgaccatgcggcttttgaactcaaagaaaaggttaaagagtaccttagaaacaaaggaatagaagttatagactgtggtacatattcaatagaaagtgttgattatcctgattacgctaagaaagttgccgaaaaagtgaaaagcaaagaatgtcactttggaatattgatgtgtggtacaggcattggaatgtctattgctgcaaacaaaataaaaggaataagagcagctctgtgtctattcccagatatggcgacttatgctcgaaaacacaacgatgcgaatgttttagttttgccaggtcgtttgatgggtatagagctagcaaagtggacagttgatgcctttttagactcttcatttgaaggcggaagacatgaaagaagggtaaaaaagattgaagaacttgaagagtga

SEQ ID NO: 4075 - DNA, 456 bp, Kosmotoga olearia TBF 19.5.1
gtgaaggtggctattgcttcagatcacgcgggattcgctatgaaaaaagaactcatagattttttaagctcagcaggatatgaaattactgactacggcacatattctgaagagtcggtagattatcccgattatgccgcgaaggtcgcagaggcggttactgaaggaacagcagagcgcggaatccttatttgtggaacagggctcggaatgtccatagctgctaatcgttataaaggggtaagggcagcgctatgtctttatcccgaaatggcaagaatgacaagaaaacataatgatgcgaacgttctcgtattaagtggaagattaatcggtgttgaacttgccaggagaatcgtagaggtgttctttgaaaccgggttcgagggtggtcgccacgaacgcagaataagaaagatcgatgatctaccggatctacggaggcggtctgattga

SEQ ID NO: 4076 - DNA, 435 bp, Petrotoga mobilis SJ95
atgaaaattgcaattgcctccgatcatgccggatatgagatgaaagaacagcttaagaattatcttttagagaaaaaattcaatataatagatttgggaactaattccaatgccagtgtcgattatcctgattatgccaaaaaacttggtgaaaaggtaaccaaaggtgaagctgacttcggcattggtatctgtggtactggaataggtatgtcaatcgcagtgaacaaagtcaaaggcgttagaggcgctctttgcttgtatccatcgatggcagaatacgccagaaaacataacgacgccaacgttttggttttggcaggtaggcttatgggcatcgatttagccatttggaccgtagtgaagtttttatcgacagattttgaaggtggaaggcataaaaggcgtgtcgataaaatcgacgaaatcaagtaa

SEQ ID NO: 4077 - DNA, 438 bp, Thermosipho africanus
atgaaaattgcaataggttcggatcacgcaggttttgagctaaaaaataaacttgtagattatttatctaaaaaaggaattgagattatagatgtaggaacaaatagtaccgaaagtgtagattatcctgattatgcaaaagaagttggaaaacttgttgtaaataaagatgctgattttggaatactcatatgtggtacaggcattggaatgtcaattgctgcaaacaaaattaagggaataagagcagctctctgtatgatacctgaaatgggaaaacttgcaagaaatcataataatgcaaacatattggtccttcctggaagattaataggatttgaacttgcaacatggattgtggaagaatttttgaatgcagattttgaaggtggaagacacgaaagaagaataaataaaatagtagaacttgaaaagtaa

SEQ ID NO: 4078 - DNA, 438 bp, Thermosipho melanesiensis BI429
ttgaaaatagcaattggaagtgatcatgcaggatttgaattgaaggaaaaaataaaaaaatacctcatggataaagatatagatgtattggattttggtacagataataaggaaagtgtggattatcctgattttgcggaaaaggttggaacatctgttaaaaacaaagaagtagaatttggtatattaatctgcggaacaggtataggtatgtccatagcagcaaataagattaagggtataagagctgcactttgtacaataccagaaatggcaagccttgcaagaaaacacaataatgcaaatattttggtgttacccggcagacttattggttttgaacttgctacttggatattagacgcatttttaaatgccacattcgaaggaggaaggcatgaaagaagaataagcaaaatttctcgtttggaggaataa

SEQ ID NO: 4079 - DNA, 438 bp, Thermotoga lettingae TMO
ttgaagatagccatcggttgtgaccacgctggctttaaattgaaagaagctataaaaggttatttagtgagcaaaggattcaacattctggacgagggaacttattctgaagactcagttgattacccagatttcgcggccaaggtcgccttagatattaaaaaccagagggctgatttcggaattcttatatgcggtactggaattggaatgagtatcgctgccaacaggataaaaggtatcagggcagctctatgcctttttccagaaatggcaaaacttgcaaggtctcacaataacgcgaatatacttgttttgccaggaaggtttatagctgtcgagctggcacaatggatagttgatgccttcatagaagaaaaatttgagggtggaagacatgaaaatcgtgttcagaagattgaggagatggataaatga

SEQ ID NO: 4080 - DNA, 432 bp, Thermotoga neapolitana
gtgaagatcgccatagcatcagaccacgctgcgtttgagttgaaagagaaggtgaaaaactaccttctgaacaagggtatcgaagtcctggaccatggtacacactccgaagagtccgttgattacccggactatgcaaagaaggttgtacaatccgtcctgtcaaacgaggtggactacgggatactgctctgtgggactggactcggtatgtcgattgccgcaaacagatacagaggcataagggctgctctctgtctctttccggacatggcaaggcttgcaaggtcacacaacaacgcgaacgtgctcgttcttcccggaagactgatcggttcagaactcgctttctggatagtggatacctttctttcaacacccttcgatggaggaagacacgaaaggagaataagaaagattgatgaggtttaa

SEQ ID NO: 4081 - DNA, 429 bp, unknown
  candidate division TM7 single-cell isolate TM7a
atgaaaatagtaattggaaatgatcatgcgggtgtagagtttaaaaataaaattatgcaggcgcttagaagtaaagggtatgaaattataaatgtaggaactgatactttggattcagttgattatcctgatattgcaaaggaagttagtaaaaaaattataaataaagaggcgaattttgggattttaatttgtggaactggaattggaatttctattgctgcaaataaaataaatggaattcgtgccgctctttgtcacaatgaatatacggcaagactttcaagacttcataatgatgcaaatataattgctttgggagctagagttttgggagaagacttgggattggcctgtgttgaaacttttataaatacagaatttgaaggtggcagacatgctagaagagttgggaaaattgaacagtaa

SEQ ID NO: 4082 - DNA, 453 bp, Candidatus Cloacamonas acidaminovorans
ttgtttgatggcggaggaaaaatgaaaatagccattgcttccgatcatgctggttttgaaatgaaagaggcaatcaaaaatgcttttccggaaattgaatttgtggattttggcactcataatacagaaagtatggattatcctgataccggttttcctgctgctaaagcggtagcggaaaaacaatgtgaaaaaggcatcttaatttgtggcagtggaataggaatgagcattactgccaacaaagtgaaaggcataagagctgctttatgtggaaatacagatgtagcacgcctttcacggctgcataatgatgccaatattttggtcttggcaggaagatttactgccattccttacgccatagaaattactaaggtctggctaaacaccccttttgagggaggaagacatttaaatagaattaataaaatacaacaaggagaaaggtaa

SEQ ID NO: 4083 - DNA, 492 bp, Thermobaculum terrenum ATCC BAA-798
atggcaaggcgttatgtggtaggtgtaggggccgatgggctgggagccgagctgaagaacctcatccgagacaggctgcgggaccatcccagggtggccgaggtggtggacttcggggtgggcgatccctccgacagctgcgagtacccccgcgtggggatccaggtggcggaggcggtggccagcggagccatcgatcgcgccgtcttggtgtgcgggaccggcatagggatggcgatatccgccaacaaggtgcgtggggtcagggcgacggtggcgtacgatccctactcggtcgagaggtcggtcctgtccaacaactgccaggtgctctgcctaggcgcaagggtggtgggaccggagttggcctggtatgtggtccgtcagtggctcacgtacgagttcgaccccagctccccgtcggcgcacaagatccagctgatatgcgattacgagcaggggcacctgaccaattccggaggcgatagctga

SEQ ID NO: 4084 - DNA, 453 bp, Paramecium tetraurelia
atgaattaaattaaaatatttattggaaatgaccatgctgcattagattataaaaatactttattagaatatagtaaaaaaaagggatatgatattgaagatctaggaacacacacaaaccaaagttgtgattataatgattatgctcttaatgtatgcaaagaggtcatcaaatctaatgcgattggaatattaatatgtggtagtggagtggggatttcaattatggccaacaaggttaagggcatcagatgcgggtaagtgaatgattatgattcaacattaaaggcattagaaataggatgcaatgtgatttcttttggtgccagaactgttgggatcgagattgccaagtaaattgtggacacttttctttccaatcaaaacagagccaagaatcatgaagttgagaaggaaatttaaagcatcgaggaactaacttatggaaaatga

SEQ ID NO: 4085 - DNA, 492 bp, Paramecium tetraurelia
atgaacacaataagaacaattacgtattattaattttcaaaaaagaattaatataaaatttatatcggcaatgatcatgcaggattggaatacaaaaatataataattgatcatcttaaatagcaagaatatgacataataaatagaggaactaacacaaaacaaagctgtgattacaatgaaatagccacagaattatgctctgatgtcttgagagataagggattgggaatcttaatatgcggaagtggagttggaatgtccattatgtcaaataaagtcaaaggtatcaggtgcggataaatcaatgattacaattctgctaaataagcagctgaaatcggttgcaacgtaatagccttaggctcaagaatattgggaatagaagtagctaaataagttatagatgcatttttgaattcatactaaaatgtccatacagagataaatgaaacaatatcctaaattgagcaggacaattttagaaaatga

SEQ ID NO: 4086 - DNA, 531 bp, Perkinsus chesapeaki
atgtcctcctccactccccaaaagctcctattcgagcccgcagctgcccgtttgcagaacggtttgaaactcgtcttcggctctgatcacgccggcatcgacctcaagaacgagatgatcgactttgtgaagaacaccttgaaggctcccgagggcagcatcacggatgttggcacttacactcacgactcggttgattatccagatttcgcggagaagacctgcaagactcttctgagcacatcggacgatacttcgaaggctctaggcgttgttatttgcggatccggtcttggtatttccatgtcggccaacaagtgcaaaggcattagatgcgccctgtgctctagcaactacgatgctcgttatagccgccttcacaacaacgctaatgttctcgccatgggtggccgtacaactggtgttgaagtcgctcgggaaatactggcaacttacatcaataccgatttcgagggcggtcgccatcagaagcgaattgataagatgatggctctcgaacagaaggactaa

SEQ ID NO: 4087 - DNA, 525 bp, Perkinsus marinus
atgtcgactccccagaagctacttttcgagcccgccaccgcccgtttgcagaacggtttgaagttggtcttcggttctgaccacgccggcatcgacttgaaaaatgagatgatcgatttcgtcaagaacgtcttgaaggcccctgaggggtgcatcacggatgtcggcacttacacgcatgaatcgatcgactaccctgatttcgctgagaaagcttgcaagactcttctgagcatttccaatgatactaccaaggcgttgggtgttgtcatttgcggatctggtctaggaatctcgatgtccgctaacaagtgcaaaggaatcaggtgtgctttgtgctccagcaactacgatgctcgatatagtcgtctccacaacaacgccaacgttcttgctatgggcggtcgtaccacgggtgttgaggttgcgcgagagattcttgctacttacatcaacaccgacttcgagggaggacgccatcagaagagaattgacaagatgatggcccttgagaacaagaactaa

SEQ ID NO: 4088 - DNA, 531 bp, Perkinsus marinus
atggagtatcagcaaactgagaagcttcttttcgcccccgccgccgagcgcctacagaagggtttaaaactcgtcctctgctcggaccacgccggtatcgatctgaagaatcaggttattgatttcatcaagaacgacctcaaggcccctgagggttgcatcgaagatgtcgggtgtttcacgcacgactcagttgactatcctgacttcgctgagaagctcggccgtaaggttgtggctgttgatgatacgacaaagctcctcggtattgccatctgcggcagcggtttgggtatgtcgatatcagtcaacaaggtgaagggtattcgatgtggcctttgtcatggcaactacgatgctcgctatttgcgtatgcacaacaacggaaacgtcctcgcgatgggcggccgtacgaccggtattgagatcgccaaagagatcgttgccacattcatcaacaccaacttctgtggtggtcgtcatcagcggcgcctcgataagatctctgctattgagcaacgcggagattag

SEQ ID NO: 4089 - DNA, 531 bp, Perkinsus marinus
atggagtatccgcaaactgaaaagcttcttttcgcgcccgccgccgagcgtctgcagaagggtttaaaactcgtcttctgctcggaccacgccggtatcgatctgaagaatcaggttattgatttcatcaagaacgaccttaaggcccctgagggttgcatcgaagatgtcgggtgtttcacgcacgactctgttgactatcctgacttcgctgagaagctcggccgtaaggttgtggctgttgatgatacgacaaagctcctcggtattgccatctgcggcagcggtttgggtatgtcgatatcagtcaacaaggtgaagggtattcgatgtggcctttgtcatggcaactacgatgctcgctatttgcgtatgcacaacaacggaaacgtcctcgcgatgggcggccgtacgaccggtattgagatcgccaaagagatcgttgccacattcatcaacaccaacttctgtggtggtcgtcatcagaggcgcctcgataagatctctgcaattgagcaacgcggagattag

SEQ ID NO: 4090 - DNA, 441 bp, Entamoeba dispar
atggaagtaattataggaagtgatcatgctggttttccattaaaagaaattgtaaaaaaatatttaattgaaaaaggaattaaagtagatgatatgggtacttattctactgaaagatgtgattatcctgattttgctgaaaaagtagcacgcgaagttcttaaaactggtaaaaaaggtattttggtatgtggaagtggaattggaatttctatagctgcaaataaaattaatggtatcagatgtgctctttgtcatgaccactatactgctgtaatgtgtagaagacataatgacgctaatattattgcttttggtgctagagttattggatctgatattgctactgacatggttgatgctttcttatctactccttttgatggaatgcaacacactgctcgtgttgaaaaaattcacaaattagaacaaaatcattaa

SEQ ID NO: 4091 - DNA, 441 bp, Entamoeba histolytica
atggaagtaattataggaagtgatcatgctggttttccattaaaagaaattgtaaaaaagtacttaattgaaaaaggaattaaagtaaatgatatgggtacttattctactgaaagatgtgattatcctgattttgctgaaaaagttgcacgtgaagttgttaaaactggaaaaaaaggtattttagtctgtggaagtggaattggaatttctatagctgcaaataaaattaatggtgttagatgtgctctttgtcatgatcattatactgctgtaatgtgtagaagacataacgatgctaatattattgcttttggtgctagagttattggttctgatattgcaactgatatggtagatgttttcttatctactccttttgatggaatgcaacatactgctcgtgttgaaaaaattcataaattagaacaaaatcattaa

SEQ ID NO: 4092 - DNA, 519 bp, Leishmania infantum
atgccgaagcgtgttgctctgggctgcgaccatgccgcgtacgccacacatcaggagatcatggacatggtcaacgccagcggtgccgcgtcgaaggtgatgtacatgggcccctcctccgacacatccgtcgactaccccgactacgccgcgcaggtgtgtgaggccatcttgaagggcgaggcggacacgggtatccttgtctgcggcaccggtatcggcatgtcgatcgcggccaacaagttcagaggcattcgtgcggctctttgctacgaccatgtgacggcgcagctgagccgccagcacaacaacgcccacatcttgtgcattggggtgcgcaccagtggaatggaggttatccgcgacatcatcgagaccttcctcacgacagagccgttggcggaagggcgccacggcaaccgcgtcgacaagatcacggtgattgaggaggagcagatgaaggacgaacagcgatggtgcttcagcggttgtggaggtcttaaggaggaaggaaagtga

SEQ ID NO: 4093 - DNA, 519 bp, Leishmania major
atgtcgaagcgtgttgctctgggctgtgaccacgccgcctacgccgcacatcgggagatcatggacatgatcagcgccagcggtgctgtgtcaaaggtgatgtacatgggcccctcctccgacacatccgtcgactaccccgactacgccgcgcaggtgtgtgaggccatcttgaagggcgaggcggatgcgggcatcctcgtctgcggaaccggcatcggcatgtcgatcgcggccaacaagttcagaggcattcgtgcggcgctttgctacgaccacgtgacggcgcagctgagccgccagcacaacaacgctcacatcttgtgcattggggtgcgcaccagtggcatggagatcatccgcgacatcatcacgaccttcctcacgacagagccgttggcagaagggcgccacagcaaccgcgtcgataagatcacggtgatcgaggaggagcagatgaaggacgaacagcgatgctgcttcagcggttgtggaggccgtaaggaagaaggaaagtga

SEQ ID NO: 4094 - DNA, 471 bp, Leishmania braziliensis
atgtcgaagcgtgttgctctgggctgcgaccatgccgcctacgacattcatcaggagatcatggacatgatcaccaccaccggtgtcgtgtcaaaggtgatatacatgggcccctcctccgcctcgtctgtcgactaccccgactacgccgctcaggtgtgtgaggccatcttgaaaggtgaggcggatacgggcattctcgtctgcggcaccggcattggcatgtcgattgcggccaacaagttcagtggcattcgcgcggcgctctgcaacgaccatgtgacggcgcagctctgccgccagcacaacaacgccaatgtcttgtgcctcggggcgcgcacctgtggcagggagattcttcgcgacattattatcactttcctcacagcagagccatctaaggaggggcgccacggcagccgcatcgccaagatcacagagatcgagagggagcagatgaagaaggaatag

SEQ ID NO: 4095 - DNA, 480 bp, Trypanosoma cruzi
atgacgcgccgagtcgcaatcggtacggatcatccggcattcgccattcatgagaatctgattctgtacgtgaaggaggctggcgacgagtttgtgcctgtgtactgtggaccgaaaacggcggagagtgtcgattacccggactttgccagtcgtgtggcggaaatggtggcaaggaaggaggtggaatttggcgtgctggcatgcggtagtgggatcggcatgtccatcgcagccaacaaagttcccggggtgcgggctgccctctgccatgaccactacaccgcagcgatgtcgcggatccacaacgatgcgaacattgtttgcgtgggagagcggacgactggtgtggaggtcattcgggaaatcatcattacgttcttgcagacgccgtttagcggcgaggagcgccatgtacgacgtattgagaagatacgagccattgaagcctcccacgccgggaaaaaaggggtacaatga

SEQ ID NO: 4096 - DNA, 468 bp, Trypanosoma brucei
atgacgcgcaaggtggctatcggtgctgaccacatcggcttccccattcacgaaagcattgtgcggtacgtgcgggaagcaggtgaggaatttgaacctgtctacattggcccgcacagtttggagagagttgactaccccgattacgccctcaatgtggcacggatggtcgcccgtggcgaggcggacgtcggtattcttgtttgcggcagcggaattggtatgtcgatcgcggcaaataaagtcccaggaattcgtgctgcgctttgtttcgaccactatacggcggtcatggcaagacagcacaacgatgcaaatgtcgtgtgcctcggggagcgcacgacggggccggctgtgctcagggaaattatcatgacgttcctgcagacaccatacagcggggaggaccgtcacacgcagcggctggagaagattaaggctgccgaatctaacacgaatggttgttag

SEQ ID NO: 4097 - DNA, 438 bp, Giardia intestinalis
atgaaggtcgcatttgcttctgatcatggcggcagagggcttcgcttgtttctacaacagcgtgccggtgcaaatggctatgcagtggtggatctaggcacggagagcgatgcttcggtcgactaccccgactttgccaagattggctgcgaggccgtcctttctggcagggctgactgttgcgttctgatctgcggaacaggtattgggataagtatagctgccaacaagatgaagggaattcgctgtgctttatgctcttcagagtatgatgcagaaatggcaaggaagcataacaatgcaaatgcacttgctcttggtggtcgaactactggaccagaggttgcctcatctatcctcttaagattccttgccacagaattcgaaggtggcagacacgctacgcgccttgagaagatcaaggccatggaggaataa

SEQ ID NO: 4098 - DNA, 438 bp, Giardia lamblia ATCC 50803
atgaaggttgcctttgcttctgatcacggtggtagggaccttcgcatgttcctgcagcagcgtgcaagtgcacacggttatgaagtgatggatctgggcacagagagcgatgcttcagtggactatcctgactttgccaaaattggctgtgaagccgtcacctccggcagggctgactgctgcattctagtctgcggaacaggcatagggataagtatagcagccaacaagatgaaggggattcgctgtgctttatgctctacggaatatgatgcggaaatggcaagaaagcacaacaatgcaaacgcgcttgctcttggcggccgaaccactggaccggaagttgctgcatccattctctcacgattccttagcacgaactttgagggcggccgacacgcggcgcgcatcgcaaagatcagcgctatggaagaataa

SEQ ID NO: 4099 - DNA, 516 bp, Pyrenophora tritici-repentis
atgacatcaccaacgcccctccgcatagcaatcggctgcgatgacgcaggcgtctcctacaaaaacgccataaaagccgacctcgaagcctcccccctcgtctccaccatcaccgacgtcggcgtccccaccaacacagacaaaacagcctacccccacatcgccgtcaacgccgccaaactcgtcacctctggcgccgccgaccgcgccctcttaatctgcggcacgggtctcggcgtcgccattgccgcgaacaaggtgcccggtgtccgggccgtgactgcgcatgatagtttttccgtcgagcgcgccgtgctgagtaatgatgcgcaggtgctttgtatgggagagcgggtcgtggggattgagcttgcgaggaggttggtgagggagtggttggggtatcggtttgatacggcgagtgcgagtgcgaagaaggtggatgctattatggagcatgaacgagtgaattttaaggggttggaggcagatttggagggcgccaaggggtgttga

SEQ ID NO: 4100 - DNA, 474 bp, Aspergillus nidulans FGSC A4
atgtctcagagcctccgcatcgtcttcgccgccgacgaggctggccagccctataaggagaccctcaaggaggtcctctccaagaaccccaatgtcagcgaggtcctcgacgtcggtgtcaactcgacctccgacaagactgcctaccctcaccctgccgtcgagggagccaagctcatccgggacggcaaggctgaccgcggcctcttcatctgcggcactggtctgggtgttgccatctccgccaacaaagtccccggcattcgcgccgtcactgcccacgactctttctctgtcgagcgtgccatcctcagcaacgacgcccaggtgctctgcttcggccagcgcgtgatcggtctcgagctggccaagcgcctcgccaacgagtgggtgacctacaagttcgatcccaacagttcctctgcccccaaggtccaggctatcaaggactatgaggccgagttcgcgaagtaa

SEQ ID NO: 4101 - DNA, 489 bp, Aspergillus clavatus
atgtctgccgatctgcaacccctccgcatcgtcatggcctgcgatgaggctggccaaccatacaaggaaattatcaaggccgcactcgagaagaaccctctcgttgcatccgtcaccgacgtcggcgtcaattccacctctgacaagaccgcctatcctcaccctgctgtcgccggcgcggtgctcatcaaggagggcaaggcagaccgtggtcttttcatctgcggtaccggtctcggtgtcgccatcgccgccaacaaggttcccagtatccgcgccgtcacggcccatgatcccttctccgtggagcgcgccatcctgagcaacgacgcccaggttctctgcttcggccagcgcgtcatcggcatcgagctggctaagaagcttgccaacgactggctcacctaccgcttcgacccccagagtgcctcggccgccaaggtccaggccatcagcgactacgagaagcagtttgcgactgctcagtaa

SEQ ID NO: 4102 - DNA, 489 bp, Aspergillus flavus
atgtctgccgatctgaagccccttcgcattgtcatggcctgtgacgaggctggccaaccctacaaggagactctcaaggcagcccttgagaagaaccctctggtcgagtccgtcgatgatgttggtgtcaactcgacctccgacaagactgcctaccctcaccccgccgtcgccggtgctaagctcatcaaggagggtaaggcagaccgtggtctcttcatctgcggtacaggtctgggtgttgccatcgccgccaacaaggttcccggtatccgtgccgtcactgcccacgactccttctccgtcgagcgtgctatcctgagcaacgacgcccacgtcctctgcttcggtcagcgtgtcattggcattgagctcgcgaagaagcttgccaacgagtgggttacctaccgcttcgaccccaagagcgcatctgccgccaaggtccaggctatctccgactacgaggccgaattcgccaaggctcagtag

SEQ ID NO: 4103 - DNA, 489 bp, Aspergillus niger
atgtctgccgatccgaagcccctccgcatcgtcgtggcctgcgatgaggccggccagccctacaaggagaccctgaaggctgctctcgagaagaaccctctggttgagtccatccaagacgtgggcgtcaactctacctccgacaagaccgcctaccctcaccccgctgtcgctggtgccaaactcatcaaggagggcaaggcagaccgtggtctcttcatctgcggtactggtcttggtgtcgccatctccgccaacaaggtgcccggcatccgcgccgtgacggcacacgactccttctccgtcgagcgctccatcctcagcaacgacgcccaggtgctttgctttggccagcgcgtcatcggcattgagcttgcgaagaagctcgccaacgagtgggtgacctaccgcttcgaccccaagagtgcctccgccgccaaggtgcaagccatctccgactacgagaaggaactcgctggtactgcttaa

SEQ ID NO: 4104 - DNA, 456 bp, Aspergillus oryzae
atggcctgtgatgaggctggccaaccctacaaggagactctcaaggcagcccttgagaagaaccctctggtcgagtccgtcgatgatgttggtgtcaactcgacctccgacaagactgcctaccctcaccccgccgtcgccggtgctaagctcatcaaggagggtaaggcagaccgtggtctcttcatctgcggtacaggtctgggtgttgccatcgccgccaacaaggttcccggtatccgtgccgtcactgcccacgactccttctccgtcgagcgtgctatcctgagcaacgacgcccacgttctctgcttcggtcagcgtgtcattggcattgagctcgcgaagaagcttgccaacgagtgggttacctaccgcttcgaccccaagagcgcatctgccgccaaggtccaggctatctccgactacgaggccgaattcgccaaggctcagtag

SEQ ID NO: 4105 - DNA, 486 bp, Aspergillus terreus
atggcctctcccgctcccctccgcatcgtcttcgcctgtgacgaggctggccaaccctacaaggaaaccctcaaggccgctctggagaagaaccccctggtctccgagatcctcgatgtcggcgtcaactccacctccgacaagaccgcctaccctcaccccgccgtcgccggcgccaagctcatcaaggagggcaaggcggaccgcggcctcttcatctgcggcaccggtctgggcgtcgccatctccgccaacaaggtgcctggcatccgcgccgtcaccgcccacgactccttctccgtggagcgctccatcctgagcaacgacgcccaggtcctctgcttcggccagcgcgtcatcggaatcgagctcgccaagaagctcgcgaacgagtgggtgacctaccgcttcgaccccaagagcgcatctgccgccaaggtccaggccatctccgactatgaggcccagctggctggtgcccagtaa

SEQ ID NO: 4106 - DNA, 462 bp, Aspergillus terreus
atggcctgcgacgacgccggccacgactacaaagaagcagtgaaaaaggccctcgaaagcaacccgctggtggactccatcatcgacgtcggcgtcgactcgcccgccgacaagaccgcctacccgcacccggccgtcaaggccgcgctgctggtccgcgacggccaggccgatcgcgcgctgctgatctgcgggacgggcatgggcgtcagtatcgccgcgaacaaagtgccaggaatccgggcggtgacggcccacgatccgttcagcgtggagcgcgccattctcagcaacaacgcacaggtgctgtgcttcggacagcgtgtgattggggttgagctggccaagaagctggccgcggaatgggtgcagtatcggttcgatccgaagagcgcgagcgccgagaagattgcgatgattcatgattatgagaggacgcttgctgcgggtggtgggcaataa

SEQ ID NO: 4107 - DNA, 480 bp, Penicillium chrysogenum
atgtccactcctttccgcattgtcatggcctgcgacgaggccggcgtcccatacaaggatgccatcaaggccaccctcgagaagaaccctctcgtcgccgagatcattgacgtcggtgtcaactcaacctccgataagaccgcctaccctcatcctgccgtcgaaggcgccaagctcatcatggatggcaaggctgaccgtggcctcttcatctgcggcactggtctgggtgttgccatcgctgccaacaaggtgcccggcatccgagctgtcactgcccacgatcccttctccgttgaacgctccatcctgagcaacgacgcccaagtcctgtgcatgggtcagcgtgtcatcggtgtcgaattggccaagaagctcgctaccgactggctcaactaccgcttcgaccccaagtctgcctctgctgccaaggtccaggctatcaccgactatgaggttcagttccgcactgctgcttaa

SEQ ID NO: 4108 - DNA, 483 bp, Penicillium marneffei
atgggcaccgacctcaaacccctccgcatcgtcatggccggcgacgaagccggctacgactacaaagccgccatcaaagacctcctcgaaaagagtccccttgtcgaatccgttgtcgacgtcggcgcaacctccctgaccgacaaaaccgcctaccctcactccgctgtcgagggcgccaaactcattgcagagggcaaagctgaccgtgggctcttcatctgtggcacgggactcggcgtcgccattgccgccaacaaagtgcccggcattcgcgccgtgactgcccacgaccccttttccgttgagcgcgctatcctgagtaacgatgcccagatcctgtgttttgggcagagggttattggtattgagttggccaagaagttgactttggattggttgaactatcgatttgatccaaagagtggttctgctgccaaggtgcaggctatttcggattatgagaagacccttaatgcttaa

SEQ ID NO: 4109 - DNA, 489 bp, Neosartorya fischeri
atgtctaccgatctgaagcccctccgcattgtcatggcctgtgacgaggccggccagccctacaaggagatcatcaaggccgccctggagaagaaccccctggtcgagtccatcaccgacgtcggcgtcaactccacctccgacaagactgcctatcctcaccctgccgtcgccggcgccaaactcatcaaggagggcaacgcagaccgcggtctcttcatctgcggcaccggtctgggtgtcgccatcgccgccaataaggttcccggcatccgcgccgtgaccgctcacgactccttctccgtggaacgctccatcctcagcaacgacgcgcaggtcctctgcttcggccagcgcgtcatcggcatcgagctggccaagaagctcgccaacgaatggctcacctatcgcttcgaccccaagagcgcctctgccgccaaggtccaggccatcaccgactacgagcgggaatttgctgctgctcagtag

SEQ ID NO: 4110 - DNA, 477 bp, Ajellomyces dermatitidis
atgactcccgcacccctccgcattgtcatggcctgcgacgaggccggccacagctacaaagaaaccctaaaagcccacctatcaaacaaccccctcgtcgcctccatcacagacgtgggcgttccctccgccgatgacaaaaccgcctacccgcacgtcgccgtccaggccgcccagctcatcaaggaaggaaaagccgatcgcgcacttctgatctgtggaaccggcctgggtgtggcgattgccgccaataaggttgcgggcatccgtgccgttaccgctcacgatccgttctctgttgagagatccgttctcagcaacgatgcccaggtgctctgctttggccagagagttattggcatcgagctggcaaagaagttggcggctgactggttgaactatcgctttgataccagcagtgcctcctcggctaaggtgaaggttattggcgagtatgaggctaagtttgcttgctaa

SEQ ID NO: 4111 - DNA, 492 bp, Microsporum canis
atggccgcctcactccctccactccgcattgccgttgcctgtgacgatgcaggccactcctacaaggaagccatcaaagcgcacctagagaaaaacccactcgttgcttcgataacggacgtcggcgtgcccgccccaaccgacaaacgagcctaccctcatgtcgccgtcgaggctgcccacttgatcaaggacggaaaagtcgaccgggccctgatgatttgcggcactggtctcggagtagccattgccgccaacaaggtggctggaatcagagccgtgaccgcccacgatccatttagcgtcgagagatccgtcctcagcaacaatgcacaggttctctgctttggccagagagtcatcggtatcgagttggcgaagaagttggtaggcgactggttgacctacagattcgacgagtccagcgccagcgcagagaaagttaaggctatcggagagtacgaggccaagttcggtgaatctaagcaatag

SEQ ID NO: 4112 - DNA, 492 bp, Coccidioides immitis
atggcagcaaccccacttccacctctccgtctcgccatcgcctgcgacgacgccggtgtctcctacaaagaagccctcaaagcccacctctccgacaatcctctcgtctcttccattacggatgtcggtgtcacttccaccaccgacaagaccgcctatccacacgttgccattcaagctgcccaattgatcaaagatggcaaagtcgaccgagcactcatgatctgcggaacaggtctaggcgtagccatctccgcgaacaaggtccccggaatccgggccgtaacggcccacgacacgttcagcgtggagagagcgatcttgagtaacgacgcgcaggtgctctgctttggacagagggttattggaattgaattggcgaagaggttagccggcgagtggctaacgtatcgattcgaccagaagagtgcgagtgcgcaaaaagtgcaggcaatttcagactatgagaagaagttcgtggaggtgaattaa

SEQ ID NO: 4113 - DNA, 531 bp, Coccidioides posadasii C735 delta SOWgp
atggcagcaaccccacttccacctctccgtctcgccatcgcctgcgacgacgccggtgtctcctacaaagaagccctcaaagcccacctctccaacaatcctctcgtctcttccattacggatgtcggtgtcacttccatcaccgacaagaccgcctatccacacgttgccattcaagctgcccaattgatcaaagatggcaaagtcgaccgagcactcatgatctgcggaacaggtctaggcgtagccatctccgcgaacaaggtccccggaatccgggccgtaacggcccacgacacgttcagcgtggagagagcgatcttgagtaatgacgcgcaggtgctctgctttggacagagggttattggaattgaattggcgaagaagttagccggcgagtggctaacgtatcgattcgaccagaagagtgcgagtgcgcaaaaagtgcaggcaatttcggactatgagaagaagttcgtggagggtggcacatacggaagggttggaaaattggatgaattcaagaaatga

SEQ ID NO: 4114 - DNA, 477 bp, Paracoccidioides brasiliensis
atgtcacctgcccccctccgcatcgtcatcgcttgcgacgaagctggccacagctacaaagaaatcctgaaagcccacctgtcatccaaccctctagtttcctctgtcaccgacgttggcgtcccctccgcttctgacaagaccgcctacccacacgtcgccgtgcaggctgcacaactagtcaaggagaggaaagcggaccgcgcccttctggtctgtggaactggtttaggtgtggcgattgccgccaataaggttcccggcatccgtgccgttaccgcccacgacccattctctgtcgagagggctgtactcagcaataatgcacaggtcctctgctttggtcagagagttattggcattgagctggcgaagaagttggctgctgactggctgaactatcgttttgatagcagcagtgcctctgcagctaaggtgaagatcattggcgagtacgaggctaaatttgcttgctaa

SEQ ID NO: 4115 - DNA, 477 bp, Paracoccidioides brasiliensis
atgtctcttgcgcccctccgcatcgttatcgcttgcgacgaagctggccacagctacaaagaaatccttaaagcccacctgtcctctaaccctctagttgcctctgtcaccgacgtcggcgtcccctccgcttctgacaagaccgcctacccacacgttgccgtgcaggctgcacaactagtcaaggagaggagagcggaccgcgcccttctgatctgtggaactggtttaggtgtggcgattgccgccaataaggttcccggcatccgtgccgttaccgcccacgacccgttctctgtcgagagggctgtactcagtaatgatgcacaggtcctctgctttggccagagagttatcggcattgaactggcgaagaagttggctgctgactggctgaactatcgctttgatagcagcagtgcctctgcggctaaggtgaagatcattggcgagtacgaggctaaacttgcttgctaa

SEQ ID NO: 4116 - DNA, 492 bp, Uncinocarpus reesii
atggcgacagcatccctccctcccctccgtctcgccatcgcttgtgacgatgcgggcgtttcctacaaagacaccctcaaagcccatctctcgaacaatcccctcgtctcatccataacagacgtcggcgttgcctcctccaccgacaaaaccgcctaccctcacgttgccatccaagctgcccaactgatcaaggagggcaaagtcgaccgcgcactcatgatctgcggtaccggcctaggtgtggccatttcggcaaacaaggtcccaggaatccgggcggtaacggctcacgatccgttcagcgtggaaagagccgtgttgagcaacgatgcgcaggttttgtgtttcgggcagagagttatcggaatcgagctggcgaagaaattggccagtgagtggttgacgtatcggtttgatcaaaagagtgcgagtgcgcggaaggttgaaactatttctgaatacgagaaaaagttcggagaggtgtattag

SEQ ID NO: 4117 - DNA, 489 bp, Gibberella zeae
atgcctggacttcgtattgttatcggcggagacgacgcaggcttcccctacaagtccataattgctgaagcgctcctcaacgacccacgcgttgaaaccgtcatcgacgccggcccatcaacagaatcagacaaaaccgcttattcgacttttgccattgctgctgcagagaaggtcgcaaggggagaagctgatcgagcgctgttaatctgcggaactggtcttggtgttgctattgccgccaacaaagtccgcggtattcgagctgttacagcacatgatagtttctccgttgagcgttctgttttgagtaacaatgctcaggttttgtgcttgggacagcgtgttgttggaattgagcttgcgaagaggctagtgaaggaatggttggggtatacgtttgaccccaactcttcttctgctgctaaggtcaagattatcgaggattatgataggcaacaaacacttatgacaacagtagctacatag

SEQ ID NO: 4118 - DNA, 471 bp, Nectria haematococca
atggcgccaaagtggagaattgcaatgggctgcgatgaagcaggaatttcctataaaaacgccatcaagcaagactttgaatccgatggccgtgtagaagaggtcctcgacgtcggctccaaccaccacgcagataaaactccctatccactccgcgcagcagaagcagcccgtctagtcgcagagggcaaggcagaccgagcactgctcatctgcggcacaggtctaggtgtggccatctcggcaaacaaggtgaaaggcatccgggcggtgacggcccacgatagcttcagcatcgagaggagcgtcaagagcaacaacgcgcaggtgctgtgttttggcgagcgcgtcatcgggctagagctcgccaggagattagcgaccgagtggctagactacgagtttgatccttcgagtaacagcgccaagaaggtggatgagattgtgcagttggaggcggtggcggcatag

SEQ ID NO: 4119 - DNA, 483 bp, Verticillium albo-atrum
atggctgttctgtccgagtccaggttgagaatcgccatcggctgcgacgacgctggcgttcactacaaggacaagattaagcaagacttcgaaaaagaccctcgtgtagtgctcatcgaagacgtgggaagctatacaggtgatgacaagacggcttatccccaccgggcagcgtctgcagcaaagcttgtggctgatggcacctgtgatcgggcgctgctcatctgtggtacagggcttggcgtcgccattacagcaaacaaaatcaagggcgtacgagcagtgacagcgcacgatagtttctcggttgagcgagccgtcttgagcaacaacgcccaggtcctatgtatgggcgagagggtcgtgggattggagcttgcgaggcgcctggccaaggagtggttggggtacaggttcgatccgcagagcgcgagtgccgccaaggtggatgctatcgtggcgctggagagcgattccgactga

SEQ ID NO: 4120 - DNA, 471 bp, Magnaporthe grisea
atgccaggcctccgcatcgtcctcggcggcgacgacgccggcttcgcctacaagtcgaccctcgccgccgacctggacgccgacccgcgcgtggcctccgtcgacgatgtaggccccctcgccgactcggacaagacggcctactcgacttttgccatccgggccgcggaaaaggtggcgtcgggcgaggcggaccgcgcgctcctcatctgcgggaccggactgggcgtcgcaatcgccgcgaacaaggtccccggggtccgggccgtgacggcgcacgacagcttcagcgtcgagaggagcgtgctgagcaacgatgcgcaggtgctgtgcatcgggcagagggttatcggcatcgagttggccaggaggttggtcaaggagtggttggggtacacgtttgatccgaactctgcatcagcggccaaggtcaaaatcatcaacgattacaacgccgacaagtcaaagtaa

SEQ ID NO: 4121 - DNA, 498 bp, Chaetomium globosum
atgagttcaccaaagtggcgtatcgttgtcggctgcgatgacgccggcgtcggttacaagaacaagatcaaggcggactttgccgctgacgaccgtgtcgcctcggtgattgatgtcggtgccgacgacaagacggcctacccgcacgtcgccgcgaaggccgctaaactggtggcttcaggggaatgcgacagggcgctcctgatctgcgggacgggcctcggcgtggctatctcggccaacaagatcaagggtatccgggctgtcaccgcacatgacagcttttcggtggagagggcggtgctgagcaacaacgcgcaggtgctgtgcatgggggaacgggtggtggggctggaacttgctcggcggctggccaaagagtggttggggtacgtgtttgacgagagcagccccagtgctgccaaggtcgcggctatccacgagtatgaagagggggaggggggcttgtcggggcatgaggaggtgaagggatgttga

SEQ ID NO: 4122 - DNA, 510 bp, Podospora anserina
atgagctcaccacagtggaagattgccgttggctgcgatgacgccggcgtgagctacaagaacaaaatcaaagaagacttcgcggccgatccccgggtcatctcagtcgtcgacgtcggtgccacgggcaaggaggacaagacggcatacccacacatcgccgcggcggcggccaaactcgtggcctcgggagaggtcgaccgagctctgttgatctgcggcactggcctcggcgttgccattgccgccaataagatcaaggggatcagggcagtcaccgcacacgacagcttctcggtcgagagagcggtcctcagcaacaatgcccaggtgttgtgcatgggggagcgggtggtgggactggagcttgcgaggaggctcgcaaaggagtggttgggatatgtctttgacgagaagagcgccagtgctgccaaggtggctgccattcatgaatacgaagaaggggaacatggtctttctggggcggcggaggaagtgaagggttgctga

SEQ ID NO: 4123 - DNA, 522 bp, Neurospora crassa
atgtctacaacaacaccacaaccacgatggcgcatcgccgtcggctgcgatgacgccggcatcaactacaagaacaaaatcaaatccgacctctcctctgaccctcgcgtaatttccgtcatcgacgtcggcgtcgcccacgactctcaagacaggtccaccgcctacccacacatcgccgccgcagccgccaagctggtcgcgtcgggcgaatgcgaccgcgccttgctcatctgcggcaccggattaggggtggccatcgcagccaacaaaatcaagggtatccgggcggttacggcccacgatagcttttcggtggagagagccgtgttgagcaataatgcccaggtgctgtgtatgggtgaacgggtggtcgggctggaacttgcgcggagactggcgaaggagtggttgggctatgtgtttgatgagagtagtgctagtgcggagaaggtgagggctattcatgagtatgaggggagggaagggggtagagaggcggagtgggtgaaggggtgttag

SEQ ID NO: 4124 - DNA, 471 bp, Yarrowia lipolytica
atgggattcactattgttgttggatgcgacgaggctggcgttgattacaagaacagaatcaaggccgatctcgaaaagtcccctcgagtcgacaaggtcattgacgttggtgtcaaggcctcggaagacaagaccgcctaccccaacattgccattgctgctgctgagaaggtggcctccggcgaggccgaccgagccattctcatctgtggtaccggtcttggtgtcgccatctccgccaacaaggtggccggtgttcgagccgtgactgcacatgactccttctccgtcgagcgatccattctttccaacaacgcccagattctctgcatgggccagcgggtggttggaatcgagcttgctcgacgtctggtggccgagtggctcacctacgagtttgaccagacctctgcttctgccgctaaggttgccgatattgagacctacgagaagaagcacattgctgcctaa

SEQ ID NO: 4125 - DNA, 492 bp, Debaryomyces hansenii
atgggacaaagaatcagaattgtagtaggttgcgatcaagctggctatgaatacaaagaagcaattaaaaaagatctccaaaacaatccccttgttgaaagtataaaagatatcggtgttccaagcaatacagactcaacatcttaccctcttattggtataaaagctggtgagatgattcaaacaggtgaagccgatcgtgctattttaatttgcggtactggcttaggggtggcaatatcggccaataaggtttcagaaattagagcagtcactgctcatgatagttttagcgttgagcgtagtattctttccaataactgccaagttttatgcatgggtcaaagagttgttggtttagaacttgctagaagattggcttctgaatggttaacatatatatttgatgaaacaagtggatctgctgccaaggttaaggcgcttgttgattatgaacataaatctccacaggttctgctgcctaatatttag

SEQ ID NO: 4126 - DNA, 492 bp, Debaryomyces hansenii; identical to SEQ ID NO: 4125

SEQ ID NO: 4127 - DNA, 471 bp, Debaryomyces hansenii
atgagtaacattaaattaagaatcgtagttggctgcgaccaagcaggttacgaatacaaggaacaaatcaaaaaagatcttgaatctaatacgaatgttgaaaaagttattgatgtaggcgttgactccaatggtagcaaaactgcttatcctttgattggtattgatgctgcggaaaaaattgccaaaggtgaagctcaccgagccatcttaatttgcggtactggtttaggtgttgccatttctgctaacaaagtcaagggtattagagccgtcactgctcacgattcattcagcgttgaaagaagcatattaagcaacaattgtcaagttttatgtatgggtcaaagagttattggtttagaacttgccagaagattggttaaagagtggttgacttatgcgtttgatcagactagtgcttctgctaagaaagttactgcgatcgaaaattatgaaggttgtgcttaa

SEQ ID NO: 4128 - DNA, 471 bp, Pichia stipitis
atgactactgctgggctcagaattgtcattggttgcgatgaagcaggtttcgaatataagcaaaagctccagcaagaccttgaaaagaatgacttggtatctgaagttatagacattggtattaatactaaaggtgatcatctcgcgtaccctcatgttggtatcaaggctggtgaattaatcagagatggaaaggctgacagagccttattgatctgtggtactggtttaggggtagcaatcagtgcaaacaaggttgctggtattagagctgtaactgcacatgacagcttcagtgtcgaaagaagtatcctttctaacaattgtcatgtcttgtgtatgggtcaaagagtgataggtattgaattggctagaagattagtggcagaatggttgacttacaatttcgatgaatccagcgcctctgcctcaaaagtagctgttctcaaaagatatgaatccatctgttaa

SEQ ID NO: 4129 - DNA, 510 bp, Cryptococcus neoformans var. neoformans JEC21
atgtcccagcctccttacactattgttcttgcctgcgacagcgctggacacgaatacaagtccgcccttaaggccttgctcgaatctgacaagcgagtcaagggcgttatcgacgtcggtatcaacaaggatgccagcggcaagcttgaagacaccgcttacccccacatcgctgtcgatgctgctaggaaggtcgccaagggtgaggctgataggggattgttgatctgcggtaccggtatgggcgtcgccatctctgccaacaaggtgcccggtatccgagcttccgtcgcccacgactcattctctgtcgaacgtctcatcaagtccaacaatgcccaaatcctctgtctcggccaacgagtcatcggtatcgagcttgccaagaagcttgttgctgaatggctcggtcacgtctttgacccttcatccgcgagcaacgataaggtcaaggtcatccatgactacgatggatatgagtatgaggctgttcccggtggatgcacttga

SEQ ID NO: 4130 - DNA, 486 bp, Ustilago maydis
atggccgcacctcaacaaaagtggaagatcgcctttggctgcgacgaagccggtgtcgactacaagaacgcacttatcaaagactttgaggcggatgctcgcgttgaatccgtgatcgacgtcggtgtcccttccaacgccgacaagactgcctatccccatgttgccgttaccgctgctcgcaaggtcgccagcggtgaggttgaccgtgcgcttctcatctgcggtaccggtctaggtgtcgccattgccgccaataaggtgaacggcgtccgtgccgttaccgcacacgactcgtactcggtcgaacgcgcgatcctttccaatgacgcgcaagtactctgcatgggtcagcgcgtcatcggtctcgagctcgccagaaagctcgcaaaggagtggctctcttaccgcttcgacgcctcgagcgcctccgctgcaaaggtacaggccatctgctcgtacgagcacgccgctgacaagcagtag

SEQ ID NO: 4131 - DNA, 435 bp, Trichomonas vaginalis
atgaagattgtcgttggatgcgaccatggtggctttgccttaaagcaaacagttattgatacagtcaagtcccttggccacgaagttattgatgttggcacaaattctacagaatctgttgactatccagacttcgctcaagccgctgctaaggaaattgagtcaggaaacgctcaactgggtgttcttatctgcggaactggtatcggaatttccattgctgctaacaaatgcaagggaatcagatgcgctctttgccacgaacaccttacagctcaactctgccgccagcacaacaatgctaacatcgttgctatgggtgcacgtatcattggcccagaaacagctattgatatcgtcaaaacattccttacaacagatttcctcggcgatcgtcatgagcgccgtgttaacaagatcatggctctcgagtaa

SEQ ID NO: 4132 - DNA, 435 bp, Trichomonas vaginalis
atgaaagttgttgttggctgtgatcacggtggcttcgctttaaagcaaacagttatcgatacaatcaagtctcttggacatgaggttatcgatgttggtacaaattcaacagaatctgttgattatccagattatgctcaaaaagcagctcatgagatccaatcaggaaatgctcagtttggtgttttgatttgcggaacaggcattggcatttctatcgctgccaacaaatgcaaaggaattagatgtgcactttgccatgaacatcttactgctgagctttgccgccagcacaacaatgcaaacatcgtcgcaatgggcgctcgtatcattggcccagagacagccattgatattgtcaagacattccttactacgaatttccttggcgatcgtcatgaacgtcgcgtctgcaagattatgtctctcgagtaa

What is claimed is:

1. A recombinant bacterial host cell comprising:

a) a xylose metabolic pathway comprising at least one gene encoding a polypeptide having xylose isomerase activity;

b) at least one gene encoding a polypeptide having ribose-5-phosphate isomerase activity selected from the group consisting of ribose-5-phosphate isomerase A and ribose-5-phosphate isomerase B; and c) at least one genetic modification which increases ribose-5-phosphate isomerase activity in the host cell as compared with ribose-5-phosphate isomerase activity in the host cell lacking said genetic modification;

wherein the bacterial host cell utilizes xylose to produce ethanol; and wherein the bacterial host cell is selected from the group consisting of *Zymomonas* and *Zymobacter*.

2. The recombinant host cell of claim 1 wherein the at least one genetic modification of step (c) is over-expression of an endogenous gene encoding a polypeptide having ribose-5-phosphate isomerase activity.

3. The recombinant host cell of claim 1 wherein the at least one genetic modification of step (c) is expression of at least one non-endogenous gene encoding a polypeptide having ribose-5-phosphate isomerase activity.

4. The recombinant microorganism of claim 1 wherein the polypeptide having ribose-5-phosphate isomerase activity has the EC classification EC 5.3.1.6.

5. The recombinant host cell of claim 1 wherein the ribose-5-phosphate isomerase A polypeptide:

i) gives an E-value score of 0.1 or less when queried using a Profile Hidden Markov Model prepared using SEQ ID NOs:, 86, 96, and 97; the query being carried out using the hmmsearch algorithm wherein the Z parameter is set to 1 billion, and ii) has aspartic acid and glutamic acid at positions corresponding to 107 and 129, respectively, in the *Saccharomyces cerevisiae* RPI-A protein of SEQ ID NO:97.

6. The recombinant host cell of claim 1 wherein the ribose-5-phosphate isomerase A has an amino acid sequence having at least 90% identity to an amino acid sequence selected from the group consisting of SEQ ID NOs:86, 96 and 97 based on the Clustal W method of alignment using the default parameters of GAP PENALTY=10, GAP LENGTH PENALTY=0.1, and Gonnet 250 series of protein weight matrix.

7. The recombinant host cell of claim 6 wherein the ribose-5-phosphate isomerase A has an amino acid sequence having at least 90% identity to an amino acid sequence selected from the group consisting of SEQ ID NOs: 86, 96, and 97 based on the Clustal W method of alignment using the default parameters of GAP PENALTY=10, GAP LENGTH PENALTY=0.1, and Gonnet 250 series of protein weight matrix.

8. The recombinant host cell of claim 1 wherein said microorganism further comprises at least one genetic modification which increases xylose isomerase activity as compared to xylose isomerase activity in the microorganism lacking said genetic modification.

9. The recombinant host cell of claim 1 wherein the gene encoding a polypeptide having xylose isomerase activity is over-expressed.

10. The recombinant microorganism of claim 1 wherein the gene encoding a polypeptide having xylose isomerase activity is expressed in multicopy.

11. A process for producing ethanol comprising:

a) providing a recombinant bacterial host cell of claim 1; and b) culturing the bacterial host cell of (a) in a medium comprising xylose whereby xylose is converted to ethanol.

12. The process of claim 11 wherein the medium comprises either a mixture of sugars including xylose or xylose as a sole sugar.

* * * * *